United States Patent 11,098,302 (IDENTIFICATION OF POLYNUCLEOTIDES ASSOCIATED WITH A SAMPLE) - sequence listing, part 38

SEQ ID NO: 128274 - DNA, 777 bp, Homo sapiens
  misc_feature: GYAE6OF01C17HA.2.70.G04.1.454.CMB.1.raw
tcagacgctcgacacacgaccggtgctcgatttagtgtagtgtgaagggaaagggggaagagctgctcagttaggaccagagggaccatggaacccagcgcagcttctcttcctcctgctactctggcctcccagtactaccaccggaagaaacttgtgttgacgcagtcctcgaggacctacccttgttctttcgtacctaccggaagggggaaacgacgaccctacccttcttcgttcggcgacgggaccagtacgagtacgttggttacgggacaacggtaaaacgacgttacctttccgtccgttacggtaccgaacggaccgaaacggtaaaacccgtcgggtacccaaccggtccctaccccgtaacggccttacctacctacttacgtacgtcgtacctaactacgttccgacgccgaacgccgtaccacgtacggctaaccgtacccgagtacgtacggttacgaggtacggcgtaggttcggtacgtacgggactaggttactaccgtacttccacgactatcgagacgtaacggacggtacggacgcgttaggtagtttagttacgacgttaagttcggtaacttacgtcgttcaaggttcgttagggtcggttacgggtactacgttagggtacgttcgggttacggtttaacgggttccggggaaccgggtaacggggtaaccgacggttaccgggtaaggtaaccgttaacggtaaccgaaaacgggttcgggttacggtcgggaccttacgagttacccgtag

SEQ ID NO: 128275 - DNA, 245 bp, Homo sapiens
  misc_feature: GYAE6OF02HIL9V.2.70.G04.1.454.CMB.1.raw
  modified_base (244)..(245): a, c, t, g, unknown or other
  misc_feature (244)..(245): n is a, c, g, or t
tcagacgctcgacacacgaccggtgctcgatttagtgtagtgtgaagggaagggccggcgcgggagcgaatgagttctgggccagggaaccctggtcaccgtctcctcagcctccaccaagggcccatcggtcttcccctggcgccctgctccaggagcacctccgagagcacagcggccctgggctgcctggtcaaggactacttcctgtcgagcgtctgagcgggctggcaaggcgcatagnn

SEQ ID NO: 128276 - DNA, 247 bp, Homo sapiens
  misc_feature: GYAE6OF02GEC3M.2.70.G04.1.454.CMB.1.raw
  modified_base (244)..(247): a, c, t, g, unknown or other
  misc_feature (244)..(247): n is a, c, g, or t
tcagacgctcgacacacgaccggtgctcgatttagtgtagtgtgaagggaagggccggcgcgggagcgaatgagttctgggccagggaaccctggtcaccgtctcctcagcctccaccaagggcccatcggtcttcccctggcgccctgctccaggagcacctccgagagcacagcggccctgggctgcctggtcaaggactacttcctgtcgagcgtctgagcgggctggcaaggcgcatagnnnn

SEQ ID NO: 128277 - DNA, 249 bp, Homo sapiens
  misc_feature: GYAE6OF02GHVJS.2.70.G04.1.454.CMB.1.raw
  modified_base (247)..(249): a, c, t, g, unknown or other
  misc_feature (247)..(249): n is a, c, g, or t
tcagacgctcgacacacgaccggtgctcgatttagtgtagtgtgaagggaaagggccggcgcgggagcgaatgagttctggggccagggaaccctggtcaccgtctcctcagcctccaccaagggcccatcggtcttccccctggcgccctgctccaggagcacctccgagagcacagcggccctgggctgcctggtcaaggactacttcctgtcgagcgtctgagcgggctggcaaggcgcatagnnn

SEQ ID NO: 128278 - DNA, 244 bp, Homo sapiens
  misc_feature: GYAE6OF02I2PFG.2.70.G04.1.454.CMB.1.raw
  modified_base (241)..(244): a, c, t, g, unknown or other
  misc_feature (241)..(244): n is a, c, g, or t
tcagacgctcgacacacgaccggtgctcgatttagtgtagtgtgaagggaagggccggcgcgggagcgaatgagttctgggccagggaacctggtcaccgtctcctcagcctccaccaagggcccatcggtcttcccctggcgccctgctccaggagcacctccgagagcacagcggccctgggctgcctggtcaaggactacttcctgtcgagctctgagcggctggcaaggcgcatagnnnn

SEQ ID NO: 128279 - DNA, 283 bp, Homo sapiens
  misc_feature: GYAE6OF02GYOSM.2.70.G04.1.454.CMB.1.raw
  modified_base (252)..(283): a, c, t, g, unknown or other
  misc_feature (252)..(283): n is a, c, g, or t
tcagacgctcgacacacgaccggtgctcgatttagtgtagtgtgaagggaaaggggccggcggcgggagcgaatgagttctggggccagggaaccctggtcaccgtcttcctcagcctccaccaagggcccatcggtcttcccctggcggccctgctccaggagcactccgagagcacagcggccctgggctgcctggtcaagggactacttcctgtcgagcgtctgagcgggctgggctaaggcgcatagnnnnnnnnnnnnnnnnnnnnnnnnnnnnnnnn

SEQ ID NO: 128280 - DNA, 254 bp, Homo sapiens
  misc_feature: GYAE6OF02HD9O1.2.70.G04.1.454.CMB.1.raw
  modified_base (249)..(254): a, c, t, g, unknown or other
  misc_feature (249)..(254): n is a, c, g, or t
tcagacgctcgacacacgaccggtgctcgatttagtgtagtgtgaagggaaagggccgggcgcgggagcgaatgagttctggggccagggaaccctggtcaccgtctcctcagcctccaccaagggcccatcggtcttccccctggcgccctgctccgaggagcacctccgagagcacagcggccctgggctgcctggtcaaggactacttcctgtcgagcgtctgagcgggctggcaaggcgcatagnnnnnn

SEQ ID NO: 128281 - DNA, 251 bp, Homo sapiens; identical to SEQ ID NO: 128085
  misc_feature: GYAE6OF02IR090.2.70.G04.1.454.CMB.1.raw
  modified_base (248)..(251): a, c, t, g, unknown or other
  misc_feature (248)..(251): n is a, c, g, or t

SEQ ID NO: 128282 - DNA, 249 bp, Homo sapiens; identical to SEQ ID NO: 128036
  misc_feature: GYAE6OF02H7UQG.2.70.G04.1.454.CMB.1.raw
  modified_base (247)..(249): a, c, t, g, unknown or other
  misc_feature (247)..(249): n is a, c, g, or t

SEQ ID NO: 128283 - DNA, 253 bp, Homo sapiens; identical to SEQ ID NO: 128051
  misc_feature: GYAE6OF02G30UE.2.70.G04.1.454.CMB.1.raw
  modified_base (248)..(253): a, c, t, g, unknown or other
  misc_feature (248)..(253): n is a, c, g, or t

SEQ ID NO: 128284 - DNA, 250 bp, Homo sapiens; identical to SEQ ID NO: 128024
  misc_feature: GYAE6OF02HQX2E.2.70.G04.1.454.CMB.1.raw
  modified_base (246)..(250): a, c, t, g, unknown or other
  misc_feature (246)..(250): n is a, c, g, or t

SEQ ID NO: 128285 - DNA, 250 bp, Homo sapiens; identical to SEQ ID NO: 128042
  misc_feature: GYAE6OF02H1RC6.2.70.G04.1.454.CMB.1.raw
  modified_base (247)..(250): a, c, t, g, unknown or other
  misc_feature (247)..(250): n is a, c, g, or t

SEQ ID NO: 128286 - DNA, 517 bp, Homo sapiens
  misc_feature: GYAE6OF02HG029.2.70.G04.1.454.CMB.1.raw
  modified_base (202)..(202): a, c, t, g, unknown or other
  misc_feature (202)..(202): n is a, c, g, or t
  modified_base (245)..(245): a, c, t, g, unknown or other
  misc_feature (245)..(245): n is a, c, g, or t
tcagacgctcgacacacgaccggtgctcgatttagtgtagtgtgaagggaaaggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaagngccaccctctcttgcagggccagtcagactgttggcagaaacngcttctcctggtaccagcagaaacctggccacgctccaggcctcctcatctatgctacattcagcagcgccactggcatcccagacaggttcagtggcaggtgggtctgggacagagttcactctcaccatcagcagacgtggagccgtggaggtattttgctagttgttattactgtcatcagttggtgggtctcgagtcgtgctaggtttggccgtaggggaccaggtcgtggagagtacgaaacgtacgtggtaggcgtgcctactacg

SEQ ID NO: 128287 - DNA, 249 bp, Homo sapiens; identical to SEQ ID NO: 128277
  misc_feature: GYAE6OF02HEZ1K.2.70.G04.1.454.CMB.1.raw
  modified_base (247)..(249): a, c, t, g, unknown or other
  misc_feature (247)..(249): n is a, c, g, or t

SEQ ID NO: 128288 - DNA, 273 bp, Homo sapiens
  misc_feature: GYAE6OF02HMEG7.2.70.G04.1.454.CMB.1.raw
  modified_base (249)..(273): a, c, t, g, unknown or other
  misc_feature (249)..(273): n is a, c, g, or t
tcagacgctcgacacacgaccggtgctcgatttagtgtagtgtgaagggaaagggccgggcgcgggagcgaatgagttctggggccgagggaacctggtcaccgtctcctcagcctccaccaaggcccatcggtcttccccctggcgccctgctccaggagcaacctccgagagcacagcggccctgggctgcctggtcaaggactacgttcctgtcgagcgtctgagcgggctggcaaggcgcatagnnnnnnnnnnnnnnnnnnnnnnnnn

SEQ ID NO: 128289 - DNA, 249 bp, Homo sapiens; identical to SEQ ID NO: 128277
  misc_feature: GYAE6OF02FJ7T1.2.70.G04.1.454.CMB.1.raw
  modified_base (247)..(249): a, c, t, g, unknown or other
  misc_feature (247)..(249): n is a, c, g, or t

SEQ ID NO: 128290 - DNA, 249 bp, Homo sapiens; identical to SEQ ID NO: 128277
  misc_feature: GYAE6OF02GIKM8.2.70.G04.1.454.CMB.1.raw
  modified_base (247)..(249): a, c, t, g, unknown or other
  misc_feature (247)..(249): n is a, c, g, or t

SEQ ID NO: 128291 - DNA, 274 bp, Homo sapiens
  misc_feature: GYAE6OF02GU2H6.2.70.G04.1.454.CMB.1.raw
  modified_base (250)..(274): a, c, t, g, unknown or other
  misc_feature (250)..(274): n is a, c, g, or t
tcagacgctcgacacacgaccggtgctcgatttagtgtagtgtgaagggaaagggccggcgcgggagcgaatgagttctgggccagggaaccctggtcaccgtcgtccctcagcctccaccaagggcccatcggtcttccccctggcgccctgctccaggagcacctccgagagccacagcggccctgggctgcctggtccaaggctacttcctgtcgagcggtctgagcgggctggcaaggcgcatagnnnnnnnnnnnnnnnnnnnnnnnnn

SEQ ID NO: 128292 - DNA, 255 bp, Homo sapiens
  misc_feature: GYAE6OF02JCGHO.2.70.G04.1.454.CMB.1.raw
  modified_base (248)..(255): a, c, t, g, unknown or other
  misc_feature (248)..(255): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggcccatcggtcttccccctggcgccctgctccaggagcacctccgagagcacagcggccctgggctgcctggtcaaggactacttcctgtcgagcgtctgagcgggctggcaaggcgcatagnnnnnnnn

SEQ ID NO: 128293 - DNA, 251 bp, Homo sapiens; identical to SEQ ID NO: 128085
  misc_feature: GYAE6OF02IBPGT.2.70.G04.1.454.CMB.1.raw
  modified_base (248)..(251): a, c, t, g, unknown or other
  misc_feature (248)..(251): n is a, c, g, or t

SEQ ID NO: 128294 - DNA, 513 bp, Homo sapiens
  misc_feature: GYAE6OF02HCN4E.2.70.G04.1.454.CMB.1.raw
  modified_base (201)..(201): a, c, t, g, unknown or other
  misc_feature (201)..(201): n is a, c, g, or t
  modified_base (244)..(244): a, c, t, g, unknown or other
  misc_feature (244)..(244): n is a, c, g, or t
tcagacgctcgacacacgaccggtgctcgatttagtgtagtgtgaagggaaaggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaangccaccctctcttgcagggccagtcagactgttggcagaaacngcttctcctggtaccagcagaaacctggccacgctcccaggctcctcatctatgctacattcagcagcgccactggcatcccagacaggttcagtggcagtgggtctgggacagagttcactctcaccgatcagcagactggagcctgaggtattttgctagtgtattactgtctatcaggttggtgggtctcgagtcgttgctagtttggccgtaggggaccaaggcgtaggagtagtacgaaacgacgtggtcggcgtgcacctacg

SEQ ID NO: 128295 - DNA, 249 bp, Homo sapiens
  misc_feature: GYAE6OF02HP90J.2.70.G04.1.454.CMB.1.raw
  modified_base (248)..(249): a, c, t, g, unknown or other
  misc_feature (248)..(249): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggcccatcggtcttccccctggcgccctgctccaggagcacctccgagagcacagcggccctgggctgcctggtcaaggactacttcctgtcgagcgtctgagcgggctggcaaggcgcatagnn

SEQ ID NO: 128296 - DNA, 252 bp, Homo sapiens; identical to SEQ ID NO: 128169
  misc_feature: GYAE6OF02F65BW.2.70.G04.1.454.CMB.1.raw
  modified_base (248)..(252): a, c, t, g, unknown or other
  misc_feature (248)..(252): n is a, c, g, or t

SEQ ID NO: 128297 - DNA, 249 bp, Homo sapiens; identical to SEQ ID NO: 128295
  misc_feature: GYAE6OF02HBY69.2.70.G04.1.454.CMB.1.raw
  modified_base (248)..(249): a, c, t, g, unknown or other
  misc_feature (248)..(249): n is a, c, g, or t

SEQ ID NO: 128298 - DNA, 245 bp, Homo sapiens
  misc_feature: GYAE6OF02FGAJY.2.70.G04.1.454.CMB.1.raw
  modified_base (244)..(245): a, c, t, g, unknown or other
  misc_feature (244)..(245): n is a, c, g, or t
tcagacgctcgacacacgaccggtgctcgatttagtgtagtgtgaagggaagggccggcgcgggagcgaatgagttctgggccagggaaccctggtcaccgtctcctcagcctccaccaagggcccatcggtcttccccctggcgccctgctccaggagcacctccgagagcacagcggccctgggctgcctggtcaaggatacttcctgtcgagcgtctgagcgggctggcaaggcgcatagnn

SEQ ID NO: 128299 - DNA, 251 bp, Homo sapiens
  misc_feature: GYAE6OF02F1MCL.2.70.G04.1.454.CMB.1.raw
  modified_base (247)..(251): a, c, t, g, unknown or other
  misc_feature (247)..(251): n is a, c, g, or t
tcagacgctcgacacacgaccggtgctcgatttagtgtagtgtgaagggaaagggccggcgcgggagcgaatgagttctggggccagggaaccctggtcaccgtctcctcagcctccaccaagggcccatcggtcttccccctggcgccctgctccaggagcacctccgagagcacagcggccctgggctgcctggtcaaggactacttcctgtcgagcgtctgagcgggctggcaaggcgcatagnnnnn

SEQ ID NO: 128300 - DNA, 501 bp, Homo sapiens
  misc_feature: GYAE6OF02I49JM.2.70.G04.1.454.CMB.1.raw
  modified_base (202)..(202): a, c, t, g, unknown or other
  misc_feature (202)..(202): n is a, c, g, or t
  modified_base (245)..(245): a, c, t, g, unknown or other
  misc_feature (245)..(245): n is a, c, g, or t
  modified_base (251)..(251): a, c, t, g, unknown or other
  misc_feature (251)..(251): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaangccaccctctcttgcagggccagtcagactgttggcagaaacngcttcncctggtaccagcagaaacctggccacgctccaggctcctcatctatgctacattcagcagcgccactggcatcccagacaggttcagtgcagtggtctgggacagagttcactctcaccatcagcagactggagctgaggtatttgctagtgtattactgtcatcagtgtgggtctcgagcgtgcgtagtttgccgtagggaccaaggcgtggagagttacgaaacgacgtgtaggcgtcgactacgtac

SEQ ID NO: 128301 - DNA, 250 bp, Homo sapiens; identical to SEQ ID NO: 128092
  misc_feature: GYAE6OF02HFDN3.2.70.G04.1.454.CMB.1.raw
  modified_base (248)..(250): a, c, t, g, unknown or other
  misc_feature (248)..(250): n is a, c, g, or t

SEQ ID NO: 128302 - DNA, 251 bp, Homo sapiens; identical to SEQ ID NO: 128085
  misc_feature: GYAE6OF02HB8JR.2.70.G04.1.454.CMB.1.raw
  modified_base (248)..(251): a, c, t, g, unknown or other
  misc_feature (248)..(251): n is a, c, g, or t

SEQ ID NO: 128303 - DNA, 251 bp, Homo sapiens; identical to SEQ ID NO: 128299
  misc_feature: GYAE6OF02GP878.2.70.G04.1.454.CMB.1.raw
  modified_base (247)..(251): a, c, t, g, unknown or other
  misc_feature (247)..(251): n is a, c, g, or t

SEQ ID NO: 128304 - DNA, 247 bp, Homo sapiens; identical to SEQ ID NO: 128034
  misc_feature: GYAE6OF02FWFRV.2.70.G04.1.454.CMB.1.raw
  modified_base (246)..(247): a, c, t, g, unknown or other
  misc_feature (246)..(247): n is a, c, g, or t

SEQ ID NO: 128305 - DNA, 252 bp, Homo sapiens; identical to SEQ ID NO: 128169
  misc_feature: GYAE6OF02FOBMX.2.70.G04.1.454.CMB.1.raw
  modified_base (248)..(252): a, c, t, g, unknown or other
  misc_feature (248)..(252): n is a, c, g, or t

SEQ ID NO: 128306 - DNA, 273 bp, Homo sapiens
  misc_feature: GYAE6OF02GQJOU.2.70.G04.1.454.CMB.1.raw
  modified_base (248)..(273): a, c, t, g, unknown or other
  misc_feature (248)..(273): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggcccatcggtcttccccctggcgccctgctccaggagcacctccgagagcacagcggccctgggctgcctggtcaaggctacttcctgtcgagcgtctgagcgggctgggcaaggcgcatagnnnnnnnnnnnnnnnnnnnnnnnnnn

SEQ ID NO: 128307 - DNA, 262 bp, Homo sapiens
  misc_feature: GYAE6OF02HCU7J.2.70.G04.1.454.CMB.1.raw
  modified_base (249)..(262): a, c, t, g, unknown or other
  misc_feature (249)..(262): n is a, c, g, or t
tcagacgctcgacacacgaccggtgctcgatttagtgtagtgtgaagggaaagggccggcgcgggagcgaatgagttctggggccagggaaccctggtcaccgtctcctcagcctccaccaagggcccatcggtcttccccctggcgccctgctccaggagcacctccgagtagcacagcggccctgggcctgcctggtcaaggactacttcctgtcgagcgtctgagcgggctggcaaggcgcatagnnnnnnnnnnnnnn

SEQ ID NO: 128308 - DNA, 504 bp, Homo sapiens
  misc_feature: GYAE6OF02JDF3U.2.70.G04.1.454.CMB.1.raw
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaagagccaccctctcttgcagggccagtcagactgttggcagaaacagcttctcctggtaccagcagaaacctggccacgctcccaggctcctcatctatgctacattcagcagcgccactggcatcccagacaggttcagtgcagtgggtctgggacagagttcactctcaccatcagcagactggagcctgaggtatttgctagtgtattacgtgtcatcaggtgtggggtctcgagtcgtgctaggtttgccgtaggggaccaaggcgtggagatacgaagacgtggtaggctgccactacg

SEQ ID NO: 128309 - DNA, 252 bp, Homo sapiens
  misc_feature: GYAE6OF02JVXB4.2.70.G04.1.454.CMB.1.raw
  modified_base (247)..(252): a, c, t, g, unknown or other
  misc_feature (247)..(252): n is a, c, g, or t
tcagacgctcgacacacgaccggtgctcgatttagtgtagtgtgaagggaaagggccggcgcgggagcgaatgagttctggggccagggaaccctggtcaccgtctcctcagcctccaccaagggcccatcggtcttccccctggcgccctgctccaggagcacctccgagagcacagcggccctgggctgcctggtcaaggactacttcctgtcgagcgtctgagcgggctggcaaggcgcatagnnnnnn

SEQ ID NO: 128310 - DNA, 247 bp, Homo sapiens
  misc_feature: GYAE6OF02H3LF4.2.70.G04.1.454.CMB.1.raw
  modified_base (244)..(247): a, c, t, g, unknown or other
  misc_feature (244)..(247): n is a, c, g, or t
tcagacgctcgacacacgaccggtgctcgatttagtgtagtgtgaagggaagggctggcgcgggagcgaatgagttctggggccagggaaccctggtcaccgtctcctcagcctccaccaagggcccatcggtcttcccctggcgccctgctccaggagcacctccgagagcacagcggccctgggctgcctggtcaaggactattcctgtcgagcgtctgagcgggctggcaaggcgcatagnnnn

SEQ ID NO: 128311 - DNA, 253 bp, Homo sapiens; identical to SEQ ID NO: 128051
  misc_feature: GYAE6OF02F65LT.2.70.G04.1.454.CMB.1.raw
  modified_base (248)..(253): a, c, t, g, unknown or other
  misc_feature (248)..(253): n is a, c, g, or t

SEQ ID NO: 128312 - DNA, 248 bp, Homo sapiens; identical to SEQ ID NO: 128022
  misc_feature: GYAE6OF02G8DEL.2.70.G04.1.454.CMB.1.raw
  modified_base (246)..(248): a, c, t, g, unknown or other
  misc_feature (246)..(248): n is a, c, g, or t

SEQ ID NO: 128313 - DNA, 251 bp, Homo sapiens; identical to SEQ ID NO: 128085
  misc_feature: GYAE6OF02IAVTG.2.70.G04.1.454.CMB.1.raw
  modified_base (248)..(251): a, c, t, g, unknown or other
  misc_feature (248)..(251): n is a, c, g, or t

SEQ ID NO: 128314 - DNA, 254 bp, Homo sapiens
  misc_feature: GYAE6OF02G0IGE.2.70.G04.1.454.CMB.1.raw
  modified_base (246)..(254): a, c, t, g, unknown or other
  misc_feature (246)..(254): n is a, c, g, or t
tcagacgctcgacacacgaccggtgctcgatttagtgtagtgtgaagggaaagggccggcgcgggagcgaatgagttctggggccagggaaccctggtcaccgtctcctcagcctccaccaagggcccatcggtcttccccctggcgccctgctccaggagcacctccgagagcacagcggccctgggatgcctggtaaggactacttcctgtcgagcgtctgagcgggctggcaaggcgcatagnnnnnnnnn

SEQ ID NO: 128315 - DNA, 514 bp, Homo sapiens
  misc_feature: GYAE6OF02GTRYE.2.70.G04.1.454.CMB.1.raw
  modified_base (246)..(246): a, c, t, g, unknown or other
  misc_feature (246)..(246): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaagagccaccctctcttgcagggccagtcagactgttggcagaaacngcttctcctggtaccagcagaaacctggccacgctcccaggctcctcatctatgctacattcagcagcgccactggcatcccagacaggttcagtggcagtgggtctgggacagagttcactctcacctatcagcagactggacgcctgaggtatttgcgtagtgttattactgtcatcagtgtgggtctcgagtcgtgtctaggtttggccgtaggggaccgaaggtcgtaggagagtacaacgaacgtggtggcgtcgacactacg

SEQ ID NO: 128316 - DNA, 253 bp, Homo sapiens; identical to SEQ ID NO: 128157
  misc_feature: GYAE6OF02G3AN6.2.70.G04.1.454.CMB.1.raw
  modified_base (246)..(253): a, c, t, g, unknown or other
  misc_feature (246)..(253): n is a, c, g, or t

SEQ ID NO: 128317 - DNA, 251 bp, Homo sapiens; identical to SEQ ID NO: 128085
  misc_feature: GYAE6OF02HAKM7.2.70.G04.1.454.CMB.1.raw
  modified_base (248)..(251): a, c, t, g, unknown or other
  misc_feature (248)..(251): n is a, c, g, or t

SEQ ID NO: 128318 - DNA, 249 bp, Homo sapiens; identical to SEQ ID NO: 128036
  misc_feature: GYAE6OF02JEO3C.2.70.G04.1.454.CMB.1.raw
  modified_base (247)..(249): a, c, t, g, unknown or other
  misc_feature (247)..(249): n is a, c, g, or t

SEQ ID NO: 128319 - DNA, 251 bp, Homo sapiens; identical to SEQ ID NO: 128085
  misc_feature: GYAE6OF02GS87U.2.70.G04.1.454.CMB.1.raw
  modified_base (248)..(251): a, c, t, g, unknown or other
  misc_feature (248)..(251): n is a, c, g, or t

SEQ ID NO: 128320 - DNA, 565 bp, Homo sapiens
  misc_feature: GYAE6OF02JKITN.2.70.G04.1.454.CMB.1.raw
  modified_base (250)..(250): a, c, t, g, unknown or other
  misc_feature (250)..(250): n is a, c, g, or t
tcagacgctcgacacacgaccggtgctcgatttagtgtagtgtgaagggaaaggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaagagccaccctctcttgcaggccagtcagactgttggcagaaacagcttcncctggtaccagcagaaacctggccacgctcccaggctcctcatctatgctacattcagcagcgccacgtggcactcccgagaccaggttcagtcggccgaggtcgggtctagggacctagacgtttccacgtctacacctatcagacagactggacgcctcggaggtacgtttgcgtagttgtacttactgtactatctaggttgtcgggtactcgtagtcgtcgtcgttacgtttaggccgtaggggtaaccaggtccgtagggtacgtaacgttaccgaaagtacgttaggtcggacgtcgacgtaccgtacg

SEQ ID NO: 128321 - DNA, 499 bp, Homo sapiens
  misc_feature: GYAE6OF02G3XAA.2.70.G04.1.454.CMB.1.raw
  modified_base (246)..(246): a, c, t, g, unknown or other
  misc_feature (246)..(246): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaagagccaccctctcttgcagggccagtcagactgttggcagaaacngcttctcctggtaccagcagaaacctggccacgctcccaggctcctcatctatgctacattcagcagcgccactggcatcccagacaggttcagtgcagtgggtctgggacagagttcactctcaccatcagcagactggagcctgaggattttgctagtgtattactgtcatcagtgtgggtctcgagtcgtgcgtagttttggccgagggaccaaggctggagtagtacgaacgactggtggctgcactac

SEQ ID NO: 128322 - DNA, 254 bp, Homo sapiens; identical to SEQ ID NO: 128057
  misc_feature: GYAE6OF02FYLUU.2.70.G04.1.454.CMB.1.raw
  modified_base (248)..(254): a, c, t, g, unknown or other
  misc_feature (248)..(254): n is a, c, g, or t

SEQ ID NO: 128323 - DNA, 255 bp, Homo sapiens
  misc_feature: GYAE6OF02HOTXR.2.70.G04.1.454.CMB.1.raw
  modified_base (247)..(255): a, c, t, g, unknown or other
  misc_feature (247)..(255): n is a, c, g, or t
tcagacgctcgacacacgaccggtgctcgatttagtgtagtgtgaagggaaagggccggcgcgggagcgaatgagttctggggccagggaaccctggtcaccgtctcctcagcctccaccaagggcccatcggtcttccccctggcgccctgctccaggagcacctccgagagcacagcggccctgggctgcctggtcaaggactacttcctgtcgagcgtctgagcgggctggcaaggcgcatagnnnnnnnnn

SEQ ID NO: 128324 - DNA, 553 bp, Homo sapiens
  misc_feature: GYAE6OF02G30UT.2.70.G04.1.454.CMB.1.raw
  modified_base (209)..(209): a, c, t, g, unknown or other
  misc_feature (209)..(209): n is a, c, g, or t
  modified_base (251)..(251): a, c, t, g, unknown or other
  misc_feature (251)..(251): n is a, c, g, or t
  modified_base (257)..(257): a, c, t, g, unknown or other
  misc_feature (257)..(257): n is a, c, g, or t
  modified_base (385)..(385): a, c, t, g, unknown or other
  misc_feature (385)..(385): n is a, c, g, or t
tcagacgctcgacacacgaccggtgctcgatttagtgtagtgtgaagggaaagggggaagagctgctcagttaggacccagagggaaccatggaaaccccagcggcagcttctcttcctcctgcttacgttcgtggctcccagataccacccggagaaactgtgttgacgcagtctccaggccaccgtgtctttgtctccaggggaaanagccaccctctcttgcaggccagtcagactgtggcagaaacngcttcnctggaccagcagaaacctggccacgctcccaggctcctcatctatgctacattcagcagccgccactggcatcccagacaggttcagtggcaggtgggtctgggacagagttcactctcaaccatcancagacgtggagcctgaggtattttgcgagtgtattactgtcatcagttgtgggtctcgtagcgtgtctagttttcgggccgtacggggaccgtaacggtccgtagggtaagaacgttacgaaaaccggtaacgttgggtacggtaccgttaggtaccgaacccgtacg

SEQ ID NO: 128325 - DNA, 249 bp, Homo sapiens
  misc_feature: GYAE6OF02FWWIG.2.70.G04.1.454.CMB.1.raw
  modified_base (248)..(249): a, c, t, g, unknown or other
  misc_feature (248)..(249): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggcccatcggtcttccccctggcgccctgctccaggagcacctccgagagcacagcggccctgggatgcctggtcaaggactacttcctgtcgagcgtctgagcgggctggcaaggcgcatagnn

SEQ ID NO: 128326 - DNA, 252 bp, Homo sapiens; identical to SEQ ID NO: 128309
  misc_feature: GYAE6OF02HZ3OT.2.70.G04.1.454.CMB.1.raw
  modified_base (247)..(252): a, c, t, g, unknown or other
  misc_feature (247)..(252): n is a, c, g, or t

SEQ ID NO: 128327 - DNA, 513 bp, Homo sapiens
  misc_feature: GYAE6OF02JDOMI.2.70.G04.1.454.CMB.1.raw
  modified_base (203)..(203): a, c, t, g, unknown or other
  misc_feature (203)..(203): n is a, c, g, or t
  modified_base (246)..(246): a, c, t, g, unknown or other
  misc_feature (246)..(246): n is a, c, g, or t
  modified_base (292)..(292): a, c, t, g, unknown or other
  misc_feature (292)..(292): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaagngccaccctctcttgcagggccagtcagactgttggcagaaacngcttctcctggtaccagcagaacctggccacgctcccaggctcctnatctatgctacattcagcagcgccactgcatcccagacaggttcagtgcaggtgggtctgggacagtagttcactctcaccatcagcagactggagccgtagagtatttgctagtgtattactgtcatcagtgtgggtctcgagtcgtgtcgtagtttcggccgacggggaccaaggtcgtaggacgtatacgaaacgtactggtcggcgtcgacactacg

SEQ ID NO: 128328 - DNA, 521 bp, Homo sapiens
  misc_feature: GYAE6OF02IWM9Z.2.70.G04.1.454.CMB.1.raw
  modified_base (202)..(202): a, c, t, g, unknown or other
  misc_feature (202)..(202): n is a, c, g, or t
  modified_base (246)..(246): a, c, t, g, unknown or other
  misc_feature (246)..(246): n is a, c, g, or t
  modified_base (252)..(252): a, c, t, g, unknown or other
  misc_feature (252)..(252): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaanagccaccctctcttgcagggccagtcagactgttggcagaaacngcttcncctggtaccagcagaaacctggccacgctccaggctcctcatctatgctacattcagcagccgccactggcatcccagacaggttcagtggcagtgggtctggggacagagttcactctccaccatcagcagactggacgccgtggaggtagttttgactagttgttattactgtctatcagtgtgggtctcgagtcgtgcgtaggtttcggccgtagggacctaggcgtggagacgtacgaaacgtacgtggtggcgtgacacctacg

SEQ ID NO: 128329 - DNA, 508 bp, Homo sapiens
  misc_feature: GYAE6OF02HU1PQ.2.70.G04.1.454.CMB.1.raw
  modified_base (246)..(246): a, c, t, g, unknown or other
  misc_feature (246)..(246): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaagagccaccctctcttgcagggccagtcagactgttggcagaaacngcttctcctggtaccagcagaaacctggccacgctcccaggctcctcatctatgctacattcagcagcgccactggcatcccagacaggttcagtggcagtgggtctgggacagagttcactctcaccatcagcagactggagcctgaggattttgctagtgtattactgtcatcagtgtgggtctcgagtcgtgcgtagttttgggccgtaggggaccgaaggcgtggagagtacgaacgaacgtggtggctgcacctacg

SEQ ID NO: 128330 - DNA, 259 bp, Homo sapiens
  misc_feature: GYAE6OF02HSEEB.2.70.G04.1.454.CMB.1.raw
  modified_base (247)..(259): a, c, t, g, unknown or other
  misc_feature (247)..(259): n is a, c, g, or t
tcagacgctcgacacacgaccggtgctcgatttagtgtagtgtgaagggaaaggggccggcgcgggagcgaatgagttctggggccagggaacctggtcaccgtctcctcagcctccaccaaggcccatcggtcttccccctggcgccctgctccaggagcacctccgagagcacagcggccctgggctgcctggtcaaggactacttccgtgtcgagcgtctgagcgggctggcaaggcgcatagnnnnnnnnnnnnn

SEQ ID NO: 128331 - DNA, 270 bp, Homo sapiens
  misc_feature: GYAE6OF02FGF84.2.70.G04.1.454.CMB.1.raw
  modified_base (247)..(270): a, c, t, g, unknown or other
  misc_feature (247)..(270): n is a, c, g, or t
tcagacgctcgacacacgaccggtgctcgatttagtgtagtgtgaagggaaaggggccggcgcgggagcgaatgagttctgggccagggaaccctggtcaccgtctcctcagcctccaccaagggcccatcggtctccccctggcgccctgctccaggagcacctccgagagcacagcggccctgggctgcctggtcaaggactacgttcctgtcgagcgtctgagcgggctggcaaggcgcatagnnnnnnnnnnnnnnnnnnnnnnnn

SEQ ID NO: 128332 - DNA, 528 bp, Homo sapiens
  misc_feature: GYAE6OF02IFUE1.2.70.G04.1.454.CMB.1.raw
  modified_base (202)..(202): a, c, t, g, unknown or other
  misc_feature (202)..(202): n is a, c, g, or t
  modified_base (246)..(246): a, c, t, g, unknown or other
  misc_feature (246)..(246): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaanagccaccctctcttgcagggccagtcagactgttggcagaaacngcttctcctggtaccagcagaaacctggccacgctcccaggctcctcatctatgctacattcagcagcgccactggcatcccagacaggttcaggtgcaggtgggtctgggacaggagttcactctacaccatcagcagacgtggacgccgtgaggtattttgctagtgttattacgtgtcatcgaggttggtgggtctcgagtcgtgtcgttagtttcggccgacggggaccgaggcgtaggagtagtacgaaacgtacgtggtggcgtcgaccacgtacg

SEQ ID NO: 128333 - DNA, 511 bp, Homo sapiens
  misc_feature: GYAE6OF02FU4NF.2.70.G04.1.454.CMB.1.raw
  modified_base (202)..(202): a, c, t, g, unknown or other
  misc_feature (202)..(202): n is a, c, g, or t
  modified_base (245)..(245): a, c, t, g, unknown or other
  misc_feature (245)..(245): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaangccaccctctcttgcagggccagtcagactgttggcagaaacngcttctcctggtaccagcagaaacctggccacgctcccaggctcctcatctatgctacattcagcagcgccactggcatcccagacaggttcagtggcagtgggtctgggacagagttcactctcaccatcagcagactggagcctgaggtatttgctagtgttattactgtcatcgtagtggtgggtctcgagtcgtgtcgtagtttggccgtagggaccaggtcgtaggagagtacgaaacgtacgtggtggctgaccactacg

SEQ ID NO: 128334 - DNA, 251 bp, Homo sapiens; identical to SEQ ID NO: 128085
  misc_feature: GYAE6OF02HEGC7.2.70.G04.1.454.CMB.1.raw
  modified_base (248)..(251): a, c, t, g, unknown or other
  misc_feature (248)..(251): n is a, c, g, or t

SEQ ID NO: 128335 - DNA, 589 bp, Homo sapiens
  misc_feature: GYAE6OF02IT6LL.2.70.G04.1.454.CMB.1.raw
  modified_base (201)..(201): a, c, t, g, unknown or other
  misc_feature (201)..(201): n is a, c, g, or t
  modified_base (249)..(249): a, c, t, g, unknown or other
  misc_feature (249)..(249): n is a, c, g, or t
  modified_base (290)..(290): a, c, t, g, unknown or other
  misc_feature (290)..(290): n is a, c, g, or t
  modified_base (302)..(302): a, c, t, g, unknown or other
  misc_feature (302)..(302): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgctccaggggaaanagccacctctcttgcagggccagtcagactgttggcagaaacgcttcncctggtaccagcagaaacctggccacgctcccaggctcctnatctatgctacnttcagcagcgccactggcatccccagacaggttcagtggcagttcgggtctggggactaggacgtttcaccttctccaacctatcacgacagactggacgtccgtaggtaggtacgttttggctaggtgttaattacttgtactagttacgaggttggttgggtcgttcgtgtacgttggtcgtaggttttacgggccgtacggggtaaccgtaacggtcggtacggtaggtaacgttacgaaacgtaacggttacggttacggtacggtacgtaccgtaccgtacg

SEQ ID NO: 128336 - DNA, 498 bp, Homo sapiens
  misc_feature: GYAE6OF02GEOSP.2.70.G04.1.454.CMB.1.raw
  modified_base (202)..(202): a, c, t, g, unknown or other
  misc_feature (202)..(202): n is a, c, g, or t
  modified_base (246)..(246): a, c, t, g, unknown or other
  misc_feature (246)..(246): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaanagccaccctctcttgcagggccagtcagactgttggcagaaacngcttctcctggtaccagcagaaacctggccacgctccaggctcctcatctatgctacattcagcagcgccactgcatcccagacaggttcagtgcagtggtctgggacagagttcactctcacatcagcagactggagcctgagtatttgctagtgtattactgtcatcagtgtgggtctcgagcgtgctagtttgccgtagggaccaaggcgtaggagtatacgaacgacgtgtaggtctgtaccactacg

SEQ ID NO: 128337 - DNA, 253 bp, Homo sapiens; identical to SEQ ID NO: 128051
  misc_feature: GYAE6OF02G60NQ.2.70.G04.1.454.CMB.1.raw
  modified_base (248)..(253): a, c, t, g, unknown or other
  misc_feature (248)..(253): n is a, c, g, or t

SEQ ID NO: 128338 - DNA, 252 bp, Homo sapiens
  misc_feature: GYAE6OF02H5QOL.2.70.G04.1.454.CMB.1.raw
  modified_base (248)..(252): a, c, t, g, unknown or other
  misc_feature (248)..(252): n is a, c, g, or t
tcagacgctcgacacacgaccggtgctcgatttagtgtagtgtgaagggaaaggggccggtgcgggagcgaatgagttctggggccagggaaccctggtcaccgtctcctcagcctccaccaagggcccatcggtcttccccctggcgccctgctccaggagcacctccgagagcacagcggccctgggctgcctggtcaaggactacttcctgtcgagcgtctgagcgggctggcaaggcgcatagnnnnn

SEQ ID NO: 128339 - DNA, 248 bp, Homo sapiens
  misc_feature: GYAE6OF02HS56T.2.70.G04.1.454.CMB.1.raw
  modified_base (247)..(248): a, c, t, g, unknown or other
  misc_feature (247)..(248): n is a, c, g, or t
tcagacgctcgacacacgaccggtgctcgatttagtgtagtgtgaagggaaagggccggcgcgggagcgaatgagttctggggccagggaaccctggtcaccgtctcctcagcctccaccaagggcccatcggtcttccccctggcgccctgctccaggagcacctccgagagcacagcggccctgggctgcctggtcaaggactacttcctgtcgagcgtctgagcgggctggcaaggcgcatagnn

SEQ ID NO: 128340 - DNA, 252 bp, Homo sapiens; identical to SEQ ID NO: 128169
  misc_feature: GYAE6OF02GJEFN.2.70.G04.1.454.CMB.1.raw
  modified_base (248)..(252): a, c, t, g, unknown or other
  misc_feature (248)..(252): n is a, c, g, or t

SEQ ID NO: 128341 - DNA, 254 bp, Homo sapiens; identical to SEQ ID NO: 128095
  misc_feature: GYAE6OF02JQNPP.2.70.G04.1.454.CMB.1.raw
  modified_base (247)..(254): a, c, t, g, unknown or other
  misc_feature (247)..(254): n is a, c, g, or t

SEQ ID NO: 128342 - DNA, 251 bp, Homo sapiens; identical to SEQ ID NO: 128085
  misc_feature: GYAE6OF02IW9MU.2.70.G04.1.454.CMB.1.raw
  modified_base (248)..(251): a, c, t, g, unknown or other
  misc_feature (248)..(251): n is a, c, g, or t

SEQ ID NO: 128343 - DNA, 549 bp, Homo sapiens
  misc_feature: GYAE6OF02JV90K.2.70.G04.1.454.CMB.1.raw
  modified_base (201)..(201): a, c, t, g, unknown or other
  misc_feature (201)..(201): n is a, c, g, or t
  modified_base (209)..(209): a, c, t, g, unknown or other
  misc_feature (209)..(209): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgctccaggggaaangccacctntcttgcagggccagtcagactgttggcagaaacgcttctcctggtaccagcagaaacctggccacgctccaggctcctcatctatgctacattcagcagcgccactggcactcccagacgaggttcagtggcaggtggtctgggacagagttcactctcaccatcacgcagacgtggacgccgtagaggtatttgctagtgtacttactgtctatctaggttggtgggtctcgacggtcgtcgtcgtacggttttcggaccgtacggggtacctaacggtcgtaggagtaacgtacgtaaacggtacgttacggtacggtacgtacggtactaccgtacg

SEQ ID NO: 128344 - DNA, 545 bp, Homo sapiens
  misc_feature: GYAE6OF02FWUTP.2.70.G04.1.454.CMB.1.raw
  modified_base (203)..(203): a, c, t, g, unknown or other
  misc_feature (203)..(203): n is a, c, g, or t
  modified_base (246)..(246): a, c, t, g, unknown or other
  misc_feature (246)..(246): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaagngccaccctctcttgcagggccagtcagactgttggcagaaacngcttctcctggtaccagcagaaacctggccacgctcccaggcctcctcatctatgctacattcagcagccgccactggccatccccagacaggttcagtggcaggtgggtctggggacaggtgttcactctaccacatcagcacgacgtggacgccgtgaggtatttgcgtagttgttaattacgtgtctattcgtaggtggtgggtcgtcgagtcgtgtcgttaggtttcgccggtagggaccaggtcgtaggaacgtacgtacgaaacgtacgttggtacggtacgtcgacacgtcg

SEQ ID NO: 128345 - DNA, 506 bp, Homo sapiens
  misc_feature: GYAE6OF02GIY0B.2.70.G04.1.454.CMB.1.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (246)..(246): a, c, t, g, unknown or other
  misc_feature (246)..(246): n is a, c, g, or t
  modified_base (252)..(252): a, c, t, g, unknown or other
  misc_feature (252)..(252): n is a, c, g, or t
  modified_base (389)..(389): a, c, t, g, unknown or other
  misc_feature (389)..(389): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaagngccaccctntcttgcagggccagtcagactgttggcagaaacngcttcncctggtaccagcagaaacctggccacgctcccaggctcctcatctatgctacattcagcagcgccactggcatcccagacaggttcagtggcagtgggtctgggacagagttcactctcaccatcagcagactgganctagaggtatttgctagtgttattacgtgtctatcagtgtgggtctgagtcgtgctagtttcgccgagggaccaggtcgtaggagatacgaaacgactggtagctcgtacacgtacg

SEQ ID NO: 128346 - DNA, 253 bp, Homo sapiens; identical to SEQ ID NO: 128051
  misc_feature: GYAE6OF02FYYUN.2.70.G04.1.454.CMB.1.raw
  modified_base (248)..(253): a, c, t, g, unknown or other
  misc_feature (248)..(253): n is a, c, g, or t

SEQ ID NO: 128347 - DNA, 605 bp, Homo sapiens
  misc_feature: GYAE6OF02I0XL4.2.70.G04.1.454.CMB.1.raw
  modified_base (197)..(197): a, c, t, g, unknown or other
  misc_feature (197)..(197): n is a, c, g, or t
  modified_base (240)..(240): a, c, t, g, unknown or other
  misc_feature (240)..(240): n is a, c, g, or t
  modified_base (246)..(246): a, c, t, g, unknown or other
  misc_feature (246)..(246): n is a, c, g, or t
  modified_base (278)..(278): a, c, t, g, unknown or other
  misc_feature (278)..(278): n is a, c, g, or t
  modified_base (282)..(282): a, c, t, g, unknown or other
  misc_feature (282)..(282): n is a, c, g, or t
tcagacgctcgacacacgaccggtgctcgatttagtgtagtgtgaagggaaagggggaagagctgctcagttaggacccagagggaaccatggaaacccagcgcagcttctcttcctcctgctactctggctcccagactaccaccggagaaactgtgttgacgcagtctccaggcacctgtcttgctcagggaaancgccacctctcttgcgacgggccagtcagactgtgcagaaacngcttcnctgtaccagcagaactgccacgctccagctcnctanctatgactacattcacgcagccgccagtcgacactccgagactacggttcagtcggcagtcgggtcgtagggaactagtacgtttacacgttccacaaccgactacgagaccgaagtaccggtaggacgtccgtagggtagttacgtttaggcgttaaggttcgttattaacgtgtacgagttcgtaggtcggttacggggtctacggtacggtcggttacgtacgttacgggtttacgaccgggtacgggaactaacgggcgtaagggcgtaaacgtaaccgaaacggtaacgttcgggtacggactacgaccgtacgtacg

SEQ ID NO: 128348 - DNA, 505 bp, Homo sapiens
  misc_feature: GYAE6OF02HROA8.2.70.G04.1.454.CMB.1.raw
  modified_base (202)..(202): a, c, t, g, unknown or other
  misc_feature (202)..(202): n is a, c, g, or t
  modified_base (246)..(246): a, c, t, g, unknown or other
  misc_feature (246)..(246): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaanagccaccctctcttgcagggccagtcagactgttggcagaaacngcttctcctggtaccagcagaaacctggccacgctcccaggctcctcatctatgctacattcagcagcgccactggcatcccagacaggttcagtgcaggtgggtctgggacagagttcactctcaccatcagcagactggagctaggaggtagtttgctagtgtattactgtcatcgagtggtgggtctcgagtcgtgctagtttcggcgagggacaaggcgtaggagagtacgaacgacgtggtggcgtgcactacg

SEQ ID NO: 128349 - DNA, 544 bp, Homo sapiens
  misc_feature: GYAE6OF02H07VM.2.70.G04.1.454.CMB.1.raw
  modified_base (202)..(202): a, c, t, g, unknown or other
  misc_feature (202)..(202): n is a, c, g, or t
  modified_base (246)..(246): a, c, t, g, unknown or other
  misc_feature (246)..(246): n is a, c, g, or t
  modified_base (361)..(361): a, c, t, g, unknown or other
  misc_feature (361)..(361): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaanagccaccctctcttgcagggccagtcagactgttggcagaaacngcttctctggtaccagcagaaacctggccacgctcccaggctcctcatctatcgctacattcagcagcgccatggcatccccagacaggttccagtggcaggtgggtctgggacnggagttcacttctacaccatcagcagacgtggagcctagaggtattttgctagttgttattactgtcatcgtagtaggttgggtctcgagtcgtgcgtagtttcggccgtagggtaccgtaaggtcgtaggtagtaacgtaccgaaacgtacgtacggtcggtacgtacgaccgtaccgtacg

SEQ ID NO: 128350 - DNA, 529 bp, Homo sapiens
  misc_feature: GYAE6OF02I36JN.2.70.G04.1.454.CMB.1.raw
  modified_base (244)..(244): a, c, t, g, unknown or other
  misc_feature (244)..(244): n is a, c, g, or t
  modified_base (250)..(250): a, c, t, g, unknown or other
  misc_feature (250)..(250): n is a, c, g, or t
  modified_base (320)..(320): a, c, t, g, unknown or other
  misc_feature (320)..(320): n is a, c, g, or t
tcagacgctcgacacacgaccggtgctcgatttagtgtagtgtgaagggaaaggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaagagccaccctctcttgcagggccagtcagactgtggcagaaacngcttcncctggtaccagcaagaaacctggccacgctccaggctcctcatctatgctacattcagcagccgcactgnactcccagacaggttcagtgcagtggtctgggacagagttcacgtctcgacatcagcagacgtggagccgtagtaggtattttgctagtagttaattactgtacatctagtgttgggtctcgtagcgtgctaggtttcgccgtagggaccgaagtcggtaggtagtaagtaccgaaacggaacgtgtacggtacgtcgtcgaccgtacg

SEQ ID NO: 128351 - DNA, 542 bp, Homo sapiens
  misc_feature: GYAE6OF02GBID6.2.70.G04.1.454.CMB.1.raw
  modified_base (202)..(202): a, c, t, g, unknown or other
  misc_feature (202)..(202): n is a, c, g, or t
  modified_base (245)..(245): a, c, t, g, unknown or other
  misc_feature (245)..(245): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgatgcagtctccaggcaccctgtctttgtctccaggggaaangccaccctctcttgcagggccagtcagactgttggcagaaacngcttctcctggtaccagcagaaacctggccacgctccaggctcctcatctatgctacattcagcagcgccactggcatcccagacaggttcagtgcaggtggtctgggacagtagttcactctcaccatcagcagacgtggacgccgtggaggtatttgctagttgtattacgtgtctagtcgagttggtcggggttctcgtagtcgtgtcgttagtttcggaccgtacggggtaccgtaaggtcgtagggacgtacgtacgaaacggtacgtcggtaggtaccgtcggacctaccg

SEQ ID NO: 128352 - DNA, 252 bp, Homo sapiens; identical to SEQ ID NO: 128169
  misc_feature: GYAE6OF02IJCBB.2.70.G04.1.454.CMB.1.raw
  modified_base (248)..(252): a, c, t, g, unknown or other
  misc_feature (248)..(252): n is a, c, g, or t

SEQ ID NO: 128353 - DNA, 256 bp, Homo sapiens
  misc_feature: GYAE6OF02I5A8M.2.70.G04.1.454.CMB.1.raw
  modified_base (247)..(256): a, c, t, g, unknown or other
  misc_feature (247)..(256): n is a, c, g, or t
tcagacgctcgacacacgaccggtgctcgatttagtgtagtgtgaagggaaagggccggcgcgggagcgaatgagttctggggccagggaaccctggtcaccgtctcctcagcctccaccaagggcccatcggtcttccccctggcgccctgctccaggagcacctccgagagcacagcggccctgggctgcctggtcaaggactacttcctgtcgagcgtctgagcgggctggcaaggcgcatagnnnnnnnnnn

SEQ ID NO: 128354 - DNA, 252 bp, Homo sapiens; identical to SEQ ID NO: 128169
  misc_feature: GYAE6OF02GIZCR.2.70.G04.1.454.CMB.1.raw
  modified_base (248)..(252): a, c, t, g, unknown or other
  misc_feature (248)..(252): n is a, c, g, or t

SEQ ID NO: 128355 - DNA, 251 bp, Homo sapiens; identical to SEQ ID NO: 128085
  misc_feature: GYAE6OF02INTZ5.2.70.G04.1.454.CMB.1.raw
  modified_base (248)..(251): a, c, t, g, unknown or other
  misc_feature (248)..(251): n is a, c, g, or t

SEQ ID NO: 128356 - DNA, 558 bp, Homo sapiens
  misc_feature: GYAE6OF02IVMA5.2.70.G04.1.454.CMB.1.raw
  modified_base (202)..(202): a, c, t, g, unknown or other
  misc_feature (202)..(202): n is a, c, g, or t
  modified_base (244)..(244): a, c, t, g, unknown or other
  misc_feature (244)..(244): n is a, c, g, or t
  modified_base (250)..(250): a, c, t, g, unknown or other
  misc_feature (250)..(250): n is a, c, g, or t
  modified_base (362)..(362): a, c, t, g, unknown or other
  misc_feature (362)..(362): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaangccaccctctcttgcagggccagtcagactgtggcagaaacngcttcncctggtaccagcagaaacctggccacgcctccaggcctcctcatctatgctacattcagcagcgccacgtggcatcccagacaggttcagtggcaggtgggtctgggacagngttcactctacacatcagcagacgtggagtccgtaggaggtattttggactagttagttattactgtactagtcgtaggttggtcgggtctcgaggtcgttggcgttaggtttcgggaccggtacggggaccgtaggtcggtacgggagtacgtaacgtaacgtagtcggtacggtacgtacgtaccgtacgtacg

SEQ ID NO: 128357 - DNA, 266 bp, Homo sapiens
  misc_feature: GYAE6OF02GBD15.2.70.G04.1.454.CMB.1.raw
  modified_base (250)..(266): a, c, t, g, unknown or other
  misc_feature (250)..(266): n is a, c, g, or t
tcagacgctcgacacacgaccggtgctcgatttagtgtagtgtgaagggaaaggggccgggcgcgggagcgaatgagttctggggccagggaaccctggtcaccgtctcctcagcctccaccaagggcccatcggtcttccccctggcgccctgctccaggagcacctccgagagtcacagcggccctgggctgcctggtcaaggactacttcctgtcgagcgtctgagcgggctggcaaggcgcatagnnnnnnnnnnnnnnnnn

SEQ ID NO: 128358 - DNA, 250 bp, Homo sapiens
  misc_feature: GYAE6OF02FG223.2.70.G04.1.454.CMB.1.raw
  modified_base (245)..(250): a, c, t, g, unknown or other
  misc_feature (245)..(250): n is a, c, g, or t
tcagacgctcgacacacgaccggtgctcgatttagtgtagtgtgaagggaaaggggccggcgcgggagcgaatgagttctgggccagggaaccctggtcaccgtctcctcagcctccaccaagggcccatcggtctccccctggcgccctgctccaggagcacctccgagagcacagcggccctgggctgcctggtcaaggactacttcctgtcgagcgtctgagcggctggcaaggcgcatagnnnnnn

SEQ ID NO: 128359 - DNA, 253 bp, Homo sapiens; identical to SEQ ID NO: 128051
  misc_feature: GYAE6OF02GM1FQ.2.70.G04.1.454.CMB.1.raw
  modified_base (248)..(253): a, c, t, g, unknown or other
  misc_feature (248)..(253): n is a, c, g, or t

SEQ ID NO: 128360 - DNA, 582 bp, Homo sapiens
  misc_feature: GYAE6OF02GN9SZ.2.70.G04.1.454.CMB.1.raw
  modified_base (202)..(202): a, c, t, g, unknown or other
  misc_feature (202)..(202): n is a, c, g, or t
  modified_base (245)..(245): a, c, t, g, unknown or other
  misc_feature (245)..(245): n is a, c, g, or t
  modified_base (251)..(251): a, c, t, g, unknown or other
  misc_feature (251)..(251): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaangccaccctctcttgcagggccagtcagactgttggcagaaacngcttcncctggtaccagcagaaacctggccacgctcccaggcctcctcatctatgctacattcagcagcgccactggcatcccagacaggttcagtcgcagtgggtctgggacagagttcactctcacctatcgagcacgacgtggacgccgtaggacgttagtttgacgtagttagttacgttacgtcgtactacttcgtaggttgggttcgggttctcgtaggtcgttacgtacgttagggttttcggaccggtacggggtaaccgaaggtcggtaggaacggtaacgtaacgtaaaccggtacgttcggtacggtccgtacgaccgtacctacg

SEQ ID NO: 128361 - DNA, 328 bp, Homo sapiens
  misc_feature: GYAE6OF02H976F.2.70.G04.1.454.CMB.1.raw
  modified_base (265)..(279): a, c, t, g, unknown or other
  misc_feature (265)..(279): n is a, c, g, or t
  modified_base (281)..(328): a, c, t, g, unknown or other
  misc_feature (281)..(328): n is a, c, g, or t
tcagacgctcgacacacgaccggtgctcgatttagtgtagtgtgaagggaaagggggtccggcgcgggagcgaatgagttctgggggccagggaaccctggtcaccggtcctccgtcagcctccaccaacgggccccatcggtcctttccccctggccgccctgctccaggagcacctccgagagcacagcggccctgggctcgcctggtcaaggctacttcctgtcgagcgtctgagccgggctgggcaaagggcacaagtagnnnnnnnnnnnnnnnannnnnnnnnnnnnnnnnnnnnnnnnnnnnnnnnnnnnnnnnnnnnnnn

SEQ ID NO: 128362 - DNA, 528 bp, Homo sapiens
  misc_feature: GYAE6OF02JCBAC.2.70.G04.1.454.CMB.1.raw
  modified_base (202)..(202): a, c, t, g, unknown or other
  misc_feature (202)..(202): n is a, c, g, or t
  modified_base (246)..(246): a, c, t, g, unknown or other
  misc_feature (246)..(246): n is a, c, g, or t
  modified_base (363)..(363): a, c, t, g, unknown or other
  misc_feature (363)..(363): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaanagccaccctctcttgcagggccagtcagactgttggcagaaacngcttctcctggtaccagcagaaacctggccacgctccaggcctcctcatctatgctacattcagcagcgccactggcactcccagacaggttcagtggcaggtgggtctgggacagngttcactctcacatcagcagctggacgcctaggaggtatttgactagtgttattactgtcattctaggtggtgggtctcgtagcgtgcgtaggtttcggaccgtaggggaccaggtcgtaggagacgtacgaacggtacgtggtaggtacgtcgacctacgtacg

SEQ ID NO: 128363 - DNA, 254 bp, Homo sapiens; identical to SEQ ID NO: 128095
  misc_feature: GYAE6OF02GY6Y7.2.70.G04.1.454.CMB.1.raw
  modified_base (247)..(254): a, c, t, g, unknown or other
  misc_feature (247)..(254): n is a, c, g, or t

SEQ ID NO: 128364 - DNA, 254 bp, Homo sapiens; identical to SEQ ID NO: 128057
  misc_feature: GYAE6OF02FFGL7.2.70.G04.1.454.CMB.1.raw
  modified_base (248)..(254): a, c, t, g, unknown or other
  misc_feature (248)..(254): n is a, c, g, or t

SEQ ID NO: 128365 - DNA, 505 bp, Homo sapiens
  misc_feature: GYAE6OF02FV6BP.2.70.G04.1.454.CMB.1.raw
  modified_base (246)..(246): a, c, t, g, unknown or other
  misc_feature (246)..(246): n is a, c, g, or t
tcagacgctcgacacacgaccggtgctcgatttagtgtagtgtgaagggaaagggggaagagctgctcagttaggacccagagggaaccatggaaaccacagcgcagcttctcttcctcctgctactctggctcccagataccaccggagaaactgtgttgacgcagtctccaggcaccctgtctttgtctccaggggaaagagccaccctctcttgcagggccagtcagactgttggcagaaacngcttctcctggtaccagcagaaacctggccacgctccaggctcctcatctatgctacattcagcagcgccactggcatcccagacaggttcagtggcagtgggtctgggacagagttcactctcgaccatcagcagactggagccgtgaggtattttgctagttgtattactgtctatcagtgtgggtctcgagtcgtgctagtttcggcgacgggaccgaaggcgtggagagtacgaacgtacgtgtggtctgctacg

SEQ ID NO: 128366 - DNA, 604 bp, Homo sapiens
  misc_feature: GYAE6OF02JECE4.2.70.G04.1.454.CMB.1.raw
  modified_base (202)..(202): a, c, t, g, unknown or other
  misc_feature (202)..(202): n is a, c, g, or t
  modified_base (244)..(244): a, c, t, g, unknown or other
  misc_feature (244)..(244): n is a, c, g, or t
  modified_base (250)..(250): a, c, t, g, unknown or other
  misc_feature (250)..(250): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaangccacctctcttgcagggccagtcagactgttggcagaaacngcttcncctggtaccagcagaacctggccacgctccaggcctcctcatctatcgctacattcagcagccgcactggcactcccaggactaggttcaggtcggacaggtcgggtcaggggacaggacgtttccactcctacaccatcagcagacgtcgggacgtccgtaggtaggtattttcggcgtagttagttacttacgttcgtactacgttcgtaggtggttacggggtctcgtaggtccgttggtacgttacgggtttcggtaccggtacgggggtaccgtaaggtcggtacgggtacggtaacgttaccgtaaacggtacgttacgggtacggtccgtacggtaccgtacgtacg

SEQ ID NO: 128367 - DNA, 661 bp, Homo sapiens
  misc_feature: GYAE6OF02JGZ8Z.2.70.G04.1.454.CMB.1.raw
  modified_base (200)..(200): a, c, t, g, unknown or other
  misc_feature (200)..(200): n is a, c, g, or t
  modified_base (209)..(209): a, c, t, g, unknown or other
  misc_feature (209)..(209): n is a, c, g, or t
  modified_base (243)..(243): a, c, t, g, unknown or other
  misc_feature (243)..(243): n is a, c, g, or t
  modified_base (309)..(309): a, c, t, g, unknown or other
  misc_feature (309)..(309): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgctccagggaaangccaccctntcttgcagggccagtcagactgttggcagaaacngtcttctctggtaccagcacgaaacctggaccacgcctcccaggcctcctcatctatcgactactnttccagcacgccgtccacgtcggcactccccgaagacgtacggttacaaggtcgggccgtaaggttcgggtacgttacggggaactaggtacggttacaccgttccgtaccaacctaagtccgaacgacgtaaggtacctagggtacgtaccgtaggaggttacgttttacgaccgtaaggttcgttaacgttacgtcgttacagttcgtaaggttcgggttcgggttaccgttacgtacggttccggttagtacggttacggttttcggaccgtaccggggtaactaggccggttaggaacggtaacacggtaaacgtacgttacggtacgacgtcgtacgtaccgtaacg

SEQ ID NO: 128368 - DNA, 254 bp, Homo sapiens; identical to SEQ ID NO: 128202
  misc_feature: GYAE6OF02HRBM3.2.70.G04.1.454.CMB.1.raw
  modified_base (247)..(254): a, c, t, g, unknown or other
  misc_feature (247)..(254): n is a, c, g, or t

SEQ ID NO: 128369 - DNA, 257 bp, Homo sapiens
  misc_feature: GYAE6OF02JCVM5.2.70.G04.1.454.CMB.1.raw
  modified_base (206)..(206): a, c, t, g, unknown or other
  misc_feature (206)..(206): n is a, c, g, or t
  modified_base (241)..(241): a, c, t, g, unknown or other
  misc_feature (241)..(241): n is a, c, g, or t
  modified_base (244)..(257): a, c, t, g, unknown or other
  misc_feature (244)..(257): n is a, c, g, or t
tcagacgctcgacacacgaccggtgctcgatttagtgtagtgtgaagggaaagggccggcgcgggagcgaatgagtctgggcaggaacctggtcaccgtctcctcagcctccaccaaggcccatcggtcttcccctggcgccctgctccaggagcacctccgagacgcacagcggccctgggctgcctggtcaaggactacttccngtcgagcgtctgagcggctggcaaggcgcagtagnctnnnnnnnnnnnnnn

SEQ ID NO: 128370 - DNA, 259 bp, Homo sapiens
  misc_feature: GYAE6OF02G1UYQ.2.70.G04.1.454.CMB.1.raw
  modified_base (250)..(259): a, c, t, g, unknown or other
  misc_feature (250)..(259): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggcccatcggtcttccccctggcgccctgctccaggagcacctccgagagcacagcggccctgggctgcctggtcaaggctacttcctgtcgagcgtctgagcgggctgggcaagggcgcagtagnnnnnnnnnn

SEQ ID NO: 128371 - DNA, 127 bp, Homo sapiens
  misc_feature: GYAE6OF02HQ5LU.2.70.G04.1.454.CMB.1.raw
  modified_base (124)..(127): a, c, t, g, unknown or other
  misc_feature (124)..(127): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaannnn

SEQ ID NO: 128372 - DNA, 610 bp, Homo sapiens
  misc_feature: GYAE6OF02GAVXD.2.70.G04.1.454.CMB.1.raw
  modified_base (203)..(203): a, c, t, g, unknown or other
  misc_feature (203)..(203): n is a, c, g, or t
  modified_base (244)..(244): a, c, t, g, unknown or other
  misc_feature (244)..(244): n is a, c, g, or t
  modified_base (290)..(290): a, c, t, g, unknown or other
  misc_feature (290)..(290): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaagngccaccctctcttgcagggccagtcagctgttggcagaacngcttctcctggtaccagcagaaacctggccacgctcccaggctccncatctatgctacattcagcagcgccactggcactcccagacaggttcaggtcggcgtaggtgggtcgtgggacaggtcgtttacactccgtccaactactcgaacgcaacgacgtgggacgtcgtaggtaggttacgttttcgacgttagttacgttaactttacgtcgttactagttcgtaagggttcgggttgggttcctacggtacggtcgtcgtacgttacgggtttcggaccggtacgggtaacctagggtacgtacggaacgtacgtaaccgtaaacggtacgttcggtacggtacgtacggtccgaccgtacg

SEQ ID NO: 128373 - DNA, 252 bp, Homo sapiens
  misc_feature: GYAE6OF02GUX2B.2.70.G04.1.454.CMB.1.raw
  modified_base (246)..(252): a, c, t, g, unknown or other
  misc_feature (246)..(252): n is a, c, g, or t
tcagacgctcgacacacgaccggtgctcgatttagtgtagtgtgaagggaaagggccggcgcgggagcgaatgagttctggggccagggaaccctggtcaccgtctcctcagcctccaccaagggcccatcggtcttccccctggcgccctgctccaggagcacctccgagagcacagcggccctgggctgcctggtcaaggactacttcctgtcgagcgtctgagcggctggcaaggcgcatagnnnnnnn

SEQ ID NO: 128374 - DNA, 611 bp, Homo sapiens
  misc_feature: GYAE6OF02FF3VC.2.70.G04.1.454.CMB.1.raw
  modified_base (202)..(202): a, c, t, g, unknown or other
  misc_feature (202)..(202): n is a, c, g, or t
  modified_base (244)..(244): a, c, t, g, unknown or other
  misc_feature (244)..(244): n is a, c, g, or t
  modified_base (260)..(260): a, c, t, g, unknown or other
  misc_feature (260)..(260): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaangccaccctctcttgcagggccagtcagactgttggcagaacngcttctcctggtaccngcagaacctggccacgctccaggctcctcatctatgctacattcagcagcgccactggccatccccagaccgtaggttccaggtcggctaggtcgggtctaggggacctaggtacgtttcaccgtctaccaccatcagcagtacgtggacgtccgtagtaggtattttggaccttaggtacgtttaattaccgtgttacctagttcgtaggttgggttacggggtcttacggtacgtcggtgttaccgttaggttttccggggaccggtacggggtaacctaacgggtacgttcgggaacgtacgtaacgaaacggtaaccgttgggtaccgtctacggacctaccttacg

SEQ ID NO: 128375 - DNA, 658 bp, Homo sapiens
  misc_feature: GYAE6OF02I11QI.2.70.G04.1.454.CMB.1.raw
  modified_base (201)..(201): a, c, t, g, unknown or other
  misc_feature (201)..(201): n is a, c, g, or t
  modified_base (210)..(210): a, c, t, g, unknown or other
  misc_feature (210)..(210): n is a, c, g, or t
  modified_base (243)..(243): a, c, t, g, unknown or other
  misc_feature (243)..(243): n is a, c, g, or t
  modified_base (249)..(249): a, c, t, g, unknown or other
  misc_feature (249)..(249): n is a, c, g, or t
  modified_base (257)..(257): a, c, t, g, unknown or other
  misc_feature (257)..(257): n is a, c, g, or t
  modified_base (426)..(426): a, c, t, g, unknown or other
  misc_feature (426)..(426): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtcttgtctccaggggaaangccaccctntcttgcagggccagtcagactgttggcagaacngcttcnctggaccngcagaaacctggccacgctccaggctacctcatctatgactactattcgagcacgccgaccacgtcggcctactaccccaaggtacgtacggttaccgaggtcggacgtacgggttcgggttacgtaggggaacctagggttacgttaccacgttcctaccaacccgtntaccgacgacgacgacgtcggacgtacgtaggtaacggtttattcggtacgttaggtttacgttaacttacgtcgttactagttacgtaggttgggttacgggtccttacggtacggtcgttaggtaccgtttagggtttccgggaccgggtacggggtaaccctaggtcggtaggtagtaaccgttaactaacgggtacgttgggtccgacgttacgacccgtaccgtacg

SEQ ID NO: 128376 - DNA, 249 bp, Homo sapiens
  misc_feature: GYAE6OF02IFRIB.2.70.G04.1.454.CMB.1.raw
  modified_base (246)..(249): a, c, t, g, unknown or other
  misc_feature (246)..(249): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggcccatcggtcttccccctggcgccctgctccaggagcacctccgagagcacagcggccctgggctgcctggtcaaggactacttcctgtagcgtctgagcgggctggcaaggcgcatagnnnn

SEQ ID NO: 128377 - DNA, 548 bp, Homo sapiens
  misc_feature: GYAE6OF02HBQIV.2.70.G04.1.454.CMB.1.raw
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaagagccaccctctcttgcagggccagtcagactgttggcagaaacagcttctcctggtaccagcagaaacctggccacgctccaggctcctcatcatgctacattcagcagccgccactggcactcccagacaggttcagtcggcaggtgggtctgggacagagttcactctacacatcagcagactggacgcgtagaggtatttgcgtagtgttattactgtcatcgagtggtgggtctcgagtcgttgtcgtagtttcggaccgtacggggaccgtaaggtcgtagggtacgtaacgtaccgtaaaacggtacgttagggtcggtaccgtcggtacctaccgtacg

SEQ ID NO: 128378 - DNA, 251 bp, Homo sapiens; identical to SEQ ID NO: 128085
  misc_feature: GYAE6OF02G6F73.2.70.G04.1.454.CMB.1.raw
  modified_base (248)..(251): a, c, t, g, unknown or other
  misc_feature (248)..(251): n is a, c, g, or t

SEQ ID NO: 128379 - DNA, 527 bp, Homo sapiens
  misc_feature: GYAE6OF02G0SUY.2.70.G04.1.454.CMB.1.raw
  modified_base (202)..(202): a, c, t, g, unknown or other
  misc_feature (202)..(202): n is a, c, g, or t
  modified_base (246)..(246): a, c, t, g, unknown or other
  misc_feature (246)..(246): n is a, c, g, or t
  modified_base (383)..(383): a, c, t, g, unknown or other
  misc_feature (383)..(383): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaanagccaccctctcttgcagggccagtcagactgttggcagaaacngcttctcctggtaccagcagaaacctggccacgctccagctcctcatctatgctacattcagcagcgccatggcatcccagcagttcagtgcagtggtctgggacagagttcactctcaccatcagcacgactgganccgtagaggtatttgcgtagttagtattactgtcattcgaggtggttgggtcttcgagtcgtgcgtagtttcgacgtacgggacaggtcgtaggtaagtacgtacgaaacgtacgtggtacggtacgtacgacctaccgtaacg

SEQ ID NO: 128380 - DNA, 634 bp, Homo sapiens
  misc_feature: GYAE6OF02JMC6K.2.70.G04.1.454.CMB.1.raw
  modified_base (202)..(202): a, c, t, g, unknown or other
  misc_feature (202)..(202): n is a, c, g, or t
  modified_base (243)..(243): a, c, t, g, unknown or other
  misc_feature (243)..(243): n is a, c, g, or t
  modified_base (249)..(249): a, c, t, g, unknown or other
  misc_feature (249)..(249): n is a, c, g, or t
  modified_base (258)..(258): a, c, t, g, unknown or other
  misc_feature (258)..(258): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaangccacctctcttgcagggccagtcagactgtggcagaaacngcttcnctggtaccngcagaacctggaccacgctccaggctacctcatctatgactacattcagcagcgccacgtggcacgtccccaagactaggttccaggtcgcgaggtcgggtctggggacaggtaacttccgaactcgtacacccatccgagacagactacggagtccgtagacggtatttcgacgttaagttcgttaacgtttacgtcgttacacgttcgtaacgggtttggttcggggttacttaccgtacgggtcgttacggtacggttaaggttttccgggaccggttacggggtaacccgtaagggtaccgttacggtaacggtaacgttaaccggaaacgtaaccgttcgggttacgcgttacggaccgttaaccctacgg

SEQ ID NO: 128381 - DNA, 821 bp, Homo sapiens
  misc_feature: GYAE6OF02HA47F.2.70.G04.1.454.CMB.1.raw
  modified_base (203)..(203): a, c, t, g, unknown or other
  misc_feature (203)..(203): n is a, c, g, or t
  modified_base (244)..(244): a, c, t, g, unknown or other
  misc_feature (244)..(244): n is a, c, g, or t
  modified_base (250)..(250): a, c, t, g, unknown or other
  misc_feature (250)..(250): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaagngccaccctctcttgcagggccagtcagactgttgcagaacngcttcnctggtaccagcagaacctggacccacgcctacccgacggtcctccctcacttcctatcgactacctattccagtccaggccgacctacgtcggccactccccgaagaccgtacggttaccgaggtcggacgagggttcgggtacgtagggggaacctaaggtaacggtttccaaccgttcccgttaccctaaccgtactaccgaacggtaccgaaacgggtaccggtcggggtaaacggtcccgttaggggtaacggtttacgtttttacgggccgttaagggtttacgtttaaacgttttaccggtttcgttaacccgttacgtttaccgggttaagggtttccgggggtttacggggtttaccttacggggtaacgttccgggttacggttacggttttaacggggtttttccggggaaccccgggtaccggggggtaaacccttaacggggttaccgggttaacggggtaaaccgtaaccggtttaaaaccgggtaaaacccgggttaaacgggttttccggggtaaccgggttacccggtacgggtaccccgtaacccgttaaccgg

SEQ ID NO: 128382 - DNA, 256 bp, Homo sapiens
  misc_feature: GYAE6OF02HM0SV.2.70.G04.1.454.CMB.1.raw
  modified_base (247)..(256): a, c, t, g, unknown or other
  misc_feature (247)..(256): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggcccatcggtcttcccctggcgccctgctccaggagcacctccgagagcacagcggccctgggctgcctggtcaaggactacttcctgtcgagcgtctgagcgggctggcaaggcgcatagnnnnnnnnnn

SEQ ID NO: 128383 - DNA, 255 bp, Homo sapiens; identical to SEQ ID NO: 128292
  misc_feature: GYAE6OF02FUPA1.2.70.G04.1.454.CMB.1.raw
  modified_base (248)..(255): a, c, t, g, unknown or other
  misc_feature (248)..(255): n is a, c, g, or t

SEQ ID NO: 128384 - DNA, 515 bp, Homo sapiens
  misc_feature: GYAE6OF02I1QKU.2.70.G04.1.454.CMB.1.raw
  modified_base (200)..(200): a, c, t, g, unknown or other
  misc_feature (200)..(200): n is a, c, g, or t
  modified_base (242)..(242): a, c, t, g, unknown or other
  misc_feature (242)..(242): n is a, c, g, or t
  modified_base (248)..(248): a, c, t, g, unknown or other
  misc_feature (248)..(248): n is a, c, g, or t
  modified_base (400)..(400): a, c, t, g, unknown or other
  misc_feature (400)..(400): n is a, c, g, or t
  modified_base (496)..(496): a, c, t, g, unknown or other
  misc_feature (496)..(496): n is a, c, g, or t
  modified_base (502)..(502): a, c, t, g, unknown or other
  misc_feature (502)..(502): n is a, c, g, or t
tcagacgctcgacacacgaccggtgctcgatttagtgtagtgtgaaggaaaggggaagagctgctcagttaggacccagagggaaccatggaaaccccagcgcagcttctcttcctcctgctactctggctcccagataccaccggagaaactgtgttgacgcagtctccaggcaccctgtctttgtctccagggaaagngccaccctctcttgcagggccagtcagactgtggcagaaacngcttcnctggtaccagcagaaacctggccacgctcccaggctcctcatctatgctacattcagcagccgccacgtgcatcccagcaggttcagtgcagtggtctgggacagtagttcacgttctacgacctatcagcagactggagacctgtacggtnttagcctagtagttattacgtagtccagtactaggttgtcgggtctcgtgcgtgtcgtagttcgacgaggacagcgtgacgtactacgaagtacgngtcggngtcgactactacg

SEQ ID NO: 128385 - DNA, 256 bp, Homo sapiens
  misc_feature: GYAE6OF02GOQXP.2.70.G04.1.454.CMB.1.raw
  modified_base (248)..(256): a, c, t, g, unknown or other
  misc_feature (248)..(256): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggcccatcggtcttccccctggcgccctgctccaggagcacctccgagagcacagcggccctgggctgcctggtcaaggactacttcctgtcgagcgtctgagcgggctggcaaggcgcatagnnnnnnnnn

SEQ ID NO: 128386 - DNA, 262 bp, Homo sapiens
  misc_feature: GYAE6OF02JD6SQ.2.70.G04.1.454.CMB.1.raw
  modified_base (250)..(262): a, c, t, g, unknown or other
  misc_feature (250)..(262): n is a, c, g, or t
tcagacgctcgacacacgaccggtgctcgatttagtgtagtgtgaagggaaagggccggcgcgggagcgaatgagttctgggccagggaaccctggtcaccgtctcctcagcctccaccaagggcccatcggtcttccccctggcgccctgctccaggagcacctccgagagcacagcggccctgggctgcctggtcaaggactacttcctgtcgagcgtctgagcgggctaggcaacgggcgcaatagnnnnnnnnnnnnn

SEQ ID NO: 128387 - DNA, 549 bp, Homo sapiens
  misc_feature: GYAE6OF02HDVRL.2.70.G04.1.454.CMB.1.raw
  modified_base (221)..(221): a, c, t, g, unknown or other
  misc_feature (221)..(221): n is a, c, g, or t
  modified_base (247)..(247): a, c, t, g, unknown or other
  misc_feature (247)..(247): n is a, c, g, or t
  modified_base (249)..(249): a, c, t, g, unknown or other
  misc_feature (249)..(249): n is a, c, g, or t
  modified_base (252)..(252): a, c, t, g, unknown or other
  misc_feature (252)..(252): n is a, c, g, or t
  modified_base (266)..(266): a, c, t, g, unknown or other
  misc_feature (266)..(266): n is a, c, g, or t
  modified_base (280)..(280): a, c, t, g, unknown or other
  misc_feature (280)..(280): n is a, c, g, or t
  modified_base (282)..(282): a, c, t, g, unknown or other
  misc_feature (282)..(282): n is a, c, g, or t
  modified_base (284)..(284): a, c, t, g, unknown or other
  misc_feature (284)..(284): n is a, c, g, or t
  modified_base (286)..(286): a, c, t, g, unknown or other
  misc_feature (286)..(286): n is a, c, g, or t
  modified_base (288)..(288): a, c, t, g, unknown or other
  misc_feature (288)..(288): n is a, c, g, or t
  modified_base (290)..(290): a, c, t, g, unknown or other
  misc_feature (290)..(290): n is a, c, g, or t
  modified_base (292)..(292): a, c, t, g, unknown or other
  misc_feature (292)..(292): n is a, c, g, or t
  modified_base (310)..(310): a, c, t, g, unknown or other
  misc_feature (310)..(310): n is a, c, g, or t
  modified_base (314)..(314): a, c, t, g, unknown or other
  misc_feature (314)..(314): n is a, c, g, or t
  modified_base (326)..(326): a, c, t, g, unknown or other
  misc_feature (326)..(326): n is a, c, g, or t
  modified_base (331)..(331): a, c, t, g, unknown or other
  misc_feature (331)..(331): n is a, c, g, or t
  modified_base (442)..(442): a, c, t, g, unknown or other
  misc_feature (442)..(442): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgcctactcctggcctcccaggactaccgaccggataaacctgtgttagacgcagtcctcaggcacctgtcttgcaccgaggggaatgcacctcttggcancggtccaaggcaaggttctgtaccgnanacnctctctctcgtacncacacacgacgacncncncncncncncatcactctctctctacncacnctcgctcgtgcncactncgtactacgtacgcgcgcgtcgtcgcgacgcgtacgtacgtcgtctactactactagtcgacgtacgtacagactacgcgtagtactacgtacgtactgtacgtactactntacgtacgtcgtacgtcgtcgtactcgtacgtcggtcgtacgtacgtacgacgtacgtcgtgtacgtacgtacgtactacgtacgtacgacgtcgacgtacgtctac

SEQ ID NO: 128388 - DNA, 250 bp, Homo sapiens; identical to SEQ ID NO: 128092
  misc_feature: GYAE6OF02F9196.2.70.G04.1.454.CMB.1.raw
  modified_base (248)..(250): a, c, t, g, unknown or other
  misc_feature (248)..(250): n is a, c, g, or t

SEQ ID NO: 128389 - DNA, 249 bp, Homo sapiens
  misc_feature: GYAE6OF02H55H1.2.70.G04.1.454.CMB.1.raw
  modified_base (247)..(249): a, c, t, g, unknown or other
  misc_feature (247)..(249): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggcccatcggtcttccccctggcgccctgctccaggagcacctccgagagcacagcggccctgggctgcctggtcaaggctacttcctgtcgagcgtctgagcgggctggcaaggcgcatagnnn

SEQ ID NO: 128390 - DNA, 248 bp, Homo sapiens
  misc_feature: GYAE6OF02FFGTF.2.70.G04.1.454.CMB.1.raw
  modified_base (247)..(248): a, c, t, g, unknown or other
  misc_feature (247)..(248): n is a, c, g, or t
tcagacgctcgacacacgaccggtgctcgatttagtgtagtgtgaagggaaggggccggcgcgggagcgaatgagttctggggccagggaaccctggtcaccgtctcctcagcctccaccaagggcccatcggtcttccccctggcgccctgctccaggagcacctccgagagcacagcggccctgggctgcctggtcaaggactacttcctgtcgagcgtctgagcgggctggcaaggcgcatagnn

SEQ ID NO: 128391 - DNA, 251 bp, Homo sapiens
  misc_feature: GYAE6OF02G5C0J.2.70.G04.1.454.CMB.1.raw
  modified_base (247)..(251): a, c, t, g, unknown or other
  misc_feature (247)..(251): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggcccatcggtcttccccctggcgccctgctccaggagcacctccgagagcacagcggccctgggctgcctggtcaaggctacttcctgtcgagcgtctgagcgggctggcaaggcgcatagnnnnn

SEQ ID NO: 128392 - DNA, 715 bp, Homo sapiens
  misc_feature: GYAE6OF02H3HRN.2.70.G04.1.454.CMB.1.raw
  modified_base (250)..(250): a, c, t, g, unknown or other
  misc_feature (250)..(250): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccgaaggggaagacgcccaccctctcttgcagggccagtcagactgttggcaagaaacngcttctctggtaccagcaagaacctggaccacggtcctcccgaggcctcctacattcctatcgtactactattacgagtccacgccgaccctagtcggacctaaccgtccccgaaggaaccgtaggttaccagggttcgggactaggtcggggttcgtaggggaaccaggtagtttacccgacttccgtaccgaaccccgtataccgaacgtaccgtaaacggtaccggtacgggtaacgtccggttacgggtaacgggttacgtttttacggaccgttaacggtttacggtttaacgtttaccgttacgttacgtaacgttacgtaagggttacgggttcggggtacctcgtacggtcgtggtacgttacggtttcggaccggtacgggaaccgtaacggtcgttacggacgtaacgtaaccgaacgtacggttacggtacggtcgtacgtaccgtaccgtacg

SEQ ID NO: 128393 - DNA, 581 bp, Homo sapiens
  misc_feature: GYAE6OF02HRABW.2.70.G04.1.454.CMB.1.raw
  modified_base (304)..(304): a, c, t, g, unknown or other
  misc_feature (304)..(304): n is a, c, g, or t
  modified_base (309)..(309): a, c, t, g, unknown or other
  misc_feature (309)..(309): n is a, c, g, or t
  modified_base (333)..(333): a, c, t, g, unknown or other
  misc_feature (333)..(333): n is a, c, g, or t
tcagacgctcgacacacgaccggtgctcgatttagtgtagtgtgaagggaaaggggaagagctgctcagttaggacccagagggaaccatggaaacccagcgcagcttctcttcctcctgctactctggctcccagataccaccggagaaactgtgttgacgcagtctccaggcacctgtctttgctaccaggggaaatcgccacctctcttgcgaggtccagtcagactgtggcaagaaactgcttctctggtaccagcagaacctggcacgtctccgaggtcctctcatctatcgacttacngtttnacgcagcgacccagtggacctacncccgagaccaaggttcagtggctaggtcgggtcaggggaccaggtacgttcacgtctacaccgatcgagcagtacgtcgggactcggtagagtttcgttacgagtagtttactaacttcgtctagtacctaggttcggtgggtcgtcagtcgtgtccgtagtttcgtaccggaggacggacgttcggaggtagttacgaaccgtaaacggtgtaacggttcgggcctaggtcgaaccgtgttaaccgg

SEQ ID NO: 128394 - DNA, 720 bp, Homo sapiens
  misc_feature: GYAE6OF02G58F7.2.70.G04.1.454.CMB.1.raw
  modified_base (200)..(200): a, c, t, g, unknown or other
  misc_feature (200)..(200): n is a, c, g, or t
  modified_base (238)..(238): a, c, t, g, unknown or other
  misc_feature (238)..(238): n is a, c, g, or t
  modified_base (243)..(243): a, c, t, g, unknown or other
  misc_feature (243)..(243): n is a, c, g, or t
tcagacgctcgacacacgaccggtgctcgatttagtgtagtgtgaagggaaagggggaagagctgctcagttaggacccagagggaacccatggaaaccccagcgcagcttctcttcctcctgctactctggctcccagataccaccggagaaactgtgttgacgcagtctccaggcacctgtctttgctccagggaagngccacctctcttgcagggccagtcagctgtgcagaacngctcnctggtacagcagaactggccacgctccaggctcctcactctatcgactacattcagcacgcgccactcggctactcccgagacgtacggttcacggttcggactaggttcggggtaccgttaggggaccgtaaggtacggtttaccgtaaacgttccgttaccgaacccgtacgtaccgtaacgtaccgtaacggaaccggttaggggtaaccgtccggttaacgggaacgggtttacgtttttcggaaccggttaggtttacggtttaacgtttacccggttaggttaccgtaacgttacgttacgggtttacgggttaccgggggttccgttaccgggtacggttcggttcgggtaccggtttagggttttaccgggaccggttacggggtaccgtaacgggtccggttagggaacgtaacgttaccgaaacggttacgtacgggtacgtaccggtacggtaccctaccgtaccg

SEQ ID NO: 128395 - DNA, 265 bp, Homo sapiens
  misc_feature: GYAE6OF02G5JO7.2.70.G04.1.454.CMB.1.raw
  modified_base (242)..(242): a, c, t, g, unknown or other
  misc_feature (242)..(242): n is a, c, g, or t
  modified_base (248)..(265): a, c, t, g, unknown or other
  misc_feature (248)..(265): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggcccatcggtcttccccctggcgccctgctccaggagcacctccgagagcacagcggccctgggctgcctggtcaaggactacttcctgtcgagcgtctgagcgggctggcaaggcncatagnnnnnnnnnnnnnnnnnn

SEQ ID NO: 128396 - DNA, 518 bp, Homo sapiens
  misc_feature: GYAE6OF02FH0PK.2.70.G04.1.454.CMB.1.raw
  modified_base (246)..(246): a, c, t, g, unknown or other
  misc_feature (246)..(246): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaagagccaccctctcttgcagggccagtcagactgttggcagaaacngcttctcctggtaccagcagaaacctggccacgctcccaggctcctcatctatgctacattcagcagcgccactggcatccccagacaggttcagtggcagtgggtctgggacaggagttcactctcaccatcagcagacgtggagcctgaggtattttgctagtgttattacgtgtctatctagtgtgggtctcgagtcgtgcgtagtttcggccgaggggaccaaggcgtaggagactacgaaacggactcggtaggcgtacgcactacg

SEQ ID NO: 128397 - DNA, 509 bp, Homo sapiens
  misc_feature: GYAE6OF02FW52F.2.70.G04.1.454.CMB.1.raw
  modified_base (435)..(435): a, c, t, g, unknown or other
  misc_feature (435)..(435): n is a, c, g, or t
tcagacgctcgacacacgaccggtgctcgatttagtgtagtgtgaagggaaagggggaagagctgctcagttaggacccagagggaaccatgggaaaccccagcgcagcttctcttcctcctgctactctggctcccagataccaccggagaaactgtgttgacgcagtctccaggcaccctgtcttgtctccaggggaaaagagccaccctctcttgcagggccagtcagactgttggcagaacagcttctcctggtaccagcagaaacctggccacgctcccaggctcctcatctatgctacattcagcagcgccactggcatcccagacaggtcagtgcgagtgggtctgggacagagttcactctcaccatcagcagactggagcctgaggtatttagcgtagtgtacttactgtcatcagtgtgggtctnagtcgtgcgtagtttgccgtaggggacagcgtaggacgagtccgaaacgtacgtggtacggctcgaccactacg

SEQ ID NO: 128398 - DNA, 577 bp, Homo sapiens
  misc_feature: GYAE6OF02GLV6R.2.70.G04.1.454.CMB.1.raw
  modified_base (203)..(203): a, c, t, g, unknown or other
  misc_feature (203)..(203): n is a, c, g, or t
  modified_base (246)..(246): a, c, t, g, unknown or other
  misc_feature (246)..(246): n is a, c, g, or t
  modified_base (252)..(252): a, c, t, g, unknown or other
  misc_feature (252)..(252): n is a, c, g, or t
  modified_base (352)..(352): a, c, t, g, unknown or other
  misc_feature (352)..(352): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaagngccaccctctcttgcagggccagtcagactgttggcagaaacngcttcncctggtaccagcagaaacctggccacgctccaggctcctcatctatgctacattcagcagcgccactggcactcccagacaggttcagtgcagtggttcngggacagtagtcactctcactatcacgcagtacgtcggacgccgtaggaggtattttcggacgtaggttagttagtttacgtgttactacgttcgtaggttcggttcggggttctcgtacgtcgttcggcgttaggtttcggccggtaggggtaccgacggtcgtaggtacgtacgtaccgaaacggtacgttacggttacggtcgtacggtaccgtaccgtacg

SEQ ID NO: 128399 - DNA, 616 bp, Homo sapiens
  misc_feature: GYAE6OF02GKXGJ.2.70.G04.1.454.CMB.1.raw
  modified_base (247)..(247): a, c, t, g, unknown or other
  misc_feature (247)..(247): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccgaggggaaagagccaccctctcttgcagggccagtcagactgttggcagaaacngcttctcctggtaccagcaagaacctggaccacgcctcccaggcctcctcatcctatgcctacacttcagcagccgccacgtggcactcccagacgtaggttcaggtcggctaggtgggtcgaggggactaggtacgttcacgtctaccacctatcagcacgacgtggacgtcgtaggtaggttacgttgacgtagttcgttattacgtagtctagtcgtaggttcgggtcgggtactcggtagtcgtcggtacgttaggtttcgggaccggtacggggaaccgtacgggtcggtagggtaacggtaaccgtaaccggtaaacggttacggttacgggtaccggttacgtaccggtaccgtacgttacg

SEQ ID NO: 128400 - DNA, 698 bp, Homo sapiens
  misc_feature: GYAE6OF02IR5IV.2.70.G04.1.454.CMB.1.raw
  modified_base (246)..(246): a, c, t, g, unknown or other
  misc_feature (246)..(246): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctcaggcacctgtctttgctcgagggaaagcgccaccctctcttgcgagggccagtcagacgtggttggcaagaaacngtcttctcgtggtaccagcacgaacctggaccacgctccgaggctccctcattctatcgactacacttcagccacgccgaccacgtcggacacctaccccgagtaaccgtcgggttacgaaggttccgggacgaacgggttcggggtacgtggggaaactaggttacgtactaccgttctacgaacccagtcgaacgtcgaacggtacgtgggaacgtccgtagggtacggttacttttagggacttagggttacgttaactttaccggtcgttaactaacgttcggtacgggttcggttcggggtaccttacggtagggtcggttaacgtcgtttaacggggtttccggaaccggttacgggaaccgtacggtaccggtaggttaacggtaacgtaacccggttaaaaccgtgggttacggtaggtaccgtaccggaccgtacgttacccg

SEQ ID NO: 128401 - DNA, 635 bp, Homo sapiens
  misc_feature: GYAE6OF02IKJPE.2.70.G04.1.454.CMB.1.raw
  modified_base (248)..(248): a, c, t, g, unknown or other
  misc_feature (248)..(248): n is a, c, g, or t
  modified_base (254)..(254): a, c, t, g, unknown or other
  misc_feature (254)..(254): n is a, c, g, or t
  modified_base (456)..(456): a, c, t, g, unknown or other
  misc_feature (456)..(456): n is a, c, g, or t
tcagacgctcgacacacgaccggtgctcgatttagtgtagtgtgaagggaaaggggggaagacgctgctcagttaggacccagagggaccatggaaaccccagcgcagcttctcttcctcctgctactctggctcccagataccaccggagaaactgtgtgacgcagtctccaggccaccctgtctttgtctccgaggggaaagagccaccctctcttgcagggccagtcagactgttggcaagaacngcttcncgtgtaccagcagaaacctggaccacgctaccgaggctcctcactctatcgctacacttcagcacgccgccacgtggacacgtccaagaccgtaggttccaggtcgacgtacggttggggtcgaggggtacctaggtacgttccgaacttccctacgacctattaccgagccgagtaacgagggacgtaccgtggaaggttntttggacttaggttcgtaagtttaccgtgttacacgttgtacggttggttacgggttcctacggtagtcgtcggttagttacgggtttcgggaccggtacggggtacctagggtacggttacgggacgtaacgtaaccgaaacgtacggtcgggtcggtaccggtcgaccgtactacgg

SEQ ID NO: 128402 - DNA, 252 bp, Homo sapiens
  misc_feature: GYAE6OF02GAZKT.2.70.G04.1.454.CMB.1.raw
  modified_base (240)..(240): a, c, t, g, unknown or other
  misc_feature (240)..(240): n is a, c, g, or t
  modified_base (246)..(252): a, c, t, g, unknown or other
  misc_feature (246)..(252): n is a, c, g, or t
tcagacgctcgacacacgaccggtgctcgatttagtgtagtgtgaagggaaaggggccggcgcgggagcgaatgagttctgggccagggaaccctggtcaccgtctcctcagcctccaccaagggcccatcggtcttccccctggcgccctgctccaggagcacctccgagagcacagcggccctgggctgcctggtcaaggctacttcctgtcgagcgtctgagcgggctggcaaggcncatagnnnnnnn

SEQ ID NO: 128403 - DNA, 590 bp, Homo sapiens
  misc_feature: GYAE6OF02GO5HY.2.70.G04.1.454.CMB.1.raw
  modified_base (247)..(247): a, c, t, g, unknown or other
  misc_feature (247)..(247): n is a, c, g, or t
  modified_base (253)..(253): a, c, t, g, unknown or other
  misc_feature (253)..(253): n is a, c, g, or t
  modified_base (293)..(293): a, c, t, g, unknown or other
  misc_feature (293)..(293): n is a, c, g, or t
  modified_base (305)..(305): a, c, t, g, unknown or other
  misc_feature (305)..(305): n is a, c, g, or t
  modified_base (316)..(316): a, c, t, g, unknown or other
  misc_feature (316)..(316): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccgaaggggaaagagcccaccctctcttgcagggccagtcagctgttgcagaaacngcttcnctggtaccagcagaacctggccacgctcccaggcctcctnatctatgctacnttcagcagccnccagtcggcactcccagaccaggttcaggtggctaggtgggtctaggggacaggtacttccaccttcgtaccaccgtatacgacgtcgacgacgtacggacgcgtaggtaggttatttggacgtagttagttacgttacgtgtactacgttcgtaggttcggtcgggttctcgtacgtcgttcgtcgtaggtttcggaccggtacgggtaccgtaggtcgtaggtacgtaacgtaacgtaacggtacgtcggtaggtcgtacgtaccacgtacg

SEQ ID NO: 128404 - DNA, 254 bp, Homo sapiens; identical to SEQ ID NO: 128057
  misc_feature: GYAE6OF02HKY62.2.70.G04.1.454.CMB.1.raw
  modified_base (248)..(254): a, c, t, g, unknown or other
  misc_feature (248)..(254): n is a, c, g, or t

SEQ ID NO: 128405 - DNA, 255 bp, Homo sapiens
  misc_feature: GYAE6OF02ISV01.2.70.G04.1.454.CMB.1.raw
  modified_base (248)..(255): a, c, t, g, unknown or other
  misc_feature (248)..(255): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggcccatcggtcttccccctggcgccctgttccaggagcacctccgagagcacagcggccctgggctgcctggtcaaggactacttcctgtcgagcgtctgagcgggctggcaaggcgcatagnnnnnnnn

SEQ ID NO: 128406 - DNA, 550 bp, Homo sapiens
  misc_feature: GYAE6OF02I9N3U.2.70.G04.1.454.CMB.1.raw
  modified_base (202)..(202): a, c, t, g, unknown or other
  misc_feature (202)..(202): n is a, c, g, or t
  modified_base (542)..(542): a, c, t, g, unknown or other
  misc_feature (542)..(542): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtcttgtctccaggggaaagngccaccctctcttgcagggccagtcagactgttggcagaaacagcttctcctggtaccagcagaacctggccacgctccaggcctcctcatctatgctacattcagcagcgccactggacactcccagacaggttcagtggacaggtcgggtcgtgggactaggtacgttcactctacaccatcgagcagactggacgccgtagagtgtttgactgtagttattacgtgtctagtcgtagtcggtgggtctcgagtcgtgcgttagtttcggacgagggacctaggtcggtaggaagaacgtaccgaaacggtaacgtcggttacggtacgtcggtaccnccgtaacg

SEQ ID NO: 128407 - DNA, 572 bp, Homo sapiens
  misc_feature: GYAE6OF02GPGUO.2.70.G04.1.454.CMB.1.raw
  modified_base (203)..(203): a, c, t, g, unknown or other
  misc_feature (203)..(203): n is a, c, g, or t
  modified_base (249)..(249): a, c, t, g, unknown or other
  misc_feature (249)..(249): n is a, c, g, or t
  modified_base (482)..(482): a, c, t, g, unknown or other
  misc_feature (482)..(482): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccgaggggaaangccaccctctcttgcagggccagtcagactgtggcagaacgcttcnctggtaccagcagaacctggccacgctccaggctcctcatctatgctacattcagcagccgccactcggacactcccagactaggttcaggtggctaggtgggtcgtagggacaggtacgttcactctaccaacctataccagacacgtacgtagggacgtccgtaggtacggtacgttttgcgtagttcgttacgttacgtcgttactagttcgaggttggtcgggtctcgngtcgtgtcgttaggtttcggaccgtacgggactaggcgtaggacgtacgtaacgaaacgtacgtcggtacgtacgtcgtacctacgtacg

SEQ ID NO: 128408 - DNA, 298 bp, Homo sapiens
  misc_feature: GYAE6OF02F3USS.2.70.G04.1.454.CMB.1.raw
  modified_base (156)..(156): a, c, t, g, unknown or other
  misc_feature (156)..(156): n is a, c, g, or t
  modified_base (220)..(220): a, c, t, g, unknown or other
  misc_feature (220)..(220): n is a, c, g, or t
  modified_base (255)..(255): a, c, t, g, unknown or other
  misc_feature (255)..(255): n is a, c, g, or t
  modified_base (257)..(298): a, c, t, g, unknown or other
  misc_feature (257)..(298): n is a, c, g, or t
tcagacgctcgacacacgaccggtgctcgatttagtgtagtgtgaagggaaagggggtccgggcggcgggagcgaatgagttctggggccagggaaccctggtcaccgtctccgtcagcctccaccaacgggccccatcggtcttccccctggccnccctgctccaggagcacctcgagagcacagcggccctgggctgcctggtcaaggactacttccngtcgagcgtctgagcgggctggcaaggcgcatagnannnnnnnnnnnnnnnnnnnnnnnnnnnnnnnnnnnnnnnnnn

SEQ ID NO: 128409 - DNA, 586 bp, Homo sapiens
  misc_feature: GYAE6OF02GWJBS.2.70.G04.1.454.CMB.1.raw
  modified_base (202)..(202): a, c, t, g, unknown or other
  misc_feature (202)..(202): n is a, c, g, or t
  modified_base (244)..(244): a, c, t, g, unknown or other
  misc_feature (244)..(244): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaangccaccctctcttgcagggccagtcagactgttgcagaaacngcttctcctggtaccagcagaaacctggccacgctccaggcctcctcatctatgctacattcagcagccgccactggcactcccagacaggttcagtggcaggtgggtctggggacaggtacgttcactctcacctatcagcagactggacgccgtagtaggtagtttgacgtagttagttacttacgttcgtactacgttcgtaggttaggttcggggttactcgtaggtcgttggtcgttaggttttcgggaccgtacggggtaaccgaagggtcgtagggtaacggtaacgttaaccgaaacggtaacgttggtacggacgtacgaccgtaaccgtacg

SEQ ID NO: 128410 - DNA, 259 bp, Homo sapiens
  misc_feature: GYAE6OF02J0BVU.2.70.G04.1.454.CMB.1.raw
  modified_base (209)..(209): a, c, t, g, unknown or other
  misc_feature (209)..(209): n is a, c, g, or t
  modified_base (237)..(237): a, c, t, g, unknown or other
  misc_feature (237)..(237): n is a, c, g, or t
  modified_base (243)..(259): a, c, t, g, unknown or other
  misc_feature (243)..(259): n is a, c, g, or t
tcagacgctcgacacacgaccggtgctcgatttagtgtagtgtgaaggaagggccggcgcgggagcgaatgagttctgggccagggaaccctggtcaccgtctcctcagcctccaccaagggcccatcggtcttccccctggcgccctgctccaggagcacctccgagagcacagcggccctgggctgcctggtcaaggactacttccngtcgagcgtctgagcggctggacaggcncagtgnnnnnnnnnnnnnnnnn

SEQ ID NO: 128411 - DNA, 256 bp, Homo sapiens; identical to SEQ ID NO: 128385
  misc_feature: GYAE6OF02GNL2D.2.70.G04.1.454.CMB.1.raw
  modified_base (248)..(256): a, c, t, g, unknown or other
  misc_feature (248)..(256): n is a, c, g, or t

SEQ ID NO: 128412 - DNA, 270 bp, Homo sapiens
  misc_feature: GYAE6OF02HI8HH.2.70.G04.1.454.CMB.1.raw
  modified_base (162)..(162): a, c, t, g, unknown or other
  misc_feature (162)..(162): n is a, c, g, or t
  modified_base (248)..(249): a, c, t, g, unknown or other
  misc_feature (248)..(249): n is a, c, g, or t
  modified_base (251)..(270): a, c, t, g, unknown or other
  misc_feature (251)..(270): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggcccatcggtcttccccctggcgccctgctccaggancacctccgagagcacagcggccctgggctgcctggtcaaggactacttcctgtcgagcgtctgagcgggctggcaaggcgcatagnngnnnnnnnnnnnnnnnnnnnn

SEQ ID NO: 128413 - DNA, 267 bp, Homo sapiens
  misc_feature: GYAE6OF02GL8UA.2.70.G04.1.454.CMB.1.raw
  modified_base (249)..(267): a, c, t, g, unknown or other
  misc_feature (249)..(267): n is a, c, g, or t
tcagacgctcgacacacgaccggtgctcgatttagtgtagtgtgaagggaaaggggccggcgcgggagcgaatgagttctggggccagggaaccctggtcaccgtctccctcagcctccaccaagggcccatcggtcttccccctggcgccctgctccaggagcacctccgagagcacagcggccctgggctgcctggtcaaggactacttcctgtcgagcgtctgagcgggctggcaaggcgcatagnnnnnnnnnnnnnnnnnnn

SEQ ID NO: 128414 - DNA, 707 bp, Homo sapiens
  misc_feature: GYAE6OF02I92IH.2.70.G04.1.454.CMB.1.raw
  modified_base (196)..(196): a, c, t, g, unknown or other
  misc_feature (196)..(196): n is a, c, g, or t
  modified_base (204)..(204): a, c, t, g, unknown or other
  misc_feature (204)..(204): n is a, c, g, or t
  modified_base (239)..(239): a, c, t, g, unknown or other
  misc_feature (239)..(239): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcacctgtcttgctcagggaangccacctntctgcaggccagtcagctgtggcagaaacgcttcnctggtaccagcagaaacctggaccaacggcctacccgaggcctccgtacacgtcctaagtcgacttaacacttacgaacgtcacgccgacctacgtcggctaaccgtccccgaagtacgttacggttacacgggttacgggacctaaggttcggggtactacgggggaaactaacgggtacgttttaccggaaacctttcccttaccgaaccccgtagttaccgaaaggtacccgtaaggtaaaccgtcggggtaaacgtcccgtaggtaaacgggtttacttttcggaacggtaagtttacgtacttaacgtgtaactacgtacgtagggttacgggttgggtcctacggaacgttcggttgtacggttacgggtttcgacccggtagggaaccgtaaggttccgtagggacgtaacgaaccgtaaacggtacggtcggtacgtaccgtcgaacccgtacgtaacgg

SEQ ID NO: 128415 - DNA, 251 bp, Homo sapiens
  misc_feature: GYAE6OF02FLXD8.2.70.G04.1.454.CMB.1.raw
  modified_base (245)..(251): a, c, t, g, unknown or other
  misc_feature (245)..(251): n is a, c, g, or t
tcagacgctcgacacacgaccggtgctcgatttagtgtagtgtgaagggaaaggggccggcgcgggagcgaatgagttctgggccagggaaccctggtcaccgtctcctcagcctccaccaaggcccatcggtcttccccctggcgccctgctccaggagcacctccgagagcacagcggccctgggctgcctggtcaaggactacttcctgtcgagcgtctgagcggctggcaaggcgcatagnnnnnnn

SEQ ID NO: 128416 - DNA, 564 bp, Homo sapiens
  misc_feature: GYAE6OF02HDQB8.2.70.G04.1.454.CMB.1.raw
  modified_base (204)..(204): a, c, t, g, unknown or other
  misc_feature (204)..(204): n is a, c, g, or t
  modified_base (246)..(246): a, c, t, g, unknown or other
  misc_feature (246)..(246): n is a, c, g, or t
  modified_base (252)..(252): a, c, t, g, unknown or other
  misc_feature (252)..(252): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccgaggggaaagngccaccctctcttgcagggccagtcagactgtggcagaaacngcttcnctggtaccagcagaacctggccacgctccaggcctcctcatctatgctacattcagcagccgccactcggcactcccagacaggtacaggtggcaggtggggtactgggacaggtacttccacttcctcacctatcgacgcacggacgtgggacgtccgtaggtaggttatttgcgtagttgttattacgtgtacattcgaggttggtcgggtctgagtcggtgtcgtaggtttcggaccggtacggggacctaggtcggtaggaagtaacgtaacgaaacggtacgtaggtacgtcggtacgacacgtacg

SEQ ID NO: 128417 - DNA, 255 bp, Homo sapiens; identical to SEQ ID NO: 128292
  misc_feature: GYAE6OF02IV880.2.70.G04.1.454.CMB.1.raw
  modified_base (248)..(255): a, c, t, g, unknown or other
  misc_feature (248)..(255): n is a, c, g, or t

SEQ ID NO: 128418 - DNA, 779 bp, Homo sapiens
  misc_feature: GYAE6OF02H3BEG.2.70.G04.1.454.CMB.1.raw
  modified_base (195)..(195): a, c, t, g, unknown or other
  misc_feature (195)..(195): n is a, c, g, or t
  modified_base (206)..(206): a, c, t, g, unknown or other
  misc_feature (206)..(206): n is a, c, g, or t
  modified_base (245)..(245): a, c, t, g, unknown or other
  misc_feature (245)..(245): n is a, c, g, or t
  modified_base (436)..(436): a, c, t, g, unknown or other
  misc_feature (436)..(436): n is a, c, g, or t
tcagacgctcgacacacgaccggtgctcgatttagtgtagtgtgaagggaaaggggaagagctgctcagttaggacccagagggaccatggaaacccagcgcagcttctcttcctctgctactctggctcccagataccaccggagaaactgtgtgacgcagtctccaggcacctgtctttgctccgaggggaanacgccaccctntctgcgaggccagtcaggtactggttaggcaaggaaacngtccttcgtccgtacggtaccaggcaacgaaaccgtcggaccacggcctccgacggtctccactatactactgcctacgtactacgacgccgacgccgacctacgtcggaccacgtacccgagtacgtacggttacaggttcggagtacgggttcggggtacgtacggggaactacggttacgtttacccnccgtacgtaccgtactaccgtacgaacggtacggtaacggtcggtacggtaacgtaccggtaggttacggttacgtttacggtaaccgttaagtttacgttaaacgttccggttaacgtacttaacggttacgggtttaacgggttcggggtttaccggtaccgttaaccgggtacgggttaccggttcgggttaacggtttaccgggttaccggggaacccggggttaacggggtaaccgtaacgggtacgggtttaacgggaaacgttaaacccgttaacgggttaaccggtacggttacgggtaccgtacccggtaaccgttaaccggttacgttaacgg

SEQ ID NO: 128419 - DNA, 253 bp, Homo sapiens
  misc_feature: GYAE6OF02H13PV.2.70.G04.1.454.CMB.1.raw
  modified_base (248)..(253): a, c, t, g, unknown or other
  misc_feature (248)..(253): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaaggcccatcggtcttccccctggcgcctgctccaggagcacctccgagagcacagcggccctgggctgcctggtacaaggactacttcctgtcgagcgtctgaggcgggctggcaaggcgcatagnnnnnn

SEQ ID NO: 128420 - DNA, 706 bp, Homo sapiens
  misc_feature: GYAE6OF02IXGY4.2.70.G04.1.454.CMB.1.raw
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcacctgtctttgtctccaggggaaagagccaccctctcttgcagggccagtcagactgttggcagaaacagcttctcctggtaccagcagaaacctggccacgcctccaggctcctcatctaatgctactattcagcagccgccaactggaccatcccaagactaggttacaggtggcagttcggggtctggggacaggagttacacttcgtccaaccgtataccgacgacaacgaacgtagggacgtacccgtggtaacggttacgttttacgggacctaaggttagtttaacgtttaacgttacggttaccctaacgttacgtaacgggttaggttttccggggggttaaccttaccggtaacgggttacccggttaggtaccggtttaacgggttttttaccggggaccggtaaccggggggtaacccgtaaagggtaccggttaggggtaaacggtaacgttaaacccggtaaaaccgtaaccgttacgggtaaccggtaccggtacgggtaacctacccgtaaccg

SEQ ID NO: 128421 - DNA, 591 bp, Homo sapiens
  misc_feature: GYAE6OF02FPX89.2.70.G04.1.454.CMB.1.raw
  modified_base (202)..(202): a, c, t, g, unknown or other
  misc_feature (202)..(202): n is a, c, g, or t
  modified_base (211)..(211): a, c, t, g, unknown or other
  misc_feature (211)..(211): n is a, c, g, or t
  modified_base (245)..(245): a, c, t, g, unknown or other
  misc_feature (245)..(245): n is a, c, g, or t
  modified_base (303)..(303): a, c, t, g, unknown or other
  misc_feature (303)..(303): n is a, c, g, or t
  modified_base (313)..(313): a, c, t, g, unknown or other
  misc_feature (313)..(313): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaangccaccctntcttgcagggccagtcagactgttggcagaaacngcttctcctggtaccagcagaaacctggccacgctccaggctcctcatctatgctacnttcagcagcnccacgtggcactcccagtaccaggttcaggtcggactagggttcgggtacgtaggggaaccagggtacgtttccaacgttctaccgacctagtacgacgcacgacgtaggacgccgtaggtaggtatttcgacgtagtagttacttacgtgttactagtcgtaggtggtcggggtactcgtagtcgtcgtacgttgtttacggaccgtagggacctaacggtcgtaggacggtaactaacgaaacggtacgtacggtcggtacgtcgtaccacgtacg

SEQ ID NO: 128422 - DNA, 619 bp, Homo sapiens
  misc_feature: GYAE6OF02HYHLV.2.70.G04.1.454.CMB.1.raw
  modified_base (247)..(247): a, c, t, g, unknown or other
  misc_feature (247)..(247): n is a, c, g, or t
  modified_base (253)..(253): a, c, t, g, unknown or other
  misc_feature (253)..(253): n is a, c, g, or t
  modified_base (309)..(309): a, c, t, g, unknown or other
  misc_feature (309)..(309): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccgaggggaaagacgccaccctctcttgcagggccagtcagactgtggcagaaacngcttcnctgtacagcagaacctggccacgctccaggctcctcactcctatcgctacattcancagccgaccacgtggcactcccagaccgtaggttccaggttcggcaggttcgggtcgtggggacagtacgttcacgtcctacacccgtatcgaacgccagacctggagccgtgaggtatttggctagtttcgtatttacgtgtactagttacgtaggttacgggttgggtccgttacgaacggttcgtcggtacgttacggttttacgggaccggtacggggtaaccgtacgggtcggttagggaacgtaacgttaacccggtaaacggtaccggttagggtcggtaccgtacggacccgtaccgttacg

SEQ ID NO: 128423 - DNA, 526 bp, Homo sapiens
  misc_feature: GYAE6OF02FT7UA.2.70.G04.1.454.CMB.1.raw
  modified_base (203)..(203): a, c, t, g, unknown or other
  misc_feature (203)..(203): n is a, c, g, or t
  modified_base (245)..(245): a, c, t, g, unknown or other
  misc_feature (245)..(245): n is a, c, g, or t
  modified_base (315)..(315): a, c, t, g, unknown or other
  misc_feature (315)..(315): n is a, c, g, or t
  modified_base (402)..(402): a, c, t, g, unknown or other
  misc_feature (402)..(402): n is a, c, g, or t
  modified_base (411)..(411): a, c, t, g, unknown or other
  misc_feature (411)..(411): n is a, c, g, or t
  modified_base (420)..(420): a, c, t, g, unknown or other
  misc_feature (420)..(420): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaagngccaccctctcttgcagggccagtcagctgttggcagaaacngcttctcctggtaccagcagaaacctggccacgctcccaggcctcctcatctatgctacattcagcagcnccactggcatcccagacaggttcaggtgctaggtgggtctgggacagtagttcactctcactatcagcagactggacgcctgaggtnttgctagtntattacgtntcatgtagtggttcgggtctgagtcgtgctaggtttcggcgacgggtaccaggtcgtaggtagtacgtacgaacgtacgtggtacggtcgtacggtaccaccgtac

SEQ ID NO: 128424 - DNA, 248 bp, Homo sapiens; identical to SEQ ID NO: 128339
  misc_feature: GYAE6OF02HSZ4J.2.70.G04.1.454.CMB.1.raw
  modified_base (247)..(248): a, c, t, g, unknown or other
  misc_feature (247)..(248): n is a, c, g, or t

SEQ ID NO: 128425 - DNA, 279 bp, Homo sapiens
  misc_feature: GYAE6OF02G236A.2.70.G04.1.454.CMB.1.raw
  modified_base (251)..(279): a, c, t, g, unknown or other
  misc_feature (251)..(279): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggcccatcggtcttccccctggccgccctgctccaggagcacctccgagagcacagcggccctgggctgcctggtcaaggactacttcctgtcgagcgtctgagcgggctgggcaagggcgcatagnnnnnnnnnnnnnnnnnnnnnnnnnnnnn

SEQ ID NO: 128426 - DNA, 588 bp, Homo sapiens
  misc_feature: GYAE6OF02JKKF4.2.70.G04.1.454.CMB.1.raw
  modified_base (246)..(246): a, c, t, g, unknown or other
  misc_feature (246)..(246): n is a, c, g, or t
  modified_base (324)..(324): a, c, t, g, unknown or other
  misc_feature (324)..(324): n is a, c, g, or t
  modified_base (372)..(372): a, c, t, g, unknown or other
  misc_feature (372)..(372): n is a, c, g, or t
  modified_base (472)..(472): a, c, t, g, unknown or other
  misc_feature (472)..(472): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaagagccaccctctcttgcagggccagtcagactgttggcagaaacngcttctcctggtaccagcagaaaccctggccacgcctcccaggctcctcactctatcgctacacttcaagtccagccnccacgtggcactccagacgaggttcagtcggcaggtggtctggggacngtattccatccacaccatcgacgcacgacgtggacgtctaggtacggtatttgcttagtgttattacgtgtctagtacgtaggtggttcgggtactacgngtcggtgtcgttaggtttccggacgggtacgggtaccgaacggtcggttacggtaacggtacgttaaccgaaaccggtacgttacggtacggtacggtccggtacgaccgttaacg

SEQ ID NO: 128427 - DNA, 255 bp, Homo sapiens
  misc_feature: GYAE6OF02F5T8F.2.70.G04.1.454.CMB.1.raw
  modified_base (248)..(254): a, c, t, g, unknown or other
  misc_feature (248)..(254): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccgaagggcccatcggtcttccccctggcgccctgctccaggagcacctcgagagcacagcggccctgggctgcctggtcaaggactacttcctgtcgagcgtctgagcgggctggcaaggcgcatagnnnnnnng

SEQ ID NO: 128428 - DNA, 252 bp, Homo sapiens
  misc_feature: GYAE6OF02HNGDF.2.70.G04.1.454.CMB.1.raw
  modified_base (247)..(252): a, c, t, g, unknown or other
  misc_feature (247)..(252): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaaggcccatcggtcttcccctggcgccctgctccaggagcacctccgagagcacagcggcctgggctgcctggtcaaggactacttcctgtcgagcgtctggagcgggctgggcaaggcgcatagnnnnnn

SEQ ID NO: 128429 - DNA, 277 bp, Homo sapiens
  misc_feature: GYAE6OF02IDX8A.2.70.G04.1.454.CMB.1.raw
  modified_base (262)..(277): a, c, t, g, unknown or other
  misc_feature (262)..(277): n is a, c, g, or t
tcagacgctcgacacacgaccggtgctcgatttagtgtagtgtgaagggaaaggggccggcgcgggagcgaatgagttctggggccagggaccctggtcaccgtctcctcagcctccaccaagggcccatcggtcttccccctggccgccctgctccaggagcacctccgagagcacagcggccctgggctgcctggtcaaggactacttcctgtccgagcgttcctgaggccgggctgggaccgaagggtccgcaagtagnnnnnnnnnnnnnnnn

SEQ ID NO: 128430 - DNA, 722 bp, Homo sapiens
  misc_feature: GYAE6OF02FK9HG.2.70.G04.1.454.CMB.1.raw
  modified_base (200)..(200): a, c, t, g, unknown or other
  misc_feature (200)..(200): n is a, c, g, or t
  modified_base (241)..(241): a, c, t, g, unknown or other
  misc_feature (241)..(241): n is a, c, g, or t
  modified_base (252)..(252): a, c, t, g, unknown or other
  misc_feature (252)..(252): n is a, c, g, or t
  modified_base (313)..(313): a, c, t, g, unknown or other
  misc_feature (313)..(313): n is a, c, g, or t
  modified_base (357)..(357): a, c, t, g, unknown or other
  misc_feature (357)..(357): n is a, c, g, or t
tcagacgctcgacacacgaccggtgctcgatttagtgtagtgtgaagggaaagggggaagagctgctcagttaggacccagagggaaccatggaaaccccagcgcagcttcccttcctcctgctactctggctcccagataccaccggagaaactgtgttgacgcagtctccaggcaccctgtctttgctccaggggaangccaccctctcttgcagggccagtcagactgtggcagaacngctctctgacngcagaacctggccacgctacccaggcctcctcatctatgactacatcagcagcgcctacgnggacactcccaagacgaggttcagtggacagggttgggttacgngggacaggtacgtttaccacttcgacctaaccgtatcgacgaccgaaggaccgtacgggacgtccgtagggtacggttacgttttacggaccgttaggttacgtttaacgtttaccgtacgttaccgtacgttacgtacgggtttacgggtcggggttaccgttaccggtacggttccgggttacggtaccggtttaaccgggttttcgggaacccgggtaaccgggggtacccgtaaacggggttaccgggttaacgggtaaaccggtaaacgtttaaccccggtaaaaacggtaaccgggtttacgggtaccgggttacccgttaaccgggtaaccccgttaacccgttacgggtttacccgg

SEQ ID NO: 128431 - DNA, 254 bp, Homo sapiens
  misc_feature: GYAE6OF02GKWOJ.2.70.G04.1.454.CMB.1.raw
  modified_base (249)..(254): a, c, t, g, unknown or other
  misc_feature (249)..(254): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggcccatcggtcttccccctggcgccctgctccaggagcacctccgagagcacagcggccctgggctgcctggtcaaggactacttcctgtcgagcgtctgagcgggctggcaaggcgcagtagnnnnnn

SEQ ID NO: 128432 - DNA, 254 bp, Homo sapiens
  misc_feature: GYAE6OF02IZMFD.2.70.G04.1.454.CMB.1.raw
  modified_base (239)..(239): a, c, t, g, unknown or other
  misc_feature (239)..(239): n is a, c, g, or t
  modified_base (245)..(254): a, c, t, g, unknown or other
  misc_feature (245)..(254): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaaggcccatcggtcttccccctggcgccctgctccaggagcacctccgagagcacagcggccctgggctgcctggtcaaggactacttcctgtcgagcgtctgagcggctggcaggcncatagnnnnnnnnnn

SEQ ID NO: 128433 - DNA, 645 bp, Homo sapiens
  misc_feature: GYAE6OF02IZ5DB.2.70.G04.1.454.CMB.1.raw
  modified_base (201)..(201): a, c, t, g, unknown or other
  misc_feature (201)..(201): n is a, c, g, or t
  modified_base (242)..(242): a, c, t, g, unknown or other
  misc_feature (242)..(242): n is a, c, g, or t
  modified_base (248)..(248): a, c, t, g, unknown or other
  misc_feature (248)..(248): n is a, c, g, or t
  modified_base (256)..(256): a, c, t, g, unknown or other
  misc_feature (256)..(256): n is a, c, g, or t
  modified_base (286)..(286): a, c, t, g, unknown or other
  misc_feature (286)..(286): n is a, c, g, or t
  modified_base (419)..(419): a, c, t, g, unknown or other
  misc_feature (419)..(419): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgctccgagggaaangccaccctctcttgcagggccagtcagactgtgcagaaacngcttcnctgtaccngcagaacctggaccacgctccaggctcctnactctatgacctacattcgacgctacgccgcctacgtggacctacgtccccaagacgtacggttacaacgtggacctagggtacggtcgcgggtacaggtacgtttaccacggtctaccgtaccgtataccgngtacacgtacgtggacgtccgtaggacgttatttcgacgttagtacgttaactcgtacgtactagtacgtaggttaggttacgggtctacgaggtcgttcggtacgttacgggtttacggtaccggacgggtaaccttaacgggtcggttaacggaacgtacccggttacggtaaaaaccggttcgttacgggttacggaccggttaacgtaccgtacgtttacgg

SEQ ID NO: 128434 - DNA, 266 bp, Homo sapiens
  misc_feature: GYAE6OF02G8L3Q.2.70.G04.1.454.CMB.1.raw
  modified_base (249)..(249): a, c, t, g, unknown or other
  misc_feature (249)..(249): n is a, c, g, or t
  modified_base (251)..(266): a, c, t, g, unknown or other
  misc_feature (251)..(266): n is a, c, g, or t
tcagacgctcgacacacgaccggtgctcgatttagtgtagtgtgaagggaaagggggccggcgcgggagcgaatgagttctggggccagggaaccctggtcaccgtctcctcagcctccaccaagggcccatcggtcttccccctggcgcctgctccaggagcacctccgagagcacagcggcctgggctgcctggtcaaaggactacttcctgtcgagcgtctgagcgggctggcaaggcgcaatagnannnnnnnnnnnnnnnn

SEQ ID NO: 128435 - DNA, 773 bp, Homo sapiens
  misc_feature: GYAE6OF02GHDDJ.2.70.G04.1.454.CMB.1.raw
  modified_base (203)..(203): a, c, t, g, unknown or other
  misc_feature (203)..(203): n is a, c, g, or t
  modified_base (245)..(245): a, c, t, g, unknown or other
  misc_feature (245)..(245): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccgaggggaaancgccaccctctcttgcagggccagtcagactgtgcagaaacngcttctccgtggtaccagcagaaacctggcccacgcctacccgaggtcctcctacatcctatcgcttaactacttcgagccagccgacctacgtcggacctacgtccccaaggtaccgtaaggtttccaaggttcggacctaggggttcgggtacgtagggggaactaacgggtacgtttccgaaccgttcgtacccgaaccgtacgttccgaacggtacgtaacgtaaccggtcgggtaccggtacccgttaggggtaacggtttacgtttttacgggaccgttaagggtttacgtttaacggtttaccgttacggttaccttaagttaccggtaagggttcggggtttaccggggtttaccttacggtaacgggttcgttacgttaccggtttaacgggttttccgggacccgggttaacggggtaaccgtaacgggtccgggttaggtaacggtaaacgttaaccgggtaaaccgttacggttacggttaccgggtacctttacgggacccttaaccggttaacg

SEQ ID NO: 128436 - DNA, 703 bp, Homo sapiens
  misc_feature: GYAE6OF02JVYIV.2.70.G04.1.454.CMB.1.raw
  modified_base (200)..(200): a, c, t, g, unknown or other
  misc_feature (200)..(200): n is a, c, g, or t
  modified_base (209)..(209): a, c, t, g, unknown or other
  misc_feature (209)..(209): n is a, c, g, or t
  modified_base (246)..(246): a, c, t, g, unknown or other
  misc_feature (246)..(246): n is a, c, g, or t
  modified_base (260)..(260): a, c, t, g, unknown or other
  misc_feature (260)..(260): n is a, c, g, or t
  modified_base (292)..(292): a, c, t, g, unknown or other
  misc_feature (292)..(292): n is a, c, g, or t
tcagacgctcgacacacgaccggtgctcgatttagtgtagtgtgaagggaaaggggaagagctgctcagttaggacccagagggaaccatggaaaccccagcgcagcttctcttcctcctgctactctggctcccagactaccaccggagaaactgtgttgacgcagtctccaggcaccctgtctttgctccagggaaangccaccctntcttgccagggccagtcagtactgttggacaagaacngcttctctgtaccngcagaacctggccacgctccgaggcctcctanacgtctacgtgactaccattccgaagtccaggtcccgaacccctaccgttagggacctacgtcccccgaaagggtacctaaccggggtttacaaggggtttccggggactaaccgggggtttcgggtttaacccggtcgggggaaaccttaagggggtaacccttttcccggaaccgttcccgtacgaaacccctagtacgtacgtaccgtaacgtaccgtacggtaccggtccgtacggtaaggttccgttaggtaccgttaaggttcgttagttacggtcgtactagttcgtaggttacggtcgggttctcgtagtccgtagtcgttagtttcgggtacgtacgggtacgtacgggtctaggtacgacgtacgaaaccgtagtacggtacgactacggtaccagtacgg

SEQ ID NO: 128437 - DNA, 306 bp, Homo sapiens
  misc_feature: GYAE6OF02HVI40.2.70.G04.1.454.CMB.1.raw
  modified_base (143)..(143): a, c, t, g, unknown or other
  misc_feature (143)..(143): n is a, c, g, or t
  modified_base (147)..(147): a, c, t, g, unknown or other
  misc_feature (147)..(147): n is a, c, g, or t
  modified_base (160)..(160): a, c, t, g, unknown or other
  misc_feature (160)..(160): n is a, c, g, or t
  modified_base (225)..(225): a, c, t, g, unknown or other
  misc_feature (225)..(225): n is a, c, g, or t
  modified_base (248)..(248): a, c, t, g, unknown or other
  misc_feature (248)..(248): n is a, c, g, or t
  modified_base (255)..(262): a, c, t, g, unknown or other
  misc_feature (255)..(262): n is a, c, g, or t
  modified_base (264)..(306): a, c, t, g, unknown or other
  misc_feature (264)..(306): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggcccatcggtcttccccnggcncctgctccaggancacctccgagagcacagcggcctgggctgcctggtccaaggcttacgttcctgtccgagcgttcnggacgcgggactggcaaggccgnaagtagnnnnnnnnannnnnnnnnnnnnnnnnnnnnnnnnnnnnnnnnnnnnnnnnnn

SEQ ID NO: 128438 - DNA, 576 bp, Homo sapiens
  misc_feature: GYAE6OF02GOZD8.2.70.G04.1.454.CMB.1.raw
  modified_base (246)..(246): a, c, t, g, unknown or other
  misc_feature (246)..(246): n is a, c, g, or t
  modified_base (290)..(290): a, c, t, g, unknown or other
  misc_feature (290)..(290): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaagagccaccctctcttgcagggccagtcagactgttggcagaaacngcttctcctggtaccagcagaacctggccacgctccaggctccncatctatcgctacattcagtcacgcgccacgtggcactcccagacgtagttcgagtggctagggtggtcgagggactagtacgttcactccgtacaccatcagcagcgtggactcgtaggagttactttgcgtagttgttagttactgtctagtcgtaggtacgggttgggtcgtacgtggttcgtcgtcgttacggttttcggaccggtagggtaaccctagggtacgtgggaacgtacgttaacgaaacgtacgttcggtacggcgtacggtacctacgtaccg

SEQ ID NO: 128439 - DNA, 575 bp, Homo sapiens
  misc_feature: GYAE6OF02FQOS6.2.70.G04.1.454.CMB.1.raw
  modified_base (203)..(203): a, c, t, g, unknown or other
  misc_feature (203)..(203): n is a, c, g, or t
  modified_base (245)..(245): a, c, t, g, unknown or other
  misc_feature (245)..(245): n is a, c, g, or t
  modified_base (396)..(396): a, c, t, g, unknown or other
  misc_feature (396)..(396): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaagngccaccctctcttgcagggccagtcagactgttgcagaaacngcttctcctggtaccagcagaaacctggccacgctccaggctcctcatctatgctacattcagcagcgccactggcatcccagacaggttcagtgcagtgggtctgggacagagttcactcacacatcagcagactggagccgtgacggtntttgcttaggtgttattacgttgtactagtacgtaggttcggtttaggggttcttacgtacgtcgttcgtcgttaaggtttcgggtaccggaggggtacccgtaaggtcggttaggaacggtaacgtaaccgtaaacggtacgttagggttacggtacgtacggtaccgtaccgtaccg

SEQ ID NO: 128440 - DNA, 253 bp, Homo sapiens
  misc_feature: GYAE6OF02H794L.2.70.G04.1.454.CMB.1.raw
  modified_base (247)..(253): a, c, t, g, unknown or other
  misc_feature (247)..(253): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaaggcccatcggtcttccccctggcgccctgctccaggagcacctccgagagcacagcggccctgggctgcctggtcaaggactacttcctgtcgagcgtctgagcgggctggcaaggcgcatagnnnnnnn

SEQ ID NO: 128441 - DNA, 739 bp, Homo sapiens
  misc_feature: GYAE6OF02JWQ0K.2.70.G04.1.454.CMB.1.raw
  modified_base (204)..(204): a, c, t, g, unknown or other
  misc_feature (204)..(204): n is a, c, g, or t
  modified_base (251)..(251): a, c, t, g, unknown or other
  misc_feature (251)..(251): n is a, c, g, or t
  modified_base (269)..(269): a, c, t, g, unknown or other
  misc_feature (269)..(269): n is a, c, g, or t
  modified_base (318)..(318): a, c, t, g, unknown or other
  misc_feature (318)..(318): n is a, c, g, or t
  modified_base (345)..(345): a, c, t, g, unknown or other
  misc_feature (345)..(345): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccgaaggggaaancgcccaccctctcttggcagggccagtcagactggttgacagaaacngcttactccgtagtaccngcaagaacctggccacgcctccgaggcttcctcgatctatcgactacgnttccagtcacgccgcccacgtggaccncgtacccagacgtacggtcctaggtcgactcggtgggtcgtacggggactaggtacgttaccgaccgttacctaccgacctacgtccgaacggtacgtaacggaccggtacgggtacgaacccggttggtaacgggtttacgtttaggaccgttaaggtttaccggtttaaagtttcccggtacggttactacgttaccgtacgggtttacgggttaccggggttaccgtaacggtacgggttccgttaggttaacccgggtttacggttttacggggacccgggttaacggggaaccgttacgggtaaccgggttagggaaacgttaacgttaacccggtaaacggtacgggttaccggttgggtaccgtaaccggtacctacccggttacgg

SEQ ID NO: 128442 - DNA, 271 bp, Homo sapiens
  misc_feature: GYAE6OF02J0RQR.2.70.G04.1.454.CMB.1.raw
  modified_base (248)..(249): a, c, t, g, unknown or other
  misc_feature (248)..(249): n is a, c, g, or t
  modified_base (251)..(271): a, c, t, g, unknown or other
  misc_feature (251)..(271): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggcccatcggtcttccccctggcgccctgctccaggagcacctccgagagcacagcggccctgggctgcctggtcaaggactacttcctgtcgagcgtctgagcggctggcaaggcgctatagnnannnnnnnnnnnnnnnnnnnnn

SEQ ID NO: 128443 - DNA, 660 bp, Homo sapiens
  misc_feature: GYAE6OF02HPXRP.2.70.G04.1.454.CMB.1.raw
  modified_base (202)..(202): a, c, t, g, unknown or other
  misc_feature (202)..(202): n is a, c, g, or t
  modified_base (211)..(211): a, c, t, g, unknown or other
  misc_feature (211)..(211): n is a, c, g, or t
  modified_base (245)..(245): a, c, t, g, unknown or other
  misc_feature (245)..(245): n is a, c, g, or t
  modified_base (291)..(291): a, c, t, g, unknown or other
  misc_feature (291)..(291): n is a, c, g, or t
  modified_base (297)..(297): a, c, t, g, unknown or other
  misc_feature (297)..(297): n is a, c, g, or t
  modified_base (428)..(428): a, c, t, g, unknown or other
  misc_feature (428)..(428): n is a, c, g, or t
  modified_base (476)..(476): a, c, t, g, unknown or other
  misc_feature (476)..(476): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggactcccagataccaccggagaaactgtgttgacgcagtctccaggcacctgtctttgtctccaggggaaanagccacctntcttgcagggccagtcagactgttggcaagaacngcttctctggtaccagcagaacctggccacgctccaggtctacctnatctangtactacgtattcaagccagccgtccactggacactccccaaggactaaggttccagggtcgacgagggttcgggtactggggaactaggtacgtttccgaacttcacacctatcagtcacgacgtggacncgtaggagttactttgacgttgttagttacttacgtgtacctaggttntacggttggttacgggttactcggtacggttaccgttacggtttacggtttacgggtacccgggtagggtacccggtaaggtaccggttgggtaacggttaaccggtaacgtaaaaccccgggttaacgtttaccgggtacggttaacccgttacggaacccgtaccgttacccgtttaaccgg

SEQ ID NO: 128444 - DNA, 659 bp, Homo sapiens
  misc_feature: GYAE6OF02FTRYR.2.70.G04.1.454.CMB.1.raw
  modified_base (202)..(202): a, c, t, g, unknown or other
  misc_feature (202)..(202): n is a, c, g, or t
  modified_base (245)..(245): a, c, t, g, unknown or other
  misc_feature (245)..(245): n is a, c, g, or t
  modified_base (251)..(251): a, c, t, g, unknown or other
  misc_feature (251)..(251): n is a, c, g, or t
  modified_base (304)..(304): a, c, t, g, unknown or other
  misc_feature (304)..(304): n is a, c, g, or t
  modified_base (350)..(350): a, c, t, g, unknown or other
  misc_feature (350)..(350): n is a, c, g, or t
  modified_base (359)..(359): a, c, t, g, unknown or other
  misc_feature (359)..(359): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaangccaccctctcttgcagggccagtcagactgttggcagaaacngcttcncctggtaccagcagaaacctggccacgctcccaggctcctcatctatgcctanattcagccagccgccactggccatccccgagacaggttcagtggcnggtgggtcngggactaggtattcactctaccacatcaacgcagacgtcggacgccgtaggtaggtacgttttgaccttaggtacgtttacttacgttgttctaagttccgtagggttacgggttggggtttacccgttacggtacgggttaccgggttacggtccggttttaagggttttaccgggaccggttaacggggggttaaccctaacgggtccggttaaggggtaaccggtaacgttaaccgtaaaacggttaacgtttcggggttaccgggttaaccgtcggtaccccgtaacctttaacgg

SEQ ID NO: 128445 - DNA, 258 bp, Homo sapiens
  misc_feature: GYAE6OF02GIEG0.2.70.G04.1.454.CMB.1.raw
  modified_base (248)..(258): a, c, t, g, unknown or other
  misc_feature (248)..(258): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggcccatcggtcttccccctggcgccctgctccaggagcacctccgagagcacagcggccctgggctgcctggtcaaggactacttcctgtcgagcgtctgagcgggctggcaaggcgcatagnnnnnnnnnnn

SEQ ID NO: 128446 - DNA, 258 bp, Homo sapiens
  misc_feature: GYAE6OF02HKOCG.2.70.G04.1.454.CMB.1.raw
  modified_base (247)..(258): a, c, t, g, unknown or other
  misc_feature (247)..(258): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaaggcccatcggtcttccccctggcgccctgctccaggagcacctccgagagcacagcggccctgggctgcctggtcaaggactacttcctgtcgagcgtctgagcgggctggcaaggcgcatagnnnnnnnnnnnn

SEQ ID NO: 128447 - DNA, 652 bp, Homo sapiens
  misc_feature: GYAE6OF02JOW0S.2.70.G04.1.454.CMB.1.raw
  modified_base (206)..(206): a, c, t, g, unknown or other
  misc_feature (206)..(206): n is a, c, g, or t
  modified_base (251)..(251): a, c, t, g, unknown or other
  misc_feature (251)..(251): n is a, c, g, or t
  modified_base (394)..(394): a, c, t, g, unknown or other
  misc_feature (394)..(394): n is a, c, g, or t
tcagacgctcgacacacgaccggtgctcgatttagtgtagtgtgaagggaaagggggaagagctgctcagttaggacccagagggaaccatgggaaaccccagcgcagcttctcttcctcctgctactctggctcccagataccaccggagaaactgtgttgacgcagtctccaggccaccctgtctttgtctccgaggggaaagngccaccctctcttgcgaggccagtcagtctggttggacagaaacngtacttctcgtagtaccagacaaggaacctcggaccacggcctcccgaagcctcccgtacatcgtatcgactacgattaccacgcagccgaccactggctaacgcccagacgtacgtacgaggtacgcgtaggtcgggttacngggactaggtacgttccgaaccgtctacgacctacggtacacggtcgaacgacgtacggacgtactggtagtacgtttgaccgttagtagttacgttactcgtaactacgttacgtacgttcgggttcggtaccttacggtacggttacgttccgtacggtttaccgggttacgggtacccgtcgggtaaacgtcgggtaacgttacggtataaccggtacgtaaacgacgttacgggctacggtacaccgtactacg

SEQ ID NO: 128448 - DNA, 265 bp, Homo sapiens
  misc_feature: GYAE6OF02IQWF6.2.70.G04.1.454.CMB.1.raw
  modified_base (253)..(265): a, c, t, g, unknown or other
  misc_feature (253)..(265): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggcccatcggtcttccccctggcgccctgctccaggagcacctccgagagcacagcggccctgggctgcctggtcaaggacttacttcctgtcgagccgtctggagcgggctgggcaagggcgcatagnnnnnnnnnnnnn

SEQ ID NO: 128449 - DNA, 277 bp, Homo sapiens
  misc_feature: GYAE6OF02IEQD9.2.70.G04.1.454.CMB.1.raw
  modified_base (162)..(162): a, c, t, g, unknown or other
  misc_feature (162)..(162): n is a, c, g, or t
  modified_base (223)..(223): a, c, t, g, unknown or other
  misc_feature (223)..(223): n is a, c, g, or t
  modified_base (253)..(277): a, c, t, g, unknown or other
  misc_feature (253)..(277): n is a, c, g, or t
tcagacgctcgacacacgaccggtgctcgatttagtgtagtgtgaagggaaaggggccggcgcgggagcgaatgagttctggggccagggaacctggtcaccgtctcctcagcctccaccgaaggcccatcggtcttccccctggccgccctgctccaggancacctcgagagcacagcggccctggctgcctggtacaaggactacttcctgtacgagcgtncgagcgggtctggacaagggctcgaagtgnnnnnnnnnnnnnnnnnnnnnnnnn

SEQ ID NO: 128450 - DNA, 644 bp, Homo sapiens
  misc_feature: GYAE6OF02JXM8M.2.70.G04.1.454.CMB.1.raw
  modified_base (203)..(203): a, c, t, g, unknown or other
  misc_feature (203)..(203): n is a, c, g, or t
  modified_base (261)..(261): a, c, t, g, unknown or other
  misc_feature (261)..(261): n is a, c, g, or t
  modified_base (332)..(332): a, c, t, g, unknown or other
  misc_feature (332)..(332): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgaccgcagtctccaggcaccctgtctttgtctccaggggaaancgccaccctctcttgccgtagggccaggtcagtaccgtgttggcaagaaacgtcttcncgtgtaccagcagaaacctggccagctccgaggcctcctacactctatcgctactacttcgacgctagccncctacgtggacctactcccagacgtaggtaccagtcgacgagttcgggtacgtcggggaaactacgtacgtttccgaacgtcctaccgactaacgtcgtacgcgtaacgtaccgtacggacgtccgtacggtacggttacgttaggtccgttaagttacggttacgttaccgtagttacgtacgttacgtaggttcggtcgggtacgtcggtacgttacgtcgttagtacggttttcggaccgtcggggtaacacggtcgtaggtacgtaacgttacgaacgtacgtggtaccgtgtacgcgtaccgtacgg

SEQ ID NO: 128451 - DNA, 648 bp, Homo sapiens
  misc_feature: GYAE6OF02FPNT1.2.70.G04.1.454.CMB.1.raw
  modified_base (202)..(202): a, c, t, g, unknown or other
  misc_feature (202)..(202): n is a, c, g, or t
  modified_base (211)..(211): a, c, t, g, unknown or other
  misc_feature (211)..(211): n is a, c, g, or t
  modified_base (244)..(244): a, c, t, g, unknown or other
  misc_feature (244)..(244): n is a, c, g, or t
  modified_base (315)..(315): a, c, t, g, unknown or other
  misc_feature (315)..(315): n is a, c, g, or t
  modified_base (325)..(325): a, c, t, g, unknown or other
  misc_feature (325)..(325): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggccaccctgtctttgtctcagggaaagngccaccctntcttgcagggccagtcagactgttgcagaaacngtcttctccgtgaccagcacgaaacctggccacgctcccaggctcctcatctatgctacattcagcagccncacgtcgacnctccagacgtagttcgagttcggactaggtgggtcgtagggtacagtacgttacgacttcctaccgaaccacgtacgtacgactaggacgtacgggtacgcccgttaggtacggttacgttttcgtacgtacggtttacgttaagtttaacgtcgttacctaacgttacgtagggtttcgggttcgggtacgttcgtacggtaccggttgtaccgtaggttttcgggaccgtacgggtaaccgtaagggtcggtaggaacggtaacgttaccggaaaccgtacgttgggttacggtaccggtacggttacccgaacgttacgg

SEQ ID NO: 128452 - DNA, 266 bp, Homo sapiens
  misc_feature: GYAE6OF02F1ZAI.2.70.G04.1.454.CMB.1.raw
  modified_base (162)..(162): a, c, t, g, unknown or other
  misc_feature (162)..(162): n is a, c, g, or t
  modified_base (241)..(241): a, c, t, g, unknown or other
  misc_feature (241)..(241): n is a, c, g, or t
  modified_base (247)..(266): a, c, t, g, unknown or other
  misc_feature (247)..(266): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggcccatcggtcttccccctggcgccctgctccaggancacctccgagagcacagcggccctggctgcctggtcaaggactacttcctgtcgagcgtctgagcgggctggcaaggcncatagnnnnnnnnnnnnnnnnnnnn

SEQ ID NO: 128453 - DNA, 251 bp, Homo sapiens
  misc_feature: GYAE6OF02JM0IT.2.70.G04.1.454.CMB.1.raw
  modified_base (240)..(240): a, c, t, g, unknown or other
  misc_feature (240)..(240): n is a, c, g, or t
  modified_base (243)..(243): a, c, t, g, unknown or other
  misc_feature (243)..(243): n is a, c, g, or t
  modified_base (246)..(251): a, c, t, g, unknown or other
  misc_feature (246)..(251): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccgaagggcccatcggtcttccccctggccgccctgctccaggagcacctccgagagcacagcggccctgggctgcctggtcaaggactactcctgtcgagcgtctgagcggctgcaggcncanagnnnnnn

SEQ ID NO: 128454 - DNA, 724 bp, Homo sapiens
  misc_feature: GYAE6OF02GIZJU.2.70.G04.1.454.CMB.1.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (246)..(246): a, c, t, g, unknown or other
  misc_feature (246)..(246): n is a, c, g, or t
  modified_base (313)..(313): a, c, t, g, unknown or other
  misc_feature (313)..(313): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaagngccaccctntcttgcagggccagtcagactgttggcagaaacngcttctccgtggtaccagacaagaaacctggaccacgcctcccgaggcctcctcatctatcgctacnttcagcagccgccacgtggccacgtccccaagtactacggttacaggtgggactagggtcgggtcgtaggggactaggtacgttacaccttcgtacctaaccgtagtaccgaacgtccgtaacggtacgtgggtaaccggtaccgtaggtaacgggttacgttttagacggttagttacggttacgtttacgtacgttctaagttacggtaacgggtttcgggttacggggtttacctacgggtaccggttacgggttaccgggtacgttttaacgggggttttccgggaaccccgggtaagggggtaaccctaacggggttccggtaaggggaaccgtaacggttaaacccggtaaacggtaacggttacgggtaccgggtacgttacggtaaccccgtaacgtttaccg

SEQ ID NO: 128455 - DNA, 269 bp, Homo sapiens
  misc_feature: GYAE6OF02IEGPD.2.70.G04.1.454.CMB.1.raw
  modified_base (256)..(269): a, c, t, g, unknown or other
  misc_feature (256)..(269): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggcccatcggtcttccccctggccgccctgctccaggacgcacctccgagagcacgagcggccctgggctgccgtggtacaaggactaccttccttcgacgtcgtctggagcgggctggcaaggcgcatagnnnnnnnnnnnnnn

SEQ ID NO: 128456 - DNA, 643 bp, Homo sapiens
  misc_feature: GYAE6OF02FPHNL.2.70.G04.1.454.CMB.1.raw
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
  modified_base (247)..(247): a, c, t, g, unknown or other
  misc_feature (247)..(247): n is a, c, g, or t
  modified_base (255)..(255): a, c, t, g, unknown or other
  misc_feature (255)..(255): n is a, c, g, or t
  modified_base (297)..(297): a, c, t, g, unknown or other
  misc_feature (297)..(297): n is a, c, g, or t
  modified_base (316)..(316): a, c, t, g, unknown or other
  misc_feature (316)..(316): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaaactgtgttgacgcagtctccaggcaccctgtctttgtctccgaggggaaanagccaccctntcttgcagggccagtcagactgtggcagaaacngcttctcnggtaccagcagaacctgccacgctccaggcctcctacatctntcgctacattcagcagccnccacgtggccactaccccagaacgtaggtttacaggtcggcgtacggttcgggtcgttagggacgtaacggtacgtttccaacgttccctacgaaccctagtaccaacgtacaacgacgttcggacgcccgttagtacggtatttagactaggttacgttaagttaccttgtacctagttacgtaggttcgggttcgggtacgttcgacggtacgtcgtacgtttagggtttcgggtaccggtacgggaaccggtaacgcggttaacggtaagaacgtaacgttaaaacgtacgttacgggtacggtacgtacggtaccgtataccg

SEQ ID NO: 128457 - DNA, 279 bp, Homo sapiens
  misc_feature: GYAE6OF02F84JD.2.70.G04.1.454.CMB.1.raw
  modified_base (225)..(225): a, c, t, g, unknown or other
  misc_feature (225)..(225): n is a, c, g, or t
  modified_base (245)..(245): a, c, t, g, unknown or other
  misc_feature (245)..(245): n is a, c, g, or t
  modified_base (251)..(252): a, c, t, g, unknown or other
  misc_feature (251)..(252): n is a, c, g, or t
  modified_base (254)..(279): a, c, t, g, unknown or other
  misc_feature (254)..(279): n is a, c, g, or t
tcagacgctcgacacacgaccggtgctcgatttagtgtagtgtgaagggaaagggggccggcgcggggagcgaatgagttctggggccagggaaccctggtcaccgtctcctcagcctccaccaagggcccatcggtcttccccctggcgccctgctccaggagcacctccgagagcacagcggccctgggctgcctggtcaaggactacttcctgtcagcgtcnggagcgggctggcaagggcncatagnngnnnnnnnnnnnnnnnnnnnnnnnnnn

SEQ ID NO: 128458 - DNA, 261 bp, Homo sapiens
  misc_feature: GYAE6OF02FR6I2.2.70.G04.1.454.CMB.1.raw
  modified_base (249)..(261): a, c, t, g, unknown or other
  misc_feature (249)..(261): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaaggcccatcggtcttccccctggcgccctgctccaggagcacctccgagagcacagcggccctgggctgcctggtcaaggactacttcctgtcgagcgtctgaggcgggctggcaaggcgcagtagnnnnnnnnnnnnn

SEQ ID NO: 128459 - DNA, 254 bp, Homo sapiens
  misc_feature: GYAE6OF02F3AFN.2.70.G04.1.454.CMB.1.raw
  modified_base (249)..(254): a, c, t, g, unknown or other
  misc_feature (249)..(254): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggcccatcggtcttccccctggcgccctgctccaggagcacctccgagagcacagcggccctgggctgcctggtcaaggactacttcctgtcgagcgtctgagcgggctgggcaaggcgcatagnnnnnn

SEQ ID NO: 128460 - DNA, 287 bp, Homo sapiens
  misc_feature: GYAE6OF02H4CM0.2.70.G04.1.454.CMB.1.raw
  modified_base (258)..(270): a, c, t, g, unknown or other
  misc_feature (258)..(270): n is a, c, g, or t
  modified_base (272)..(287): a, c, t, g, unknown or other
  misc_feature (272)..(287): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggccccatcggtccttccccctggccgccctgctccaggagcacctcgagagcaacagcggccctgggctgcctggtccaaggactacttcctgtcgaagcgtctgagcgggctaggccaagggctacaatagnnnnnnnnnnnnntnnnnnnnnnnnnnnnn

SEQ ID NO: 128461 - DNA, 760 bp, Homo sapiens
  misc_feature: GYAE6OF02GA5YH.2.70.G04.1.454.CMB.1.raw
  modified_base (203)..(203): a, c, t, g, unknown or other
  misc_feature (203)..(203): n is a, c, g, or t
  modified_base (254)..(254): a, c, t, g, unknown or other
  misc_feature (254)..(254): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagactaccaccggagaaactgtgttgacgcagtctccaggcacctgtctttgtctcgaaggggaaangcccaccctctcgttgcgagggccagtcagacttggttcggacaagaaacngtccttctccgtaggtaccagacaagaaacctggaccacgcctccgacggtcctcctactactctatcgtacctactacttacgacgccacgccgaccgtagtcggacctaccgtacccgaagtacgtacggttacgacggtcggtacgtacgggttcgggtacgtacgggaactaacgggtacgttaccgtaccttaccgtacccgaacgtacgtaccgaacgtacaacggtacgtacgggacttaccggtaggttacggttacgtttcgacggttacgttaacgtttaacgttacggttcgtaaccgtaggttaacgtagggttacgggttacgggtcttaacggcggttacgggtttacgttacgggtttacggttaccggggaccgggtacggggtaaccgtacgggttaccggtaaacgggtaacgtaaaccggtaaccggtaaaaccggttaccggttagggtaaccggtaccgttaccggaccggttaacccggttacg

SEQ ID NO: 128462 - DNA, 648 bp, Homo sapiens
  misc_feature: GYAE6OF02GNHL8.2.70.G04.1.454.CMB.1.raw
  modified_base (202)..(202): a, c, t, g, unknown or other
  misc_feature (202)..(202): n is a, c, g, or t
  modified_base (211)..(211): a, c, t, g, unknown or other
  misc_feature (211)..(211): n is a, c, g, or t
  modified_base (242)..(242): a, c, t, g, unknown or other
  misc_feature (242)..(242): n is a, c, g, or t
  modified_base (248)..(248): a, c, t, g, unknown or other
  misc_feature (248)..(248): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccgaggggaangccaccctntcttgcagggccagtcagactgtgcagaacngcttcncctggtaccagcaacgaaacctggccacgcctacccaggcctcctcactctactgactactattcagctacgccgccacgtcggacactcccgagactggttacgagtggactaggttgggtcgtacggggactagggtacgtttccacgttacctcctaacccgactaccgaaggtcccaaaggtaccgtcgggacgtccggttaaggtacgggttacttttcggacttagttacggtttaattaaccgtgttacctagttcgtaggttcgggttcgggtttctacggtacgtcggttcgtacggttacgggtttacggaccggttacgggacgtaacggtcggtaggaacgtacgttaaccgaaagtacggtacggtacggtacgtcgtaccactacg

SEQ ID NO: 128463 - DNA, 717 bp, Homo sapiens
  misc_feature: GYAE6OF02FNZ1T.2.70.G04.1.454.CMB.1.raw
  modified_base (205)..(205): a, c, t, g, unknown or other
  misc_feature (205)..(205): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggcctcccagactaccaccggagaaactgtgttgacgcagtcctccaggcaccctgtcttgtctccgaaggggaanacgccaccctctcttgcgacggccagtccagtactggttcggacaagaaactgtcctttacctccgtaggtaaccagacaacgaaaccgtcggacccaccgcctacccgaggccctacctactactctatcgtacctactacttcacgtcgacgccaccgacgtgccactacccgagacgtacggtacaggtggcgtaggtcggtacggtacgggactaacgggtcttacctacttcctaccaaccgtcgtacgtacgaccgaacggtacgtcgggaccgtcggtaggtaacggttacgtttacggacgttaggtttcgtttaaacgttacgttcgttacgtaagttacggtacggggtttccggttacgggtccgttacggtacgttaccggtttgttaccggtttacgggtttacgggaccgggttaccggaccgtacgggtacgtacgggtaacaaccgttaaccgaaacggttacgtagggttacgtacccggacggtacctactacg

SEQ ID NO: 128464 - DNA, 759 bp, Homo sapiens
  misc_feature: GYAE6OF02IP238.2.70.G04.1.454.CMB.1.raw
  modified_base (207)..(207): a, c, t, g, unknown or other
  misc_feature (207)..(207): n is a, c, g, or t
  modified_base (261)..(261): a, c, t, g, unknown or other
  misc_feature (261)..(261): n is a, c, g, or t
  modified_base (343)..(343): a, c, t, g, unknown or other
  misc_feature (343)..(343): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggccacccttgtctttgtctaccgaggggaaacngcccacccttctcttgcacgggccaggtcagtacttggttcggacaaggaaacngtccttcgtcctggaccagtacaagaacccctggacccacggccctccgagcctaccactactctatcgacttactacgttnaccgacgactccgctacctggacctacctacccgaggtaaccgtacggtttcgagttacgggacgtagggtccgggttacggtacggaacgtaggttaccgttaccgtacctttcccaacgttacccgtagtcgtaacgaaccgtacgggtacctaggggtaaccgtcgttaggtaccggttacttttacggccggttaaggtttacttaattttccggaacttacgtcggttagtaggtttcgggtaacgggttacctgggttactcgggtttaacgtttcggttaacgggtttacggcccggggtaacgggttacgtaacgggtacgggttacgggaaaccgttagttaaaacccggtaaggttacggggtttccgtaaggggttccctaacgggttaccctaccgttaccggg

SEQ ID NO: 128465 - DNA, 670 bp, Homo sapiens
  misc_feature: GYAE6OF02FZCIA.2.70.G04.1.454.CMB.1.raw
  modified_base (212)..(212): a, c, t, g, unknown or other
  misc_feature (212)..(212): n is a, c, g, or t
  modified_base (251)..(251): a, c, t, g, unknown or other
  misc_feature (251)..(251): n is a, c, g, or t
  modified_base (323)..(323): a, c, t, g, unknown or other
  misc_feature (323)..(323): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccgagggaaagcgccaccctntcttgcagggccagtcagtactggttcggacaagaaacngtccttctccgtggtaccagaccaacgaaacctggccacgcctccgagctcctcatcatcgactacattcancacgccgccactggaccacgtcccgaagacctaacggttcagggtcgacgtagggttcgggtcgtagggactagggtacgttccaccttacgtaccaacctaagtacgacgtacaacggtaccggtacggtacgaccgtaggtacggttagtttcggaacgttaggttcgttaatttccgtgtactaacgttcggtacgggttgggttaccgggttcgtaccgagggttaccgtggttacgttcgggttttacgggaccggtacggggtaacccgtagggttacggtagggaacgtaacgttaaccggtaacggtacgttagggtaccgtcgtacgacctacgtacg

SEQ ID NO: 128466 - DNA, 659 bp, Homo sapiens
  misc_feature: GYAE6OF02FZEDD.2.70.G04.1.454.CMB.1.raw
  modified_base (203)..(203): a, c, t, g, unknown or other
  misc_feature (203)..(203): n is a, c, g, or t
  modified_base (247)..(247): a, c, t, g, unknown or other
  misc_feature (247)..(247): n is a, c, g, or t
  modified_base (371)..(371): a, c, t, g, unknown or other
  misc_feature (371)..(371): n is a, c, g, or t
  modified_base (400)..(400): a, c, t, g, unknown or other
  misc_feature (400)..(400): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagactaccaccggagaaactgtgttgacgcagtctccaggcaccctgtctttgtctccgagggaaancgccacctctcttgcagggccagtcagactgttgacaagaaacngtcttctcctggtaccagcaacgaaacctggaccacggcttacccgaggtacctcctctactctagttggcgcaactaccgaacgcgggcctacgtcgactcccgagccgtaggtcagtcgganacggtggtctaggggactaggtcgttacncgtctacaccagtcacgcgacgtcctggtactacggtacgtagtaaacgtacgttttacggacgttaagtttaacgttacgttagttacgacgtacgtagtaacgttaacttacgtaccggtaccgttaccggttacggttaaccggttaccggaccgtaaaccggtaaccggaaggtaacggaacgtaaccggaaacgtaacgtacggtacggactacgaccgtacgtactaccgttacgtacgttactacttacccg

SEQ ID NO: 128467 - DNA, 803 bp, Homo sapiens
  misc_feature: GYAE6OF02G3WO6.2.70.G04.1.454.CMB.1.raw
  modified_base (206)..(206): a, c, t, g, unknown or other
  misc_feature (206)..(206): n is a, c, g, or t
  modified_base (257)..(257): a, c, t, g, unknown or other
  misc_feature (257)..(257): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagactaccaccggagaaactgtgttgacgcagtcctccaggccaccctgtctttgtctccgaggggaaancgcccaccctctcttgcgagggccagtcagtacgtggttcggacaagaacngtcttctccgtggtaccagacaacgaaccgtggacccacgtccctacccgacggcccttaccctacacttaccgttaactcggtaccttaacctacgtttacccgaaggtaccaaccggccccggtacccctaacggttaccgggacctaacccgtacccccggaaagggtaccgttacggggttaccgtacgggtcggggaccgttaaggggttcgggtccggtaagggggaacctagggtaccgtttcccaacgttaccctaccgaaccttagaccgtacgaccgtaacggtccggtaggacggtccgtaggtaacggtttacgtttaccgagttacgttacgttacttaccggttgtaccttagtacgttacgggttacgggttcgggtacctacggtacgttccgggttaacttaccgggtttgggtttacccgggacggggtaacccgggtaccgtaacgggtacggtacgggtaagtaacccgttaaccggtaaaccggttacgttcgggtacctacccggtggaccccttacgtaccgg

SEQ ID NO: 128468 - DNA, 612 bp, Homo sapiens
  misc_feature: GYAE6OF02IC6VX.2.70.G04.1.454.CMB.1.raw
  modified_base (202)..(202): a, c, t, g, unknown or other
  misc_feature (202)..(202): n is a, c, g, or t
  modified_base (247)..(247): a, c, t, g, unknown or other
  misc_feature (247)..(247): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccgaggggaanagccaccctctcttgcagggccagtcagactgttggcaagaaacngcttctcctggtaccagcaagaaacctggccacgctcccgaggctcctcatctatcgactacattcagcagcgccactggcactcccagacaggttacagttggactaggtgggtcgtggggacaggtacgtttcgacttctccaacctatacgagaccaaggaccgtacgggacgccggtaggtaacggttagttttggacgttaggttacgttaacgtttacgttcggttactaacttcgtaggttcgggttggggtcctggtacggtcgttcggtacgttaggtttcgggaccgtaggggaaccgtaggtcgtaggagacgtaacgaacgtacggtacggtcgggtacctggaccacgtacg

SEQ ID NO: 128469 - DNA, 656 bp, Homo sapiens
  misc_feature: GYAE6OF02FJH1A.2.70.G04.1.454.CMB.1.raw
  modified_base (202)..(202): a, c, t, g, unknown or other
  misc_feature (202)..(202): n is a, c, g, or t
  modified_base (247)..(247): a, c, t, g, unknown or other
  misc_feature (247)..(247): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaangccaccctctcttgcagggccagtcagactggttggcaagaaacngcttctcctggtaccagcaacggaaaccgtcggcccacggcctcccgaggccttcccgtcacttcctagtgccttacattccgagcacgcgacccacgtggaccactccccgaagacctaggttcaggtcggacgtggtgggtcgtaggggactagggtacgtttccacgttcctacacccgatcgagccgagacgtgggacgccgtaggtacggttatttcgcgttacgttagttagtttcttagtacctagtcgtaagggttcggttgggtcctacggtcggtcgttcggtacggttcgggttttcgggaccggtacggggtaccgtaacgggtcggttagggaacgttaacgtaaccggtaaacggtacggttacgggtggtacccgtacgacccgtaccgtacgg

SEQ ID NO: 128470 - DNA, 285 bp, Homo sapiens
  misc_feature: GYAE6OF02G1S8A.2.70.G04.1.454.CMB.1.raw
  modified_base (151)..(151): a, c, t, g, unknown or other
  misc_feature (151)..(151): n is a, c, g, or t
  modified_base (226)..(226): a, c, t, g, unknown or other
  misc_feature (226)..(226): n is a, c, g, or t
  modified_base (244)..(244): a, c, t, g, unknown or other
  misc_feature (244)..(244): n is a, c, g, or t
  modified_base (250)..(257): a, c, t, g, unknown or other
  misc_feature (250)..(257): n is a, c, g, or t
  modified_base (259)..(260): a, c, t, g, unknown or other
  misc_feature (259)..(260): n is a, c, g, or t
  modified_base (265)..(265): a, c, t, g, unknown or other
  misc_feature (265)..(265): n is a, c, g, or t
  modified_base (269)..(285): a, c, t, g, unknown or other
  misc_feature (269)..(285): n is a, c, g, or t
tcagacgctcgacacacgaccggtgctcgatttagtgtagtgtgaagggaaagggggccggcgcgggagcgaatgagttctggggccagggaaccctggtcaccgtctcctcgagcctccaccgaagggcccatcggtcttccccctggcnccctgctccaggagcacctccgagagcacagcggccctgggctgcctggtcaaggactacttcctgtcgagcgtntgagcgggctggcaggcncatagnnnnnnnngnngctancagnnnnnnnnnnnnnnnnn

SEQ ID NO: 128471 - DNA, 250 bp, Homo sapiens
  misc_feature: GYAE6OF02G4QNS.2.70.G04.1.454.CMB.1.raw
  modified_base (241)..(241): a, c, t, g, unknown or other
  misc_feature (241)..(241): n is a, c, g, or t
  modified_base (247)..(250): a, c, t, g, unknown or other
  misc_feature (247)..(250): n is a, c, g, or t
tcagacgctcgacacacgaccggtgctcgatttagtgtagtgtgaagggaaaggggccgcgcgggagcgaatgagttctggggccagggaaccctggtcaccgtctcctcagcctccaccaagggcccatcggtcttccccctggcgccctgctccaggagcacctccgagagcacagccggccctgggctgcctggtcaaggactacttcctgtcgagcgtctgagcggctggcaaggcncatagnnnn

SEQ ID NO: 128472 - DNA, 775 bp, Homo sapiens
  misc_feature: GYAE6OF02IV9CH.2.70.G04.1.454.CMB.1.raw
  modified_base (202)..(202): a, c, t, g, unknown or other
  misc_feature (202)..(202): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctccagataccaccggagaaactgtgttgacgcagtctccaggcaccctgtctttgtctccgaggggaaancgcccaccctctcttcgcgacgggccagtcagtacgttggttggacgaagaaacagtccttcctccgtacggtaccaggaccaaggaaaccctggacccacggccctacccgaggtccctcctcactacctatcgaccttactacttacgacggcacggtccgtcccaacgtccggacaccttaccccgaagtaccgtacggtttcgacggtggacgtagggtcgggtcgtagggtaaccgaacggtacgtttaccgacccgttactacccgtaacccgtaatccgaacggaccgtaacggtaaccgtaggggaccgtccgggtaggtaacgggttcgttttaacggaccgttaacggttacgttaacgtttacggtacgttaaccgtacggttacgtacggggttcgggttacgggttcttacgggacggttcggtacggtacggttttaacgggttccggaaccgggtagggtaacccgtacgggtccggtaagggaactaaccggttaacggtaaaaccggtacgtttcggggtaccgttaccgtaccggggtacccaccggttaaccgg

SEQ ID NO: 128473 - DNA, 675 bp, Homo sapiens
  misc_feature: GYAE6OF02JRKPV.2.70.G04.1.454.CMB.1.raw
  modified_base (210)..(210): a, c, t, g, unknown or other
  misc_feature (210)..(210): n is a, c, g, or t
  modified_base (317)..(317): a, c, t, g, unknown or other
  misc_feature (317)..(317): n is a, c, g, or t
  modified_base (327)..(327): a, c, t, g, unknown or other
  misc_feature (327)..(327): n is a, c, g, or t
  modified_base (562)..(562): a, c, t, g, unknown or other
  misc_feature (562)..(562): n is a, c, g, or t
  modified_base (592)..(592): a, c, t, g, unknown or other
  misc_feature (592)..(592): n is a, c, g, or t
tcagacgctcgacacacgaccggtgctcgatttagtgtagtgtgaagggaaaggggaagagctgctcagttaggacccagagggaaccatggaaaccccagcgcagcttctcgttcctcctgcctactcgtcggctcccagataccaccggagaaactgtgttgacgcagtcctcgacggcaccctgtctttcgactccgaaggggaaancgccctacctctcgttgcacgggtccagtccagtactgtcggcaagaacgtcttctcgaggtaccagcaacgtaactcggacccacggcctacccgagtccacctanactcgttacncggacttaacgcttcgacgtacaccggccgtaccctacggtggtacccaccgttaccccggaagaccgttacccggttagacggttccggacgtagggtttcggcgtacgggtaactcgggttacgtttaccaacgtccctaaccgtaaacgtctaccggacgacgaacgttccgacggtaccgtaccgtaggtacgggttacttttacggaccgttagttacgtacgttacgtntacctagtcgttagtcggtacgtcgtacgngtccgtgtaacgttcgtcggtaccgtacggacgaggtcggtacgtagtactacgaacgttcgtaggtcgctacgacgtatccg

SEQ ID NO: 128474 - DNA, 915 bp, Homo sapiens
  misc_feature: GYAE6OF02ISSFJ.2.70.G04.1.454.CMB.1.raw
  modified_base (201)..(201): a, c, t, g, unknown or other
  misc_feature (201)..(201): n is a, c, g, or t
  modified_base (245)..(245): a, c, t, g, unknown or other
  misc_feature (245)..(245): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaanagccaccctctcttgcgacggccagtcagactgttgcagaaacngtcttctctggtaccagcacgaaaccgtggaccacgcctccgacggtcctccgtactatcctatcgtactactacgttaccgacgtcaacggccgtaccgtactcggacctaccgtacccgtaggtaacctaggttacctaaggttcggacgtaacgggttcggggttacgtacgggggaacgtaacgggtacgtttacccgaacccgtttaccgaaccgtaacctaacgttacccggaacggtaaccccgtaacgggtaacccggtaacgggtaccggtacccgggtttaaaggggtaacgggttttaccgtttttacggggaaccggtttaacgggttttaccggttttaaacgttttaacccggtttacgggtttaacccgtaaccggttttaccgggtaaacggggttttaccgggggtttccgggggtttaccgttacccgggttaaacggggtttcccgggtttaaccggggttacccggttttttaaaccgggggttttacccggggtaaccccgggggtaacggggggttaaacccttaacggggggttcccggttaagggggtaaacgttaaacccggttaaaccgggtaaaaaccgggtttacggttacggggttaccgggtttaacccgtacgggttaccccgttaaccttaacccggg

SEQ ID NO: 128475 - DNA, 258 bp, Homo sapiens
  misc_feature: GYAE6OF02I3BWQ.2.70.G04.1.454.CMB.1.raw
  modified_base (247)..(258): a, c, t, g, unknown or other
  misc_feature (247)..(258): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggcccatcggtcttccccctggcgccctgctccaggagcacctccgagagcacagcggccctgggctgcctggtcaaggctacttcctgtcgagcgtctgagcggctggacaaggcgcatagnnnnnnnnnnnn

SEQ ID NO: 128476 - DNA, 524 bp, Homo sapiens
  misc_feature: GYAE6OF02GMI8L.2.70.G04.1.454.CMB.1.raw
  modified_base (202)..(202): a, c, t, g, unknown or other
  misc_feature (202)..(202): n is a, c, g, or t
  modified_base (245)..(245): a, c, t, g, unknown or other
  misc_feature (245)..(245): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaangccaccctctcttgcagggccagtcagactgttggcagaaacngcttctcctggtaccagcagaaacctggccacgctcccaggctcctcatctatgctacattcagcagcgccactggcatcccagacaggttcagtggcaggtgggtctgggacagagttcactctcaccatcagcagacgtggagcctggaggtatttgctagtgttattactgtcatcagtggtgggtctcgagtcgtgcgtagttttgggccgaggggaccgaaggcgtagggtagaagtacgaaacgaacgttggtggtcgtacgtccaccgtacg

SEQ ID NO: 128477 - DNA, 722 bp, Homo sapiens
  misc_feature: GYAE6OF02H60LF.2.70.G04.1.454.CMB.1.raw
  modified_base (202)..(202): a, c, t, g, unknown or other
  misc_feature (202)..(202): n is a, c, g, or t
  modified_base (248)..(248): a, c, t, g, unknown or other
  misc_feature (248)..(248): n is a, c, g, or t
  modified_base (321)..(321): a, c, t, g, unknown or other
  misc_feature (321)..(321): n is a, c, g, or t
tcagacgctcgacacacgaccggtgctcgatttagtgtagtgtgaaggggaaagggggaagagctgctcagttaggacccagagggaaccatggaaaccccagcgcagcttctcttcctctgctactctgctcccagataccaccggagaaactgtgttgacgcagtctccaggccaccctgtcttgtctccgaaggggaanacgccaccctctcttgcgagggccagtcagactgtggcaagaaacngcttctctcggtacagcaacgaactggccacgcctaccgaggcctcctacattctatcgaactactacttacngtaccgaacgccgaccaacgttcggacctaacgtaccccgaagtaccgttacggttacgacgggtacgggtacgtaacggggttcggggtaaccggtaggggtaacccgttaggggttaaacctttcccgtacccggtttaccaaccgtaaacccttagttaccgtaacgaccgtaacggtaaccgtacgggtaaccggtacgtaaccgggttaaggttacgttttacggtacgttaacgtttacgttaacgttaacgttcgtactaacgtacgtacggttgggtcgtaccgtggtacggtcgtcgtacgttaggttccggaacggtacggaacgtagcggtaacggtagaacgttaacgaacggttacgtcggtacggtacgtacgtaccgtacgttacg

SEQ ID NO: 128478 - DNA, 304 bp, Homo sapiens
  misc_feature: GYAE6OF02HEOR8.2.70.G04.1.454.CMB.1.raw
  modified_base (237)..(237): a, c, t, g, unknown or other
  misc_feature (237)..(237): n is a, c, g, or t
  modified_base (258)..(258): a, c, t, g, unknown or other
  misc_feature (258)..(258): n is a, c, g, or t
  modified_base (264)..(304): a, c, t, g, unknown or other
  misc_feature (264)..(304): n is a, c, g, or t
tcagacgctcgacacacgaccggtgctcgatttagtgtagtgtgaagggaaaggggccggcgcgggagcgaatgagttctggggccagggaaccctggtcaccgtccgtcctcagcctccaccaaggcccatcggtcttccccctggccaccctgctccaggagcacctccgagacgcacgtaggccggcccgtggggctcgcctagggtcaaaggacctacttcctgtcgagcgtntgacgcgggctggacgaggcncatagnnnnnnnnnnnnnnnnnnnnnnnnnnnnnnnnnnnnnnnnn

SEQ ID NO: 128479 - DNA, 347 bp, Homo sapiens
  misc_feature: GYAE6OF02GVMY1.2.70.G04.1.454.CMB.1.raw
  modified_base (165)..(165): a, c, t, g, unknown or other
  misc_feature (165)..(165): n is a, c, g, or t
  modified_base (256)..(257): a, c, t, g, unknown or other
  misc_feature (256)..(257): n is a, c, g, or t
  modified_base (259)..(259): a, c, t, g, unknown or other
  misc_feature (259)..(259): n is a, c, g, or t
  modified_base (261)..(261): a, c, t, g, unknown or other
  misc_feature (261)..(261): n is a, c, g, or t
  modified_base (281)..(281): a, c, t, g, unknown or other
  misc_feature (281)..(281): n is a, c, g, or t
  modified_base (283)..(283): a, c, t, g, unknown or other
  misc_feature (283)..(283): n is a, c, g, or t
  modified_base (286)..(286): a, c, t, g, unknown or other
  misc_feature (286)..(286): n is a, c, g, or t
  modified_base (290)..(347): a, c, t, g, unknown or other
  misc_feature (290)..(347): n is a, c, g, or t
tcagacgctcgacacacgaccggtgctcgattttagtgtagtgtgaagggaaaggggccggcgcgggagcgaatgagttctgggccagggaccctggtcaccgtctcctcagcctccaccaagggccccatcggtcttccccccgtggccgccctgctccaggancacctccgagagcacagccggccctgggctgcctggtcaaggctacttcctgtccgagccgtctgaggcggctggcaagggcgtccatagnnancntcgattgcaatgaagcctcngntangcannnnnnnnnnnnnnnnnnnnnnnnnnnnnnnnnnnnnnnnnnnnnnnnnnnnnnnnnn

SEQ ID NO: 128480 - DNA, 791 bp, Homo sapiens
  misc_feature: GYAE6OF02IYJR2.2.70.G04.1.454.CMB.1.raw
  modified_base (120)..(120): a, c, t, g, unknown or other
  misc_feature (120)..(120): n is a, c, g, or t
  modified_base (149)..(149): a, c, t, g, unknown or other
  misc_feature (149)..(149): n is a, c, g, or t
  modified_base (207)..(207): a, c, t, g, unknown or other
  misc_feature (207)..(207): n is a, c, g, or t
  modified_base (570)..(570): a, c, t, g, unknown or other
  misc_feature (570)..(570): n is a, c, g, or t
  modified_base (784)..(784): a, c, t, g, unknown or other
  misc_feature (784)..(784): n is a, c, g, or t
tcagacgctcgacacacgaccggtgctcgatttagtgtagtgtgaaggaaagggggaagagctgctcagttaggacccagagggaaccatggaaaccccagcgcagcttctctcctcctnctactctggctcccagactaccaccgganaaactgtcgttgacgcagtctaccaggcacccgtgtcttagtcctccgaagggtaacncgcccaccttctcttagcgacgggtcctacggtctacggtcttcggttaggaccctaagaaacgtcgtccttaccgttccgtaggtacccaaggtaccgtaaacggtaaaccccgtgggtaccccgtaacgtcccttaccccgtaaggttcccccttaccgttaccacgttaccgttaactcccggtaacttaaccgtcgttaacgacggtccggtaacggtaccgtacctaaaccgggtccgtaaccgtaccccgttacccgtaaagtacccgttaacggggtttaccaagggttacccgcggttaacggttcgggtacccgtacgggtaacgtagtaaccgttaccgtcctacgtaacccnccggtatacgacgtaccgtacgtacgtacgtcgccgtaggtaggttactgccgttaagtacgttacttaggtcgtactacgtacggtggttaccgttacggtacgacgttacggacgtacggttcgtacggttacgggccgacggtacgtaacggtcggttaacggacggtaatacccggtaacgtcggttacgtacggtacctcgtacccgtnttaaccg

SEQ ID NO: 128481 - DNA, 789 bp, Homo sapiens
  misc_feature: GYAE6OF02FOH5W.2.70.G04.1.454.CMB.1.raw
  modified_base (257)..(257): a, c, t, g, unknown or other
  misc_feature (257)..(257): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggccacctgtctttgtctccgaggggaaagagcccaccctctcttgcgacgggcctagtccagtacgtgttcggacaagaaacncgtcttcctaccgtacggtaccagtaccaacggtaaaacccgtcggacccaacgccttaccccgagggtacccttccctacgtacttccttaagtcggaccttaacctactttaccgaggtacccgacggcccgtaccccgtaacgtcgggtacctaccgtaccccgaagaccgtacggtttcgagggttccggacgtacggggtcggggttacgtacggggaactaacggtacggtttcctaccgttacctacccgaaccctacgtaccgtaacgaccgaacgtaacggtgggtaccgtccggttaggtacggttagttttcgacgttaggttacgtttacgtttacgttcgttacgtacttacggtacggttggggttaccgggttcgttaccgggtacggttcggttcggttaccgtttacgggttttccgaccggggttacgggtaaccgtacgggtcggtacggaacggtaacgttaaaccggaacgtaacggttcggtacggtaccgtacgtaccgtacttaccgg

SEQ ID NO: 128482 - DNA, 784 bp, Homo sapiens
  misc_feature: GYAE6OF02I5CD3.2.70.G04.1.454.CMB.1.raw
  modified_base (201)..(201): a, c, t, g, unknown or other
  misc_feature (201)..(201): n is a, c, g, or t
  modified_base (249)..(249): a, c, t, g, unknown or other
  misc_feature (249)..(249): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcacctgtctttgctccgaagggaaancgccaccctctcttgcgacgggccaagtcagactgtggacaagaaacngtccttctcctaggtaccagacaacgaaaccgtcggacccacgcctaccgaggcctcctacgactactactcgacctactacttcgacgaccacgccgtacccacgtacggacctaccgtaccccgaaggtaccgtacgggtacacgggttcggaacgtacggggttacgggttacggtaacggggaactaagggttacgttccgaaccgttcaccctaacctacgtaccgacgtacacggtacgtcggacgtcgtaaggtacgttcgtttacgacgttaaggttacgttaacgttacgtacgtaccgtagtacggttagggttacgggttaccggggttcctaagggtacggttccggttaacgggttaccgtttaacggggttttaccgggaacccggggttaaccggggtaacccgttaacgggtaccggggttaaaggtaaacccgtaaacgggttaaaacccgtaaaccggggtttacgtaccggggttacggttacccggtaaccggttacccgtaacccgtttaacgg

SEQ ID NO: 128483 - DNA, 671 bp, Homo sapiens
  misc_feature: GYAE6OF02FLY6U.2.70.G04.1.454.CMB.1.raw
  modified_base (321)..(321): a, c, t, g, unknown or other
  misc_feature (321)..(321): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaagagccaccctctcttgcagggccagtcagactgttggcagaacagcttctcctaggtaccagcaaggaaacctggacccacggcctacccgaggtcctacctcactctaatgaccttacntttcacgtcacgccgccacttcgggacacttccccaagactacgggttaccaggttcggactaggttcggggtcgtaggggactaggtacgtttaccaccgttcctaccacctagtccgaacgtccgtaacggaccgtacgggacgccgtacggtaacggttagttttcgaccgttagttacgttaagtttaccgtgttactaacgttcgtaacgggttggttacgggtcttaccggtacggtccgtcggtacgttacggtttcggaccggtacgggacctaagggcgttaacggacggtaacgtacgaaacgggtcgtacggttacggtctacggtacccgtacgtacg

SEQ ID NO: 128484 - DNA, 315 bp, Homo sapiens
  misc_feature: GYAE6OF02I5JKR.2.70.G04.1.454.CMB.1.raw
  modified_base (277)..(315): a, c, t, g, unknown or other
  misc_feature (277)..(315): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggcccatcggtcttccccctggcgccctgctccaggagcacctccggagtagcacgagtcgggtcccttggggccttggcccttggggtccaaagggacttacgttcctggttcgaggtcgtcctggacgccggggctggcaaggcgcatagnnnnnnnnnnnnnnnnnnnnnnnnnnnnnnnnnnnnnnn

SEQ ID NO: 128485 - DNA, 663 bp, Homo sapiens
  misc_feature: GYAE6OF02GCREX.2.70.G04.1.454.CMB.1.raw
  modified_base (202)..(202): a, c, t, g, unknown or other
  misc_feature (202)..(202): n is a, c, g, or t
  modified_base (307)..(307): a, c, t, g, unknown or other
  misc_feature (307)..(307): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgtctccaggggaaangccaccctctcttgcagggccagtcagactggttggcagaaacagcttctcctggtaccagcagaaacctggccacgcctccaggcctcctcatctatcgctacnttacagccacgccgaccacgtcggctaacctcccaagacgtacggttcgaggttcggctagggttcgggtacgtggggactaggtacgttccgacttccgtacctaccagtacacgacgacgtacgtacggacgtaccgtaggtaggttagtttcggacgttagtttacgttaacgtttacgttcgtacgtacttcgtaggttcgggttacgggttccgtacggtcgggttacggtcggttacgttacgggttttacgggaccggtacggggaaccgtaacgggtcggttaacgggtacggtaaccgttaacggaaacggttacgtgggtccgtacggtacgtaccgtaccgtacg

SEQ ID NO: 128486 - DNA, 273 bp, Homo sapiens
  misc_feature: GYAE6OF02FSJL9.2.70.G04.1.454.CMB.1.raw
  modified_base (248)..(248): a, c, t, g, unknown or other
  misc_feature (248)..(248): n is a, c, g, or t
  modified_base (251)..(273): a, c, t, g, unknown or other
  misc_feature (251)..(273): n is a, c, g, or t
tcagacgctcgacacacgaccggtgctcgatttagtgtagtgtgaagggaaaggggccggcgcgggagcgaatgagttctggggccagggaaccctggtcaccgtctccctcagcctccaccaagggcccatcggtcttccccctggcgccctgctccaggagcacctccgagagcacagcgccctgggctgcctggtcaaggactacttcctgtcgagcgtctgagcgggctggcaaggcgcatagngcnnnnnnnnnnnnnnnnnnnnnnn

SEQ ID NO: 128487 - DNA, 858 bp, Homo sapiens
  misc_feature: GYAE6OF02G21XK.2.70.G04.1.454.CMB.1.raw
  modified_base (254)..(254): a, c, t, g, unknown or other
  misc_feature (254)..(254): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtcctccgaggcaccctgtctttgctaccgagggaaagcaccaccctctctgcgacggccagtcagacttggttacgacaacgaaacncgtcttctccgtaggaccacgactaacggaacccgtgacccacgtacctccgaggtcctcctctactcgtatcgacctaccattacgagaccgacgtaccgcccgtacgtcggacctaaccgtccgaacggtaacgtacggggttaccagggtcggtacgtaccgggttcgggggttcgtacggggaaccgtaaggttaccgtttaccgaccgttaacccaccgtaaaccgtactaccgtaacggtaaccgaacgggttaacggttaccgggtacgttacccgggtaaggggttaccggtttaaccggtttttcggaacggtttacggttaacggttttaaaccgtttaaccggttgttaaccgtttaacggttaaccggttcgggttttacgggggttaacgggtttaccgttaccgggaaacgggttttcggggtccgttttaaacgggttttacgggtttaccgggggtaacccggtaacggggttaaccggtaaccgggttccggttaacgggtaacgttaaaccggtaaacccggtaaaacggttacccgggtaggttaaccggggtaccgtaaccggtaccctttaacgggttaaccg

SEQ ID NO: 128488 - DNA, 259 bp, Homo sapiens
  misc_feature: GYAE6OF02HXNVS.2.70.G04.1.454.CMB.1.raw
  modified_base (246)..(259): a, c, t, g, unknown or other
  misc_feature (246)..(259): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggcccatcggtcttccccctggcgcctcctccaagagcacctctgggggcacagcggccctgggctgcctggtcaaggactacttcctgtcgagcgtctgagcggctggcaaggcgcatagnnnnnnnnnnnnnn

SEQ ID NO: 128489 - DNA, 723 bp, Homo sapiens
  misc_feature: GYAE6OF02G03MV.2.70.G04.1.454.CMB.1.raw
  modified_base (200)..(200): a, c, t, g, unknown or other
  misc_feature (200)..(200): n is a, c, g, or t
  modified_base (245)..(245): a, c, t, g, unknown or other
  misc_feature (245)..(245): n is a, c, g, or t
  modified_base (252)..(252): a, c, t, g, unknown or other
  misc_feature (252)..(252): n is a, c, g, or t
  modified_base (304)..(304): a, c, t, g, unknown or other
  misc_feature (304)..(304): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtctttgctccgagggaangccaccctctcttgcacggccagtcagtactgtcggcaagaaacngtcttcncctggtaccagcgaacgaaacctggacccacgtcctccgaggtctacccctnacttcgtatacgcctacattccagtccgacgccgccaacgtcggacctaccgtacccgagtacggtacggttcaaggtcgggacctaggggttcgggtcgttacggggaaactagggtaaccgtttcgaacccgttcgtaccgaacccttacgtaccgaacgaccgtaacgtacgtgggaacccgtccgtaaggtacggttacgtttcggacgttacgttagttacttcgtagtacgtagttcgtaggttcgggttacgggttacctacggagttacgtccggttacggtttacgggttaccgggtaacgggaccggggtaaccgtacgggttaccggtaaggggtaacctaaacgtaaccggtaaaacccggtagttcggggttaccggaccggttaccgtaaccgttaacgttaccg

SEQ ID NO: 128490 - DNA, 735 bp, Homo sapiens
  misc_feature: GYAE6OF02HOFMB.2.70.G04.1.454.CMB.1.raw
  modified_base (315)..(315): a, c, t, g, unknown or other
  misc_feature (315)..(315): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcaccctgtcttgtctccagggaaagcgccacccttctcttgcagggccagtcagtacttgttggcaagaaacagtcttctccgtacggtaccagtacgaacgtaaaccgtcggaccaccgtcctaccgacgtccgtcccncgtactcttactgacctactatttccgagtaccacgcccgacctacgtcggacctactaccccaagtaccgtaaggttccgtaggtcggacctacgggttcgggtcggtacggggactaggtacgttccgaaccttctaccaactacgtacgacgtacgtaccggtaaccgtcgggtaaccgtccggtttaacggacgggtttacgttttcgggaaccgttaagggtttacgttaaccgttttacgtcgttaacgtacgttacggtaagggttcgggttaccgggtacgtaccggtcgttacggtcggtacgttaacgggttttacgggccggtaacgggtaccgtaacggtccgtagggaaacgtacgtaaccgtaaacgtaggtacggtaggtaccgtacggtacccgtaacgtacgg

SEQ ID NO: 128491 - DNA, 1009 bp, Homo sapiens
  misc_feature: GYAE6OF02GUGAH.2.70.G04.1.454.CMB.1.raw
tcagacgctcgacacacgaccggtgctcgatttagtgtagtgtgaagggaaagggggaagagctgctcagttaggaccccagaggggaaccatgggaaaccccacgcgcagcttctcttcctcctgctactctggctcccagataccaccggagaaactgtgttgacgcagtcctccaggctaccctcgttcgtttgtctcccgaaggggaaacgagccacccctctcttggcgacgggccgtacgtcacgtaacggttcgttgggaccgtaaacggaaaaccaacggtcctttccgttaccccgtttacggggaccctaaaggccctaaggtaaaaaccccttcggggccccaaaccgttccccgtcccccgtaaacgggtccccttacccccgttccaacttacgtttaaccgttcggtaaccctaacccggaatttccgaacggccaaaccgggtccggtaccccaaacggtgggtaccctaacttcccccgaacggaacgttaaccggggtttccgtaagggcgggtaccacggtttaggggttacccgggtcgggtaaacgtaaccggttacgtttaaacccgttcccgtaccgtttccccaaacggttactaccgtaacggaccgtaaccgtaccggtaacgggaccggtaccggtaacgggtaaacgggtttacgttttacggtaccggaacgggtttgtttaaccgtttacgttacgttaccgaaacggtttaccgttagggtaacgggttttccgggggttaacctttaccggggtaactaccggggggtttaccttacggtttaaaccggggtttttccgggaaaccggggttacccccgggggaaacggttaacccggtacgggggtttaccggtaaacccgggggttaacgtttaaaccccgggaaaaacccggggttttaaacccggtttacggggggttacccgggttaccccgggttttaaccggtacccccggttaaccccggtttaaccggg

SEQ ID NO: 128492 - DNA, 255 bp, Homo sapiens
  misc_feature: GYAE6OF02I9N95.2.70.G04.1.454.CMB.1.raw
  modified_base (247)..(255): a, c, t, g, unknown or other
  misc_feature (247)..(255): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggcccatcggtcttccccctggcgccctgctccaggagcacctccgagagcacagcgccctgggctgcctggtcaaggactacttcctgtcgagcgtctgagcgggctggcaaggcgcatagnnnnnnnnn

SEQ ID NO: 128493 - DNA, 634 bp, Homo sapiens
  misc_feature: GYAE6OF02FSK82.2.70.G04.1.454.CMB.1.raw
  modified_base (199)..(199): a, c, t, g, unknown or other
  misc_feature (199)..(199): n is a, c, g, or t
  modified_base (239)..(239): a, c, t, g, unknown or other
  misc_feature (239)..(239): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccaggcacctgtcttgtctccaggggaangccaccctctcttgcagggccagtcagactgtgcagaacngcttctcctggtaccagcaagaacctggccacgcctcccaggcctcctcactctagtcgtactacattcagcacgcgccacgtcgcactcccgagacgtacggttcaggtcggactaggtcgggtacgtcgggaactagggtactttccgactccgtaccacgtagtccaacgtcgaacgtacgtcgggacgtccgtaggtacggttactttcggacgttaggtacgtttacgttacgtcgtacgtacgtcgtaggtacgggttcgggtacctacggtacgtccggttgtacggtttacgggttcggaccggtagggaccgtaacggtcggtacggtaacgtaacgtaccgtaaacggtacgttgggtaaccggtcgtaccggtacctacgtacg

SEQ ID NO: 128494 - DNA, 850 bp, Homo sapiens
  misc_feature: GYAE6OF02HESRW.2.70.G04.1.454.CMB.1.raw
tcagacgctcgacacacgaccggtgctcgatttagtgtagtgtgaagggaaaggggaagagctggctcagttaggacccagagggaaccatcggaaaccccagcgacagcttctcttcctcctgctactctgctaccagactaccgaaccggagaaactgtgttcgacgcgacgtctccgaggcctaccctgttctttgtcctccgaagggaactagcccctacccgtcgttacgttggaccgtacggggaccacgttcaacgaacgtttggttggaccgtaacgaaaccgtacggttacccttttaccgtcccggttaggtaacccgaagtaccgtaaacgaaaccccggttggaaccccgtaacccgtccgtaccccgtacggtcccgttaccctaccgtaagttaccgtaacgtcggtaccttaaccacgtttaccgacgtccgtaccggtaccaccgtacgtggaaccctccggtaaccgacggtaccttaacggttacgtacgggtaccggtacggtacgggttaccgggttacggtaccggaaggttaaacgttccgggttaacctaccgtacgttacccgtaacgtaccgttaacgaccggtacgtaacggtacccggtgggaacccgttggtacggtaaccggtttcgttacggtaccggttaaggttgttaaccgttagttccggtaactagttaccggagtttggggtacgtcgtaggtacgtacggttcgaccggttttaacgggtaccgggtacggtaccgtaacgtacggttcggaacggtacgtaaccgtaacggtaacgtaccgtggtacccggacgtacgttacgacttaccgg

SEQ ID NO: 128495 - DNA, 606 bp, Homo sapiens
  misc_feature: GYAE6OF02II5VL.2.70.G04.1.454.CMB.1.raw
  modified_base (206)..(206): a, c, t, g, unknown or other
  misc_feature (206)..(206): n is a, c, g, or t
  modified_base (321)..(321): a, c, t, g, unknown or other
  misc_feature (321)..(321): n is a, c, g, or t
  modified_base (333)..(333): a, c, t, g, unknown or other
  misc_feature (333)..(333): n is a, c, g, or t
  modified_base (339)..(339): a, c, t, g, unknown or other
  misc_feature (339)..(339): n is a, c, g, or t
  modified_base (434)..(434): a, c, t, g, unknown or other
  misc_feature (434)..(434): n is a, c, g, or t
  modified_base (489)..(489): a, c, t, g, unknown or other
  misc_feature (489)..(489): n is a, c, g, or t
  modified_base (524)..(524): a, c, t, g, unknown or other
  misc_feature (524)..(524): n is a, c, g, or t
  modified_base (534)..(534): a, c, t, g, unknown or other
  misc_feature (534)..(534): n is a, c, g, or t
  modified_base (597)..(597): a, c, t, g, unknown or other
  misc_feature (597)..(597): n is a, c, g, or t
tcagacgctcgacacacgaccggtgctcgatttagtgtagtgtgaagggaaagggggaagagctgctcagttaggacccagagggaaccatggaaacccccagcgcagcttctcttcctcctgctactctggctcccagactaccgaccggagaaactgtgttgacgcagtctccgaggcaccctgtctttgtctccgaggggaancgccaccctctctgcgagggcctagtcgagtacgtggttgacaagaacagtcttctcgtgtaccagtcacggaacctcggacctacgacctccgaggccttcctacacttctaancggtactaactnttaccnggcaccgccgtaccagtacggacctacctccgaacgtagtacggttcgaggttgaccgagggtcggtagtacggactgtaacgttccactccacnccgatcgtacgacacgtgtcggcgtcgtaggtagttacgttcgacgttacggttntacgttagttcgtactagtacgtgtagggtcggtntacgagtcgngtacggttgttaccgacggtacgacgtagtcgtagacgtaacgacgtaagcgttgctaccggncccgtatcg

SEQ ID NO: 128496 - DNA, 266 bp, Homo sapiens
  misc_feature: GYAE6OF02FNIS3.2.70.G04.1.454.CMB.1.raw
  modified_base (247)..(266): a, c, t, g, unknown or other
  misc_feature (247)..(266): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggcccatcggtcttccccctggcgccctgctccaggagcacctccgagagcacagcggcctgggctgcctggtcaaggactacttcctgtcgagcgtctgagcgggctggcaaggcgcatagnnnnnnnnnnnnnnnnnnnn

SEQ ID NO: 128497 - DNA, 723 bp, Homo sapiens
  misc_feature: GYAE6OF02GXCZA.2.70.G04.1.454.CMB.1.raw
  modified_base (207)..(207): a, c, t, g, unknown or other
  misc_feature (207)..(207): n is a, c, g, or t
  modified_base (599)..(599): a, c, t, g, unknown or other
  misc_feature (599)..(599): n is a, c, g, or t
  modified_base (710)..(710): a, c, t, g, unknown or other
  misc_feature (710)..(710): n is a, c, g, or t
tcagacgctcgacacacgaccggtgctcgatttagtgtagtgtgaagggaaagggggaagagctgctcagttaggacccagagggaaccatggaaacccagcgcagcttctcttcctcctgctactctggctccagataccaccggagaaactgtgttgacgctagtctccgaggcctaccttgtctttgtcctaccgaaggggaanacgcctaccctcgtcttcgcgacgggacctacgtcgagtacgttcggttggacaaacgaaacgcgtccttacgtccgttacggtaccacgacgaacgaaccgtcggacccaacgtccctacccgacggtccctccgtacacttactacgtcgtaaccttactacgttaccaagcgaccgcctcgaccgtcggacctaccgacccgagacgttacggtacgtaggtcgacggtggtccggttacggacggacgtaacggtacttccgtaccgttaccgcctaataccgtacaacggtactaacggtacggtacggtccgtaccggtaggtacggttacgtttcggtaacgttcggtttaacgtttaacgtcggtttaactcgttaacttgggngggtttaccgggtacggtacgtcggttacgtcgtttacgggtacgttcgggttacgtacgggacggtacgtacggtgacgttaacgaacgtaacgacgtgtcgtcgtaacncgtacgtacgtcg

SEQ ID NO: 128498 - DNA, 779 bp, Homo sapiens
  misc_feature: GYAE6OF02I784A.2.70.G04.1.454.CMB.1.raw
  modified_base (248)..(248): a, c, t, g, unknown or other
  misc_feature (248)..(248): n is a, c, g, or t
tcagacgctcgacacacgaccggtgctcgatttagtgtagtgtgaagggaaagggggaagagctgctcagttaggacccagagggaaccatggaaaccccagcgcagcttctcttcctctgctactctgctccagatacaccgagaaactgtgttgacgcagtctccaggcctaccctgtctttgtcctccgaaggggaaagacgccacctctcttgcgacggcagtcagacttgttcgacagaaacncgtcttcgtccgtcgtaccgagcgaacgaaccgtcggccacgtcctacccgaggtccctccctacgtactctagtcgtacctactacgttacgagtcgtacgcccgtaccacgttcggacctaaccgtacccaacggtccttacggtaccgtaggtcgggccgttacggggttcgggtacggtacgggtaacctacggtttaacggtttcccgtaccgttacctaccgtaacccgtagtaccgtacgtaaccgtacgtaccgggtacgggtaccggtaccgggtacgttacgggtttacggtttcgtaacggtttacgttacgttttaacggttacgttacggtaccgttacgttacgggttcgggttagggtttccgggtaccgttcgggttacggtcgggttcggttacggtttacggggtttacccggtaacggggttaccggaacggttacggtaacgggtacggtaacggtaacgtacgtaaacggtcgttacgggtacggttacgtaccgtaccgtacgttaccg

SEQ ID NO: 128499 - DNA, 294 bp, Homo sapiens
  misc_feature: GYAE6OF02I9VCW.2.70.G04.1.454.CMB.1.raw
  modified_base (162)..(162): a, c, t, g, unknown or other
  misc_feature (162)..(162): n is a, c, g, or t
  modified_base (246)..(246): a, c, t, g, unknown or other
  misc_feature (246)..(246): n is a, c, g, or t
  modified_base (252)..(253): a, c, t, g, unknown or other
  misc_feature (252)..(253): n is a, c, g, or t
  modified_base (255)..(294): a, c, t, g, unknown or other
  misc_feature (255)..(294): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggcccatcggtcttccccctggcgccctgctccaggancacctccgagagcacgagcggccctgggctgcctggtcaaggactacgttcctgtcgacgcgtctgagcgggctggcaagggcncatagnngnnnnnnnnnnnnnnnnnnnnnnnnnnnnnnnnnnnnnnnn

SEQ ID NO: 128500 - DNA, 789 bp, Homo sapiens
  misc_feature: GYAE6OF02IEBKF.2.70.G04.1.454.CMB.1.raw
  modified_base (172)..(172): a, c, t, g, unknown or other
  misc_feature (172)..(172): n is a, c, g, or t
  modified_base (229)..(229): a, c, t, g, unknown or other
  misc_feature (229)..(229): n is a, c, g, or t
  modified_base (313)..(313): a, c, t, g, unknown or other
  misc_feature (313)..(313): n is a, c, g, or t
  modified_base (345)..(345): a, c, t, g, unknown or other
  misc_feature (345)..(345): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgcctactctggcctccagactaccaccggagaaactgtgtagacgcagtcnccgagccaccctgtcttgtcctacgaaggggaacacgccacccgttctcgtgaccgngggccagcagacgtggttcgagaagtaaccgacgtcttacctcgttacggaacctacgacgaaaccggtaaaccgcggtaaccncgaccctaccgacggtcctacctcgatactancgtacctaacgtactacacggccacgtccaccgtaacgtcgacctaaccgtacaacggtaacgtacggtaacctcgggtcgtaccggtggtcggtaccggtacggacgtacgttaacgtactaccggtttacaaccctacgacgtacgaacggtaccgtaaggacggtaccgggtacgttaccggtaggttaacggttacgttttacggacggtttaactttaaccgggtttagttaacgttccggtaaactacggttaacggggtttaggtttaccggggttcggttaaacccgcggttaacgggttccgtttcggtaacggttaccgggtttaccgggaccggtaaccggggtacgtaacggtcgggtaaacgttacggaacctaaacgggtaacgttcggaccggttaacgggacccttaacggaccccttaagttaccgg

SEQ ID NO: 128501 - DNA, 736 bp, Homo sapiens
  misc_feature: GYAE6OF02GBRR3.2.70.G04.1.454.CMB.1.raw
  modified_base (191)..(191): a, c, t, g, unknown or other
  misc_feature (191)..(191): n is a, c, g, or t
  modified_base (203)..(203): a, c, t, g, unknown or other
  misc_feature (203)..(203): n is a, c, g, or t
  modified_base (211)..(211): a, c, t, g, unknown or other
  misc_feature (211)..(211): n is a, c, g, or t
  modified_base (251)..(251): a, c, t, g, unknown or other
  misc_feature (251)..(251): n is a, c, g, or t
  modified_base (588)..(588): a, c, t, g, unknown or other
  misc_feature (588)..(588): n is a, c, g, or t
  modified_base (597)..(597): a, c, t, g, unknown or other
  misc_feature (597)..(597): n is a, c, g, or t
tcagacgctcgacacacgaccggtgctcgatttagtgtagtgtgaagggaaagggggaagagctgctcagttaggacccagagggaaccatggaaaccccagcgcagcttctcttcctcctgctactcgtggctcccagacgtaccaccggagaaacttgtagttcgacgcagtcctcagcacctgtcttnctccaggggaangccacctntcttcgactaggccagtcgacgtacgtgttggacagaacngtcttcgacctggacacgcagaaccgtgaccgtacgccgtccgaggtcccttctcgtacttacgtcgtactaccgtacctacgttccaaacggtccaaccggtaccgtaccgtaaccgtccgggtacctaacgtcccgtaacgtacggttaccggggttaccttaagggcggtttaacccggacggtttcgggggtaacccggtggggtaaacctagggtttaacccggtaccctaccggtttaccgttacccaacgacgtaccgacgtacgaacggtacgtacggacgtcgtacgggtaacgttgttaccgaggttacgtagtttcctagtccgtntaaccggtnttaagggtcggttcggttacacgttcgtcgtcgtacggttaccggttaggaccggttacgggacctaggaccggttaggaaccgttacgtaaccgtacggtaccgtacgggttaagtaccttacgccggttactaccgg

SEQ ID NO: 128502 - DNA, 254 bp, Homo sapiens
  misc_feature: GYAE6OF02IQDSA.2.70.G04.1.454.CMB.1.raw
  modified_base (240)..(240): a, c, t, g, unknown or other
  misc_feature (240)..(240): n is a, c, g, or t
  modified_base (246)..(254): a, c, t, g, unknown or other
  misc_feature (246)..(254): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggcccatcggtcttccccctggccgccctgctccaggagcacctccgagacgcacagcggcctggctgcctggcaaggctacttcctgtcgagcgtctgagcgggctggcaaggcncatagnnnnnnnnn

SEQ ID NO: 128503 - DNA, 299 bp, Homo sapiens
  misc_feature: GYAE6OF02G7LMF.2.70.G04.1.454.CMB.1.raw
  modified_base (150)..(150): a, c, t, g, unknown or other
  misc_feature (150)..(150): n is a, c, g, or t
  modified_base (254)..(259): a, c, t, g, unknown or other
  misc_feature (254)..(259): n is a, c, g, or t
  modified_base (261)..(299): a, c, t, g, unknown or other
  misc_feature (261)..(299): n is a, c, g, or t
tcagacgctcgacacacgaccggtgctcgattttagtgtagtgtgaagggaaagggggccggcgcgggagcgaatgagttctgggccagggaaccctggtcaccgtctcctcagcctccaccaagggcccatcggtccttccccctggcnccctgctccaggagcacctccgagagcacagccggccctgggctgcctggtcaaggactacttcctgcgagcgtctggagcgggcctgggccaaggcgcatagnnnnnncnnnnnnnnnnnnnnnnnnnnnnnnnnnnnnnnnnnnnnn

SEQ ID NO: 128504 - DNA, 281 bp, Homo sapiens
  misc_feature: GYAE6OF02FTD2X.2.70.G04.1.454.CMB.1.raw
  modified_base (243)..(243): a, c, t, g, unknown or other
  misc_feature (243)..(243): n is a, c, g, or t
  modified_base (250)..(281): a, c, t, g, unknown or other
  misc_feature (250)..(281): n is a, c, g, or t
tcagacgctcgacacacgaccggtgctcgatttagtgtagtgtgaagggaaaggggccggcgcgggagcgaatgagttctggggccagggaaccctggtcaccgtctccctcagcctccaccaagggcccatcggtcttcccccctggcgccctgctccaggagcacctccgagagcacagcggccctgggctgcctggtcaaggactactcctgtcgagcgtctgaggcggctggcaaggcncgatagnnnnnnnnnnnnnnnnnnnnnnnnnnnnnnnn

SEQ ID NO: 128505 - DNA, 769 bp, Homo sapiens
  misc_feature: GYAE6OF02GXT65.2.70.G04.1.454.CMB.1.raw
  modified_base (208)..(208): a, c, t, g, unknown or other
  misc_feature (208)..(208): n is a, c, g, or t
  modified_base (258)..(258): a, c, t, g, unknown or other
  misc_feature (258)..(258): n is a, c, g, or t
tcagacgctcgacacacgaccggtgctcgatttagtgtagtgtgaagggaaaggggggaagagctgctcagttagggacccagaggggaaccatggaaaccccagcgcagcttctcttcctcctgctactctggctcccagataccaccggagaaactgtgttgacgcagtctccaggccaccctgttctttgtcctcgaaggggaangccaccctctcttgcgacggccagtcgagtactgttggacgaagtaaacncggtccttctccgtggtaccaggaccaacgtaaaccgtcggacccaccgtccctcccgacggtccctcccgtaccacgttacctaagttcgtaccttaactacgttcccgaagaccgtaccgaccggccgtaacgtcgggacctaccgtacccgaacggtaaccgttacgggttacgacgggtcggtaccgtgggtacggggttcggtacgggactaacggtacgtttaccgacgttacctaccgtacctacgctaacggcgtaacggtacgtccgggtaacgtccggtaggtaacggtttcttacgggtaccttaaggttaccttacgttccgtagttcgttaacgttacggacgggtttccgggttacggttccgtacgggtaaggtttcgtccggtttaggttaccgggttccgggaccgggttacgacggttaacggtggtaagggtaacctaaacggtaaccggtaacgttaggtcggttaccgaccggtactaccgtaattccgg

SEQ ID NO: 128506 - DNA, 1080 bp, Homo sapiens
  misc_feature: GYAE6OF02GVZZN.2.70.G04.1.454.CMB.1.raw
tcagacgctcgacacacgaccggtgctcgatttagtgtagtgtgaagggaaagggggaagagctgctcagttaggacccagagggaaccatggaaaccccagcgcagcttctcttcctcctgctactctggctcccagataccaccggagaaactgtgttgacgcagtctccgaggccaccctgtctttgtcctccgaaggggaaagagacccaccctctccgtgccgacggggccctagtcgaaggacgttgttacggcagacctaaacgtttacgcccgttaggtaccgacgtacaacggaaaccctgggaccgaacgggaccctccccgacggtaccttccctacctaagttccttagtacgggttgtacctaacgtacccgaaaccggcgggaccctacggttacggtacctaccccgtaaccggtaccgtaacgggtttaccgacgggttaccgggtaccgttacgggggttaccggggttacggttacgggggaaacgttttaaccgggtaacggttttaccctaaacccggtttacccttaaccccggtaaacccttaacggttacccgaaacgtacccggtaacccggggttaccccgttaacgggtaacccgtttccggggttaaacgtttaaacggggttaaaccgggtttttaacgtttttaccgggtaaacggtttttaaaaccggtttttttaaccgttttaaccggttaccggtttacgtaaaacgggtaacccttttaaaacggggttttaaaactttaaaaacccgtttaaccgggggttacccggttacccccggggttttacccggggggtaccggggttttaaaccccgggtttaccccgggggaaaccgggttaaaaaccccgggggttaacggtaaaccgggggtttaaaaggtaaacccgttaaaaaacccgggtaaacccgggttacccggtttaacgggggtaacccgggttaacggtaacccccgggttaacctttaacccggtaacccgttttcggtttaaccccggttttacccgtttaacgttttaaccccgttccccctttaacccccggg

SEQ ID NO: 128507 - DNA, 271 bp, Homo sapiens
  misc_feature: GYAE6OF02HE08R.2.70.G04.1.454.CMB.1.raw
  modified_base (223)..(223): a, c, t, g, unknown or other
  misc_feature (223)..(223): n is a, c, g, or t
  modified_base (226)..(226): a, c, t, g, unknown or other
  misc_feature (226)..(226): n is a, c, g, or t
  modified_base (249)..(271): a, c, t, g, unknown or other
  misc_feature (249)..(271): n is a, c, g, or t
tcagacgctcgacacacgaccggtgctcgatttagtgtagtgtgaagggaaaggggccggcgcgggagcgaatgagttctggggccagggaaccctggtcaccgtctcctcagcctccaccaagggcccatcggtcttccccctggcgccctgctccaggagcacctccgagagcacagcggccctgggctgcctggtcaaggactacttcctgtcgagcgtntgngccgggctggcaggcgcagtagnnnnnnnnnnnnnnnnnnnnnnn

SEQ ID NO: 128508 - DNA, 437 bp, Homo sapiens
  misc_feature: GYAE6OF01EC7WL.37.31.C09.1.454.CMB.1.raw
  modified_base (433)..(437): a, c, t, g, unknown or other
  misc_feature (433)..(437): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttcccctggcgccctgctccaggagcacctccgagagcacagcggccctgggctgcctggtcaaggctacttccatctacactactgagcgggctggcaaggcgcatagnnnnn

SEQ ID NO: 128509 - DNA, 441 bp, Homo sapiens
  misc_feature: GYAE6OF01EV5QB.37.31.C09.1.454.CMB.1.raw
  modified_base (434)..(441): a, c, t, g, unknown or other
  misc_feature (434)..(441): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctctcagcctccaccaagggcccatcggtcttccccctggcgccctgctccaggacgcacctccgagagcacagcggccctgggctgcctggtcaaggactactccatctacactactgagcgggctggcaaggcgcatagnnnnnnnn

SEQ ID NO: 128510 - DNA, 441 bp, Homo sapiens
  misc_feature: GYAE6OF01B1TA8.37.31.C09.1.454.CMB.1.raw
  modified_base (348)..(348): a, c, t, g, unknown or other
  misc_feature (348)..(348): n is a, c, g, or t
  modified_base (433)..(441): a, c, t, g, unknown or other
  misc_feature (433)..(441): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttcccctggcgccctgctccaggancacctccgagagcacagcggccctgggctgcctggtcaaggctacttccatctacactactgagcgggctggcaaggcgcatagnnnnnnnnn

SEQ ID NO: 128511 - DNA, 440 bp, Homo sapiens
  misc_feature: GYAE6OF01DRJBN.37.31.C09.1.454.CMB.1.raw
  modified_base (435)..(440): a, c, t, g, unknown or other
  misc_feature (435)..(440): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttcccctggcgccctgctccaggacgcacctccgagagcacagcggccctgggatgcctggtcaaggctacttccatctacactactgagcgggctgggcaaggcgcatagnnnnnn

SEQ ID NO: 128512 - DNA, 439 bp, Homo sapiens
  misc_feature: GYAE6OF01B39KI.37.31.C09.1.454.CMB.1.raw
  modified_base (433)..(439): a, c, t, g, unknown or other
  misc_feature (433)..(439): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttcccctggcgccctgctccaggagcacctccgagagcacagcggccctgggctgcctggtcaaggctacttccatctacactactgagcgggctggcaaggcgcatagnnnnnnn

SEQ ID NO: 128513 - DNA, 408 bp, Homo sapiens
  misc_feature: GYAE6OF01CX5TE.37.31.C09.1.454.CMB.1.raw
  modified_base (404)..(408): a, c, t, g, unknown or other
  misc_feature (404)..(408): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccgattcaccatctccagagacaactccaagaactcagtgtatctacacatgaacaaccttagagtcgaggacacggctgttattactgtagaaaaggccactatggagtctggggccgagggaccacggtcaccgtctcctcagcctccaccaagggcccatcggtcttccccctggcgccctgctccaggagcacctccgagagcacagcggccctgggctgcctggtcaaggactacttccatctacactactgagcgggctggcaaggcgcatagnnnnn

SEQ ID NO: 128514 - DNA, 442 bp, Homo sapiens
  misc_feature: GYAE6OF01DVLR5.37.31.C09.1.454.CMB.1.raw
  modified_base (334)..(334): a, c, t, g, unknown or other
  misc_feature (334)..(334): n is a, c, g, or t
  modified_base (435)..(442): a, c, t, g, unknown or other
  misc_feature (435)..(442): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttcccctggcnccctgctccaggacgcacctccgagacgcacagccggcctgggctgcctggtcaaggctacttccatctacactactgagcgggctggcaaggcgcatagnnnnnnnn

SEQ ID NO: 128515 - DNA, 442 bp, Homo sapiens
  misc_feature: GYAE6OF01CN96K.37.31.C09.1.454.CMB.1.raw
  modified_base (438)..(442): a, c, t, g, unknown or other
  misc_feature (438)..(442): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggccccatccggtcttccccctggccgcccctgctccaggagcacctccgagagcacagcggccctgggctgcctggtcaaggactactccatctacactactgagcgggctggcaaggcgcatagnnnnn

SEQ ID NO: 128516 - DNA, 456 bp, Homo sapiens
  misc_feature: GYAE6OF01BTU5G.37.31.C09.1.454.CMB.1.raw
  modified_base (447)..(456): a, c, t, g, unknown or other
  misc_feature (447)..(456): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggacctacggatatgactactattgggactggtacttcgatctctgggccgtggcaccctggtcactgtctcctcacgcctccaccaagggccccatcggtcttcccctggccgccctgctccaggagccacctccgagacgcacgacgcggtccctggggctcgcctggtacaaggacttacttccatcctacactactgagcgggctggcaaggcgcatagnnnnnnnnnn

SEQ ID NO: 128517 - DNA, 442 bp, Homo sapiens
  misc_feature: GYAE6OF01ENLE9.37.31.C09.1.454.CMB.1.raw
  modified_base (435)..(442): a, c, t, g, unknown or other
  misc_feature (435)..(442): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtctcccctggcgccctgctccaggacgcacctccgagagcacagccggccctgggctgcctggtcaaggactacttccatctacactactgagcgggctggcaaggcgcatagnnnnnnnn

SEQ ID NO: 128518 - DNA, 439 bp, Homo sapiens
  misc_feature: GYAE6OF01AQQVJ.37.31.C09.1.454.CMB.1.raw
  modified_base (434)..(439): a, c, t, g, unknown or other
  misc_feature (434)..(439): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttccccctggcgccctgctccaggagcacctccgagagcacagcggcctgggctgcctggtcaaggactacttccatctacactactgagcggctgggcaaggcgcatagnnnnnn

SEQ ID NO: 128519 - DNA, 440 bp, Homo sapiens
  misc_feature: GYAE6OF01A9OA5.37.31.C09.1.454.CMB.1.raw
  modified_base (332)..(332): a, c, t, g, unknown or other
  misc_feature (332)..(332): n is a, c, g, or t
  modified_base (432)..(440): a, c, t, g, unknown or other
  misc_feature (432)..(440): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctgggccgtggcacctggtcactgtctcctcagcctccaccaagggcccatcggtcttcccctggcnccctgctccaggagcacctccgagagcacagcggccctgggctgcctggtcaaggactacttccatctacactactgagcgggctggcaaggcgcatagnnnnnnnnn

SEQ ID NO: 128520 - DNA, 443 bp, Homo sapiens
  misc_feature: GYAE6OF01A4GD8.37.31.C09.1.454.CMB.1.raw
  modified_base (428)..(428): a, c, t, g, unknown or other
  misc_feature (428)..(428): n is a, c, g, or t
  modified_base (434)..(443): a, c, t, g, unknown or other
  misc_feature (434)..(443): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttccccctggcgccctgctccaggagcacctccgagagcacagcgccctgggctgcctggtcaaggctacttccatctacactactgagcgggctgggcaaggcncatagnnnnnnnnnn

SEQ ID NO: 128521 - DNA, 442 bp, Homo sapiens
  misc_feature: GYAE6OF01DE7U3.37.31.C09.1.454.CMB.1.raw
  modified_base (335)..(335): a, c, t, g, unknown or other
  misc_feature (335)..(335): n is a, c, g, or t
  modified_base (435)..(442): a, c, t, g, unknown or other
  misc_feature (435)..(442): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtaacgaaaatggcctacggatatgactactattgggactggtacttcgatctctggggccgtggcaccctggtcactgtctcctcagcctccaccaagggcccatcggtcttcccctggcnccctgctccaggacgcacctccgagacgcacagcggccctggggctgcctggtcaaggactacttcatctaactctgagcgggctggcaaggcgcatagnnnnnnnn

SEQ ID NO: 128522 - DNA, 439 bp, Homo sapiens
  misc_feature: GYAE6OF01D3RAG.37.31.C09.1.454.CMB.1.raw
  modified_base (438)..(439): a, c, t, g, unknown or other
  misc_feature (438)..(439): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaagaacaccctgtctctgcaaatgaacaacctgggagccgaggacacggccctatattactgtacgaaaataggctacggatatgactactattgggactggtacttcgatctctggggccggtggcaccctcggtcactgtctcctcagcctccaccaagggcccactcggtcttcccctcggcgccctgctccaggagcacctccgagagcacagcggccctgggctgcctggtcaaggactacttccatctacactactgagcgggctggcaaggcgcatagnn

SEQ ID NO: 128523 - DNA, 442 bp, Homo sapiens
  misc_feature: GYAE6OF01BACHG.37.31.C09.1.454.CMB.1.raw
  modified_base (432)..(442): a, c, t, g, unknown or other
  misc_feature (432)..(442): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttcccctggcgccctgctccaggagcacctccgagagcacagcggcctgggctgcctggtcaggactacttccatctacactactgagcgggctggcaaggcgcatagnnnnnnnnnnn

SEQ ID NO: 128524 - DNA, 442 bp, Homo sapiens
  misc_feature: GYAE6OF01DUK7D.37.31.C09.1.454.CMB.1.raw
  modified_base (361)..(361): a, c, t, g, unknown or other
  misc_feature (361)..(361): n is a, c, g, or t
  modified_base (436)..(442): a, c, t, g, unknown or other
  misc_feature (436)..(442): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaaatggcctacggatatgactactattgggactggtacttcgatctctggggccgtggcaccctggtcactgtctcctcagcctccaccaagggcccatccggtcttccccctggccgccctgctccaggagcacctcganagcacagcggccctgggctgcctggtcaaggctacttccatctacactactgagcgggctggcaaggcgcatagnnnnnnn

SEQ ID NO: 128525 - DNA, 438 bp, Homo sapiens
  misc_feature: GYAE6OF01B8IUP.37.31.C09.1.454.CMB.1.raw
  modified_base (351)..(351): a, c, t, g, unknown or other
  misc_feature (351)..(351): n is a, c, g, or t
  modified_base (434)..(438): a, c, t, g, unknown or other
  misc_feature (434)..(438): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaagaacaccctgtctctgcaaaatgaacaacctgagagccgaggacacggccctatattactgtacgaaaatggcctaggatatgactactattgggactggtacttcgatctcgtggggccgtggcaccctggtcactgtctcctcacgcctccaccaaggcccatcggtccttcccctggccgccctgcctccaggngcacctccgagagcacacgcgcctgggctgctggcaaggactacttccatctacactactgagcgggctgcaaggcgcatagnnnnn

SEQ ID NO: 128526 - DNA, 452 bp, Homo sapiens
  misc_feature: GYAE6OF01A66CS.37.31.C09.1.454.CMB.1.raw
  modified_base (441)..(452): a, c, t, g, unknown or other
  misc_feature (441)..(452): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatccggtcttccccctggccgccctgctccaggagccacctccgagagcacacgcggccctgggctgcctggtcaagggactacttccatctacactactgagcgggctgggcaaggcgcatagnnnnnnnnnnnn

SEQ ID NO: 128527 - DNA, 457 bp, Homo sapiens
  misc_feature: GYAE6OF01EBZ13.37.31.C09.1.454.CMB.1.raw
  modified_base (443)..(457): a, c, t, g, unknown or other
  misc_feature (443)..(457): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatccggtccttcccctggccgccctgcctccgaggacgccacctccgagacgcacagccggccctgggctgcctggtcaaggactacttccatctacactactgagcgggctggcaaggcgcatagnnnnnnnnnnnnnnn

SEQ ID NO: 128528 - DNA, 521 bp, Homo sapiens
  misc_feature: GYAE6OF01DFZGK.37.31.C09.1.454.CMB.1.raw
  modified_base (353)..(353): a, c, t, g, unknown or other
  misc_feature (353)..(353): n is a, c, g, or t
  modified_base (412)..(412): a, c, t, g, unknown or other
  misc_feature (412)..(412): n is a, c, g, or t
  modified_base (493)..(521): a, c, t, g, unknown or other
  misc_feature (493)..(521): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaaagaacaccctgtctctgcaaaatgaacaacctgagagccgaggacaccggccctatattactgtaacgaaaatggacctaacggatatgactactattgggactggtacttcgatcgtgtggggccgtggccaccgtggtcactgtcctcctcacgccctccaacccgaacgggccccagtcccggttccttcccccgnggccgccctgcctccgaggacgccacccgtccgagacgcacgacggccggccgtgggcncggcctggacaacggtactacctcctatcctacacctactgacggtcgggtctacgggacgaacggtccactagtaagcgnnnnnnnnnnnnnnnnnnnnnnnnnnnnn

SEQ ID NO: 128529 - DNA, 459 bp, Homo sapiens
  misc_feature: GYAE6OF01AKY74.37.31.C09.1.454.CMB.1.raw
  modified_base (448)..(459): a, c, t, g, unknown or other
  misc_feature (448)..(459): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaaagaacaccctgtctctgcaaatgaacaacctgagagccgaggacacggccctatattactgtacgaaaatggcctacggatatgactactattgggactggtacttcgatctctggggccgtggcaccctggtcactgtctcctcagccctccaccaagggcccatccggtccttccccctggccgccctgcctccaggagccacctccgagagccacacgccggccctggggcctgcctggtccaaggacctacttccatctacactactgagcggctggcaaggcgcatagnnnnnnnnnnnn

SEQ ID NO: 128530 - DNA, 448 bp, Homo sapiens
  misc_feature: GYAE6OF01CQ12L.37.31.C09.1.454.CMB.1.raw
  modified_base (212)..(212): a, c, t, g, unknown or other
  misc_feature (212)..(212): n is a, c, g, or t
  modified_base (439)..(448): a, c, t, g, unknown or other
  misc_feature (439)..(448): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggcctatattacngtacgaaaatggcctaggatatgactactattggactggtacttcgatctctggggcctggcaccctggtcactgtctctcagcctccaccaagggcccatccggtcttcccctggccgccctgctccaggacgccactccgagagcacagccggcctgggctgacctggtacaggctacttccatctacactactgagccgggacgtggcgaacggcgacactagnnnnnnnnnn

SEQ ID NO: 128531 - DNA, 500 bp, Homo sapiens
  misc_feature: GYAE6OF01DAHK3.37.31.C09.1.454.CMB.1.raw
  modified_base (483)..(500): a, c, t, g, unknown or other
  misc_feature (483)..(500): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtaacgaaaatggcctacggatatgactactattgggactggtacttcgatctctggggccgtggccaccctggtcactgtctcctcagcctccaccaagggcccagtccggtccttccccctggccgcccctgcctccacggacgccacctccgagacgcacgacggccggcccgtggggcctcggccgtggtaccgaacgggtactacctttcccattaccgtaactacctacgtggaacggcgggctgggacaaggcgacagtacgnnnnnnnnnnnnnnnnnn

SEQ ID NO: 128532 - DNA, 561 bp, Homo sapiens
  misc_feature: GYAE6OF01BFDOQ.37.31.C09.1.454.CMB.1.raw
  modified_base (359)..(359): a, c, t, g, unknown or other
  misc_feature (359)..(359): n is a, c, g, or t
  modified_base (524)..(524): a, c, t, g, unknown or other
  misc_feature (524)..(524): n is a, c, g, or t
  modified_base (529)..(529): a, c, t, g, unknown or other
  misc_feature (529)..(529): n is a, c, g, or t
  modified_base (531)..(532): a, c, t, g, unknown or other
  misc_feature (531)..(532): n is a, c, g, or t
  modified_base (534)..(537): a, c, t, g, unknown or other
  misc_feature (534)..(537): n is a, c, g, or t
  modified_base (539)..(546): a, c, t, g, unknown or other
  misc_feature (539)..(546): n is a, c, g, or t
  modified_base (548)..(561): a, c, t, g, unknown or other
  misc_feature (548)..(561): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtaacgaaaatggcctacggatatgactactattgggactggtacttcgatctcgtggggcctggcaccctggtcactgtctcctcacgcctccaccgaagggccccagtccggtccttccccgtggccgccctgcctccgaggcncctaaccgtccggaagacgccacacggccgcccgttggggccttacggcccgttgggtaccaaagggtaccttaacctttcccgaatttcccgttaacgaacctttacgcgggtaacggccggggtacttagggacccgaaagggtccgtaccgaagttaacggntcagngnngnnnngnnnnnnnngnnnnnnnnnnnnnn

SEQ ID NO: 128533 - DNA, 510 bp, Homo sapiens
  misc_feature: GYAE6OF01ENJ52.37.31.C09.1.454.CMB.1.raw
  modified_base (367)..(367): a, c, t, g, unknown or other
  misc_feature (367)..(367): n is a, c, g, or t
  modified_base (462)..(462): a, c, t, g, unknown or other
  misc_feature (462)..(462): n is a, c, g, or t
  modified_base (494)..(510): a, c, t, g, unknown or other
  misc_feature (494)..(510): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtaacgaaaatggcctacggatatgactactattgggactggtacttcgatctcgtggggccgtggcaccctggtcactgtctcctcagcctccaaccaaggggccccagtccggtccttcccccgtggccgtcccctgcctccgacgggtacnccacccgtccgagacgccgacgacggccggcccgttggggccttcgccgttgggtaccaagggtaccttacttcccacttcctaaccacttacgngacggcgggcctagggccaagggccgcagtgnnnnnnnnnnnnnnnnn

SEQ ID NO: 128534 - DNA, 476 bp, Homo sapiens
  misc_feature: GYAE6OF01EDEA1.37.31.C09.1.454.CMB.1.raw
  modified_base (340)..(340): a, c, t, g, unknown or other
  misc_feature (340)..(340): n is a, c, g, or t
  modified_base (470)..(476): a, c, t, g, unknown or other
  misc_feature (470)..(476): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctcgtggggccgtggcaccctggtcactgtctcctcagcctccaccgaagggcccatccggtcttcccccgtggccnccctgctccaggacgccacctccgagagccacacggccggcccgtggggcctggcccgtgggtccaaacgggtaccttaccgttcccattcctacacctactgacggccgggctgggacaaggcgcatgnnnnnnn

SEQ ID NO: 128535 - DNA, 461 bp, Homo sapiens
  misc_feature: GYAE6OF01CDLCN.37.31.C09.1.454.CMB.1.raw
  modified_base (439)..(439): a, c, t, g, unknown or other
  misc_feature (439)..(439): n is a, c, g, or t
  modified_base (446)..(461): a, c, t, g, unknown or other
  misc_feature (446)..(461): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaaggccccatcggtcttcccctggccgcccctgctccaggacgccacctccgagacgcacacgcggccctggggctcgcctggtcaaggctacttccatcctacactactgacgcgggctgggcaaggccncagtagnnnnnnnnnnnnnnnn

SEQ ID NO: 128536 - DNA, 496 bp, Homo sapiens
  misc_feature: GYAE6OF01AQS50.37.31.C09.1.454.CMB.1.raw
  modified_base (373)..(373): a, c, t, g, unknown or other
  misc_feature (373)..(373): n is a, c, g, or t
  modified_base (393)..(393): a, c, t, g, unknown or other
  misc_feature (393)..(393): n is a, c, g, or t
  modified_base (474)..(474): a, c, t, g, unknown or other
  misc_feature (474)..(474): n is a, c, g, or t
  modified_base (477)..(477): a, c, t, g, unknown or other
  misc_feature (477)..(477): n is a, c, g, or t
  modified_base (480)..(496): a, c, t, g, unknown or other
  misc_feature (480)..(496): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcggatctcgtggggccgtggcaccctggtcactgtctcctcacgccctccaccaacgggcccctagtccggtccttccccccgtgggccgtcccctcgccttacccgagggacnccacccgtccggagagccanacggcggcccgtggggctcgccgtggtacgaacggtcctaacttccgattcctacacctactggagtcggctggccaggcncancgnnnnnnnnnnnnnnnnn

SEQ ID NO: 128537 - DNA, 464 bp, Homo sapiens
  misc_feature: GYAE6OF01B3TXS.37.31.C09.1.454.CMB.1.raw
  modified_base (353)..(353): a, c, t, g, unknown or other
  misc_feature (353)..(353): n is a, c, g, or t
  modified_base (363)..(363): a, c, t, g, unknown or other
  misc_feature (363)..(363): n is a, c, g, or t
  modified_base (445)..(464): a, c, t, g, unknown or other
  misc_feature (445)..(464): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggccccatcggtccttccccctggccgccctgcctccaggancacctccganagcacagccggcctggggctcgccgtggtcaaggtctacttccatcacactactgaggcgggctgggcaacgggcgcatagnnnnnnnnnnnnnnnnnnnn

SEQ ID NO: 128538 - DNA, 435 bp, Homo sapiens
  misc_feature: GYAE6OF01A5RHL.37.31.C09.1.454.CMB.1.raw
  modified_base (417)..(417): a, c, t, g, unknown or other
  misc_feature (417)..(417): n is a, c, g, or t
  modified_base (425)..(425): a, c, t, g, unknown or other
  misc_feature (425)..(425): n is a, c, g, or t
  modified_base (430)..(435): a, c, t, g, unknown or other
  misc_feature (430)..(435): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctcgtggggccgtggcaccctggtcactgtctcctcagcctccaccaagggcccatccggtcttcccccgtggccgccctgctccaggcgcacctcgagcgcacagccggcctgggctgcctggtcaaggctactcatctacatctgagcggcnggcaggcnatagnnnnnn

SEQ ID NO: 128539 - DNA, 614 bp, Homo sapiens
  misc_feature: GYAE6OF01D9YYY.37.31.C09.1.454.CMB.1.raw
  modified_base (206)..(206): a, c, t, g, unknown or other
  misc_feature (206)..(206): n is a, c, g, or t
  modified_base (213)..(213): a, c, t, g, unknown or other
  misc_feature (213)..(213): n is a, c, g, or t
  modified_base (580)..(580): a, c, t, g, unknown or other
  misc_feature (580)..(580): n is a, c, g, or t
  modified_base (582)..(584): a, c, t, g, unknown or other
  misc_feature (582)..(584): n is a, c, g, or t
  modified_base (586)..(614): a, c, t, g, unknown or other
  misc_feature (586)..(614): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaagaatacggtctatctggaaatgaacagcctgagagccgaggacacggccctntattacngtgcgagagatcagacggagtatagcagcagctctgactacgtcggggaccaaccggaacccgttggtccacccgttcctccctcacgccctaccgaacccgaacggggccccaacgttcccgggttccctttcccccgtcgggtacccctacccccctaccccgttacccgaaacgaccggaccctacccgttccgggtcgggggaccaacggaccgggcccgggtcccgtcgggtcctccggtcccgttcgggtaccgaaacggtacccttaaccgttccctaacgttaccctaactaaccgttacgtcggaacggggtcccgggtaccgtcgggaaccgaacgggcccgtaacgtagttaacgngnnngnnnnnnnnnnnnnnnnnnnnnnnnnnnnn

SEQ ID NO: 128540 - DNA, 516 bp, Homo sapiens
  misc_feature: GYAE6OF01ESS0P.37.31.C09.1.454.CMB.1.raw
  modified_base (481)..(481): a, c, t, g, unknown or other
  misc_feature (481)..(481): n is a, c, g, or t
  modified_base (485)..(485): a, c, t, g, unknown or other
  misc_feature (485)..(485): n is a, c, g, or t
  modified_base (490)..(490): a, c, t, g, unknown or other
  misc_feature (490)..(490): n is a, c, g, or t
  modified_base (492)..(501): a, c, t, g, unknown or other
  misc_feature (492)..(501): n is a, c, g, or t
  modified_base (503)..(516): a, c, t, g, unknown or other
  misc_feature (503)..(516): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcacctggtcactgtctcctcagcctccaccaagggccccagtccggtccttcccccgtggccgtcccctgcctccgaggcgccacctccgagacgcacacgccggccctggggcctgtcccgtgggtaccaaggtaccttaccttcccgatcctacacttacgtgacggccgggactgggactaaagggccgtacaagtacgcngcanctgcngnnnnnnnnnngnnnnnnnnnnnnnn

SEQ ID NO: 128541 - DNA, 527 bp, Homo sapiens
  misc_feature: GYAE6OF01C112Y.37.31.C09.1.454.CMB.1.raw
  modified_base (499)..(527): a, c, t, g, unknown or other
  misc_feature (499)..(527): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaagaacaccctgtctctgacaaatgaacaacctgagagccgagacacggcctatatactgtaacgaaaatggacctacggatatgactaactattagggactggtacttcgatctcgtggggccgtggccaccctggtcactgtctcctcagccctaccaaccgaacgggccctagtccggtcccttccccgtggccgccctgcctaccgaggacgaccacccgtccggaagacggccacgaacgggtcccggacccgtggggctcgcccgttaggtacaaacgggtcttaacttcccattacctaacgactacgtgacggcgggctggacgaaggcacagtagcannnnnnnnnnnnnnnnnnnnnnnnnnnnn

SEQ ID NO: 128542 - DNA, 463 bp, Homo sapiens
  misc_feature: GYAE6OF01D4LR5.37.31.C09.1.454.CMB.1.raw
  modified_base (299)..(299): a, c, t, g, unknown or other
  misc_feature (299)..(299): n is a, c, g, or t
  modified_base (336)..(336): a, c, t, g, unknown or other
  misc_feature (336)..(336): n is a, c, g, or t
  modified_base (435)..(436): a, c, t, g, unknown or other
  misc_feature (435)..(436): n is a, c, g, or t
  modified_base (438)..(463): a, c, t, g, unknown or other
  misc_feature (438)..(463): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcngcctccaccaagggcccatccggtcttcccctggccnccctgctccaggcgcacctcgagagcacagccggccctgggctgcctggtcaaggctacttcatctacactatgaggcggctggacaaggcgcagtagnngnnnnnnnnnnnnnnnnnnnnnnnnnn

SEQ ID NO: 128543 - DNA, 593 bp, Homo sapiens
  misc_feature: GYAE6OF01CHLGC.37.31.C09.1.454.CMB.1.raw
  modified_base (364)..(364): a, c, t, g, unknown or other
  misc_feature (364)..(364): n is a, c, g, or t
  modified_base (391)..(391): a, c, t, g, unknown or other
  misc_feature (391)..(391): n is a, c, g, or t
  modified_base (503)..(503): a, c, t, g, unknown or other
  misc_feature (503)..(503): n is a, c, g, or t
  modified_base (559)..(559): a, c, t, g, unknown or other
  misc_feature (559)..(559): n is a, c, g, or t
  modified_base (562)..(563): a, c, t, g, unknown or other
  misc_feature (562)..(563): n is a, c, g, or t
  modified_base (566)..(593): a, c, t, g, unknown or other
  misc_feature (566)..(593): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaaagaacaccctgtctctgacaaatgaacaacctgagagccgaggacacggcctatattactgtaacgaaaatcggcctacggatatcgactactagttgggactggttacttcgattctcggtggggccgtggccaccctggtcacgttcgtcctcctcgacgtcccctccgaacgaaccgggccctacgtcccggttcccctttccccgnggccccgtccctgcctaccgagggacncccaccgtaccgagacgccacgacggcccggtcccgtgggcctacggccgtacgggtacctaacgggtaaccctttaccgttacctaacttccctaaacgtaccgttaccgngggtaacggcccggggtacgtacgggacccggtaaacgggtccgtaacctaaggtncgnngcnnnnnnnnnnnnnnnnnnnnnnnnnnnn

SEQ ID NO: 128544 - DNA, 528 bp, Homo sapiens
  misc_feature: GYAE6OF01DHVHB.37.31.C09.1.454.CMB.1.raw
  modified_base (511)..(528): a, c, t, g, unknown or other
  misc_feature (511)..(528): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatatactgtaacgaaaatggcctacggatatgactactattgggactggtacttcgatctctggggccgtggccacccgtggtcactgtctcctcacgcctccaacaacgggcccagtccggtccttccccctgggcccgcccttgccctccgagggacgccacccgtccggagacgccaacgacggcccgggtcccttggggcctcggcccttgggtaccgaagggtacccttacttacccattcctaacaccgttaacgtggaacggccggggtcgtacgggacgaacggtccgacaacgtagnnnnnnnnnnnnnnnnnn

SEQ ID NO: 128545 - DNA, 581 bp, Homo sapiens
  misc_feature: GYAE6OF01CGKAO.37.31.C09.1.454.CMB.1.raw
  modified_base (284)..(284): a, c, t, g, unknown or other
  misc_feature (284)..(284): n is a, c, g, or t
  modified_base (287)..(287): a, c, t, g, unknown or other
  misc_feature (287)..(287): n is a, c, g, or t
  modified_base (302)..(302): a, c, t, g, unknown or other
  misc_feature (302)..(302): n is a, c, g, or t
  modified_base (334)..(334): a, c, t, g, unknown or other
  misc_feature (334)..(334): n is a, c, g, or t
  modified_base (501)..(501): a, c, t, g, unknown or other
  misc_feature (501)..(501): n is a, c, g, or t
  modified_base (510)..(510): a, c, t, g, unknown or other
  misc_feature (510)..(510): n is a, c, g, or t
  modified_base (516)..(516): a, c, t, g, unknown or other
  misc_feature (516)..(516): n is a, c, g, or t
  modified_base (534)..(534): a, c, t, g, unknown or other
  misc_feature (534)..(534): n is a, c, g, or t
  modified_base (573)..(573): a, c, t, g, unknown or other
  misc_feature (573)..(573): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccgatctccagagacaattccaagaacaccctgtctctgcaaatgaacaacctgagagccgaggacaccggacctatattactgtaacgaaaatcggcctacggatagtgactactattgggactggtacttcgatctcgtgggcctggccnccnggtcactgtctctcngtcctcacgacggccagtccggtccttcccgnggccgtccctgcctaccgaggtacaccaccgtcggagcgacacgacggccgccgttagggcctacggccgttggtaccaacggtaccttaccgttaccagttcctaacgacctacgtaggaacggtccgggtcgtcgggaacgtaagggaccgtacgtacgtaacgngtacgagtnaacggngactcgtacacgtgcgcngtacgacgacgtcgcgagtacgtcgcgtcgcgtcacacnctcgtcgc

SEQ ID NO: 128546 - DNA, 554 bp, Homo sapiens
  misc_feature: GYAE6OF01E5CS2.37.31.C09.1.454.CMB.1.raw
  modified_base (524)..(554): a, c, t, g, unknown or other
  misc_feature (524)..(554): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaaagaacaccctgtctctgacaaatgaacaacctgagagccgaggacacggccctatattactgtgtgaagggacctctacgcccttatagcagcggctggtccttggttactttgacgacgtggggccagggaaccctggtccaccgtctcctcacgcctccaccgaacgggcccagtccggttcccttcccccgtgggcccgtccccgtcgccttcccggaaggacgcctaccgtccggaagacgcacgacggcccggcccgtgggtctcggcccttgggtaccaaacggtcccttacttccacttccgtaacctacgtaccgtggaccgggtccgggcgtaggaccgtaacgggcacgtagtacggctnnnnnnnnnnnnnnnnnnnnnnnnnnnnnnn

SEQ ID NO: 128547 - DNA, 642 bp, Homo sapiens
  misc_feature: GYAE6OF01CS09V.37.31.C09.1.454.CMB.1.raw
  modified_base (269)..(269): a, c, t, g, unknown or other
  misc_feature (269)..(269): n is a, c, g, or t
  modified_base (347)..(347): a, c, t, g, unknown or other
  misc_feature (347)..(347): n is a, c, g, or t
  modified_base (352)..(352): a, c, t, g, unknown or other
  misc_feature (352)..(352): n is a, c, g, or t
  modified_base (369)..(369): a, c, t, g, unknown or other
  misc_feature (369)..(369): n is a, c, g, or t
  modified_base (387)..(387): a, c, t, g, unknown or other
  misc_feature (387)..(387): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaagaaccaccctgtctctgacaaatgaacaactgagagccgaggacacggcctatattactgtaacgaaaatcggacctacggatatgactactagttggactgtcttcgatctcgnggggccgtggccacccgttggtcacttgtctcctcacgtcctccgaaccgaacggcccacgtccggttccttccccgnggccncccgtgcctcgaggacncgacctcgagacgcacgnggtcccggcccgtggggcctgcccgttaggtaccgaacggtaccttaccgttacctacgttaccctaaccgtaacttacggtacgaccggggtacgggtaccgttacgggaaccgtaaggggtaccccgacgtaacggtacgacgagctaacgcggttaacgcgtacgacgacgtacgtacgtacgacgtacgtacgtacgtacgtcgtagtactacgtacgtacgtacgtacgtacgtacgtacgtcgtgtacg

SEQ ID NO: 128548 - DNA, 559 bp, Homo sapiens
  misc_feature: GYAE6OF01DI5KU.37.31.C09.1.454.CMB.1.raw
  modified_base (236)..(236): a, c, t, g, unknown or other
  misc_feature (236)..(236): n is a, c, g, or t
  modified_base (531)..(531): a, c, t, g, unknown or other
  misc_feature (531)..(531): n is a, c, g, or t
  modified_base (535)..(559): a, c, t, g, unknown or other
  misc_feature (535)..(559): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaagaacaccctgtctctgacaaatgaacaacctgagagccgagacacggccctatattactgtaacgaaatggcctacggatangactactagttgggactggtacttcgatctcgtcggggccgtggccacccgtggtcacttcgtctcctcaccgccctaccaccgtaacgggccctacgttccggtcccttcccccgtggcccgtcccctacgccctaccgacggtacgccccaccgtccggagacgccacgtacggcccggtccgtcgggctcgccgttggtaccgaaacggttacccgtacttccgaacttacctaacgtaccttacggtaggacggtccgggacgtcgggaccgaaggccgtacacgtagcanatgnnnnnnnnnnnnnnnnnnnnnnnnn

SEQ ID NO: 128549 - DNA, 580 bp, Homo sapiens
  misc_feature: GYAE6OF01CI0T8.37.31.C09.1.454.CMB.1.raw
  modified_base (542)..(542): a, c, t, g, unknown or other
  misc_feature (542)..(542): n is a, c, g, or t
  modified_base (551)..(551): a, c, t, g, unknown or other
  misc_feature (551)..(551): n is a, c, g, or t
  modified_base (553)..(555): a, c, t, g, unknown or other
  misc_feature (553)..(555): n is a, c, g, or t
  modified_base (557)..(560): a, c, t, g, unknown or other
  misc_feature (557)..(560): n is a, c, g, or t
  modified_base (562)..(580): a, c, t, g, unknown or other
  misc_feature (562)..(580): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatcctccagagacaattccaagaacaccctgtctctgcaaatgaacaactgagagccgaggacacggcctatattactgtaacgaaaatggcctacggatatgactactattgggactggtacttcgatctcgtggggccgtggcctacccgtggtcactgtcctcccctgcctccaccaacggccgcctcgtccgttccctccggcggcccgtccgtcgccgtacggacgaccgacctcccgacggacgacaccgacggccggtcccgggcggtcgggtaccgtccggtcggtaccggtaaacgtaccgttaacccttaccctactaccttaccctaacgtacgttacggacgggtccgggggtacggtcggtccggaaaggggtacccgccggaatttaacgggtncgtgcgcgncnnncnnnngnnnnnnnnnnnnnnnnnnn

SEQ ID NO: 128550 - DNA, 484 bp, Homo sapiens
  misc_feature: GYAE6OF01EJSPV.37.31.C09.1.454.CMB.1.raw
  modified_base (339)..(339): a, c, t, g, unknown or other
  misc_feature (339)..(339): n is a, c, g, or t
  modified_base (353)..(353): a, c, t, g, unknown or other
  misc_feature (353)..(353): n is a, c, g, or t
  modified_base (472)..(484): a, c, t, g, unknown or other
  misc_feature (472)..(484): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaaagaacaccctgtctctgcaaatgaaacaacctgagagccgaggacacggccctatattactgtacgaaaatggcctacggatatgactactattgggactggtacttcgatctctggggccgtggcaccctggtcactgtctcctcagcctccaccaagggcccatccggtcttccccgtggccncctgcctccagganccacctccgagagccacgacgccgggccctggggcctggccgtgggtaccaagggaccttacctccaactctaaccacttacgtggacggcgggctgggacctaagggccgacaatagnnnnnnnnnnnnn

SEQ ID NO: 128551 - DNA, 490 bp, Homo sapiens
  misc_feature: GYAE6OF01EOWCS.37.31.C09.1.454.CMB.1.raw
  modified_base (143)..(143): a, c, t, g, unknown or other
  misc_feature (143)..(143): n is a, c, g, or t
  modified_base (243)..(243): a, c, t, g, unknown or other
  misc_feature (243)..(243): n is a, c, g, or t
  modified_base (376)..(376): a, c, t, g, unknown or other
  misc_feature (376)..(376): n is a, c, g, or t
  modified_base (403)..(403): a, c, t, g, unknown or other
  misc_feature (403)..(403): n is a, c, g, or t
  modified_base (435)..(435): a, c, t, g, unknown or other
  misc_feature (435)..(435): n is a, c, g, or t
  modified_base (439)..(439): a, c, t, g, unknown or other
  misc_feature (439)..(439): n is a, c, g, or t
  modified_base (452)..(452): a, c, t, g, unknown or other
  misc_feature (452)..(452): n is a, c, g, or t
  modified_base (468)..(468): a, c, t, g, unknown or other
  misc_feature (468)..(468): n is a, c, g, or t
  modified_base (471)..(472): a, c, t, g, unknown or other
  misc_feature (471)..(472): n is a, c, g, or t
  modified_base (474)..(490): a, c, t, g, unknown or other
  misc_feature (474)..(490): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatcctcagngacattccaagaacaccctgtctctgacaaatgaacacctgagagccgaggacacggcctatattactagtaacgaaaatgcctacggatatgactactnttgggacttggtacttgattcgtcgtggggccgtggccacccgttggtctactcggtcctccgtctacgcctccaacccgtacgggccctagtccggtccttccccgcggtccgccctcggcctccgaggtcnccaccgtcgagcgcacgcgccgtccgnggctcgcgtcggcagtacctactccatctacncttntacggagccggcngggtacaacgcgtcangcnngnnnnnnnnnnnnnnnnn

SEQ ID NO: 128552 - DNA, 559 bp, Homo sapiens
  misc_feature: GYAE6OF01BV95L.37.31.C09.1.454.CMB.1.raw
  modified_base (517)..(517): a, c, t, g, unknown or other
  misc_feature (517)..(517): n is a, c, g, or t
  modified_base (524)..(524): a, c, t, g, unknown or other
  misc_feature (524)..(524): n is a, c, g, or t
  modified_base (526)..(526): a, c, t, g, unknown or other
  misc_feature (526)..(526): n is a, c, g, or t
  modified_base (528)..(529): a, c, t, g, unknown or other
  misc_feature (528)..(529): n is a, c, g, or t
  modified_base (532)..(534): a, c, t, g, unknown or other
  misc_feature (532)..(534): n is a, c, g, or t
  modified_base (536)..(536): a, c, t, g, unknown or other
  misc_feature (536)..(536): n is a, c, g, or t
  modified_base (538)..(539): a, c, t, g, unknown or other
  misc_feature (538)..(539): n is a, c, g, or t
  modified_base (541)..(544): a, c, t, g, unknown or other
  misc_feature (541)..(544): n is a, c, g, or t
  modified_base (546)..(554): a, c, t, g, unknown or other
  misc_feature (546)..(554): n is a, c, g, or t
  modified_base (556)..(556): a, c, t, g, unknown or other
  misc_feature (556)..(556): n is a, c, g, or t
  modified_base (558)..(558): a, c, t, g, unknown or other
  misc_feature (558)..(558): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaagaacaccctgtctctgcaaatgaacaactgagagccgagacacgcctatattactgtacgaaaatgcctacggatatgactactagttggactggtacttcgatctcgtgggccgtgccacctggtcactgtctcctcacgcctccaccgaacgggccctacgttccggttccctttcccccgtggcccgtcccgtcgcctccgagacgccacctccggaagacgccaacgacggccggcccgtcggggtcctcggccgttcggtccgaaacgggtaccttaccgttccactaccgtaactacgttaccgtaggacgggccgggtcgtacgggaccgtaagggacccacgtaacgttaggacntagacgngnanncgnnngngnngnnnngnnnnnnnnncntng

SEQ ID NO: 128553 - DNA, 540 bp, Homo sapiens
  misc_feature: GYAE6OF01DSOE5.37.31.C09.1.454.CMB.1.raw
  modified_base (141)..(141): a, c, t, g, unknown or other
  misc_feature (141)..(141): n is a, c, g, or t
  modified_base (505)..(505): a, c, t, g, unknown or other
  misc_feature (505)..(505): n is a, c, g, or t
  modified_base (507)..(507): a, c, t, g, unknown or other
  misc_feature (507)..(507): n is a, c, g, or t
  modified_base (512)..(521): a, c, t, g, unknown or other
  misc_feature (512)..(521): n is a, c, g, or t
  modified_base (523)..(540): a, c, t, g, unknown or other
  misc_feature (523)..(540): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaaggccgttcaccatctccagngacaattccaagaacaccctgtctctgcaaatgaacaacctgagagccgaggaccacggccctatattactgtaacgaaaatggcctacggatatcgactactagttgggactggtacttcgatctcgtgggccgtggccacctggtcactcgtctcctcagccctaccacgaacgggcccagtccggtccttcccccgtggcccgtccctgccctccgaggacgccaccctccgagacgccacgacgccggccctggggcctcggcccgtgggtaccaaacgggtaccttaccgttaccacttaccgtaccacttaccgtggacggtccgggaccgttgggaccgaaggtccgactaagtcgnancgacnnnnnnnnnncnnnnnnnnnnnnnnnnnn

SEQ ID NO: 128554 - DNA, 453 bp, Homo sapiens
  misc_feature: GYAE6OF01D9VEF.37.31.C09.1.454.CMB.1.raw
  modified_base (131)..(131): a, c, t, g, unknown or other
  misc_feature (131)..(131): n is a, c, g, or t
  modified_base (366)..(366): a, c, t, g, unknown or other
  misc_feature (366)..(366): n is a, c, g, or t
  modified_base (441)..(441): a, c, t, g, unknown or other
  misc_feature (441)..(441): n is a, c, g, or t
  modified_base (447)..(453): a, c, t, g, unknown or other
  misc_feature (447)..(453): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttnaccatctccagagacaattccaagaacaccctgtctctgcaaatgaacaacctgagagccgaggacacggccctatattactgtacgaaaatggcctaggatatgactactattgggactggtacttgatctctggggccgtgcaccctggtcactgtctcctcagcctccacaaggggccccagtccggtccttccccctggccgtccctgcctccaggcgcaccgtccgagcncacagccggcccgtgggctcgcctgggtcaacgggtcttactccatctacacttactggagcgggctggcaggcncatagnnnnnnn

SEQ ID NO: 128555 - DNA, 440 bp, Homo sapiens
  misc_feature: GYAE6OF02JUSFI.37.31.C09.1.454.CMB.1.raw
  modified_base (359)..(359): a, c, t, g, unknown or other
  misc_feature (359)..(359): n is a, c, g, or t
  modified_base (434)..(440): a, c, t, g, unknown or other
  misc_feature (434)..(440): n is a, c, g, or t
tcagtagtgtagatcacgaccggtgctcgatttagacgtctcatcaaggaaggaagggactggagtgggtctcaggtattggtggcaggtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggcctggcaccctggtcactgtctcctcagcctccaccaagggcccatcggtcttccccctggcgccctgctccaggagcacctccganagcacagcggccctgggctgcctggtacaaggctactccatctacactactgagcgggctggcaaggctcatagnnnnnnn

SEQ ID NO: 128556 - DNA, 437 bp, Homo sapiens
  misc_feature: GYAE6OF02GTBEB.37.31.C09.1.454.CMB.1.raw
  modified_base (432)..(437): a, c, t, g, unknown or other
  misc_feature (432)..(437): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttcccctggcgccctgctccaggagcacctccgagagcacagcggcctgggctgcctggtcaaggctacttccatctacactactgagcgggctggcaaggcgcatagnnnnnn

SEQ ID NO: 128557 - DNA, 442 bp, Homo sapiens
  misc_feature: GYAE6OF02JT27H.37.31.C09.1.454.CMB.1.raw
  modified_base (430)..(442): a, c, t, g, unknown or other
  misc_feature (430)..(442): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctgggccgtggcaccctggtcactgtctcctcagcctccaccaagggcccatcggtcttcccctgcgccctgctccaggagcacctccgagagcacagcggccctgggctgcctggtcaaggctactccatctacactactgagcgggctggcaaggcgcatagnnnnnnnnnnnnn

SEQ ID NO: 128558 - DNA, 445 bp, Homo sapiens
  misc_feature: GYAE6OF02HW1WR.37.31.C09.1.454.CMB.1.raw
  modified_base (433)..(445): a, c, t, g, unknown or other
  misc_feature (433)..(445): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatatactgtacgaaaatggctacggatatgactactattgggactggtacttcgatctctggggccgtggcaccctggtcactgtctcctcagcctccaccaagggcccatcggtcttccccctggcgccctgctccaggagcacctccgagagcacagcggccctgggctgcctggtcaaggactacttccatctacactactgagcgggctggcaaggcgcatagnnnnnnnnnnnnn

SEQ ID NO: 128559 - DNA, 439 bp, Homo sapiens
  misc_feature: GYAE6OF02JJHNM.37.31.C09.1.454.CMB.1.raw
  modified_base (216)..(216): a, c, t, g, unknown or other
  misc_feature (216)..(216): n is a, c, g, or t
  modified_base (349)..(349): a, c, t, g, unknown or other
  misc_feature (349)..(349): n is a, c, g, or t
  modified_base (359)..(359): a, c, t, g, unknown or other
  misc_feature (359)..(359): n is a, c, g, or t
  modified_base (363)..(363): a, c, t, g, unknown or other
  misc_feature (363)..(363): n is a, c, g, or t
  modified_base (400)..(400): a, c, t, g, unknown or other
  misc_feature (400)..(400): n is a, c, g, or t
  modified_base (426)..(439): a, c, t, g, unknown or other
  misc_feature (426)..(439): n is a, c, g, or t
tcagtagtgtagatcacgaccggtgctcgatttagacgtctcatcaaggaaggaagggacgtggagtgggtcgtcaggtattggtggcgagtggtgagaccacatactacgcagactccgtgaagggccggttcaccatctccagagacaattccaagaacaccctgtctctgcaaatgaacaacctgagagccgaggacacggccctatattacngtacgaaaatggcctacggatatgactactattgggactggtacttcgatctctggggccgtggcaccctggtcactgtctcctcagccctccaccaagggcccatcggtctcccctgcgccctgctccaggncactccgagngcangcgcctggctgcctggcaaggctactccatcacactntgacgcgggctggcaaggcgcatagnnnnnnnnnnnnnn

SEQ ID NO: 128560 - DNA, 442 bp, Homo sapiens
  misc_feature: GYAE6OF02JI8GE.37.31.C09.1.454.CMB.1.raw
  modified_base (350)..(350): a, c, t, g, unknown or other
  misc_feature (350)..(350): n is a, c, g, or t
  modified_base (435)..(442): a, c, t, g, unknown or other
  misc_feature (435)..(442): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggccccatcggtcttccccctggcgccctgctccaggancacctccgagagcacagcggccctgggctgcctggtcaaggctacttccatctacactactgagcgggctggcaaggcgcatagnnnnnnnn

SEQ ID NO: 128561 - DNA, 445 bp, Homo sapiens
  misc_feature: GYAE6OF02HZAG2.37.31.C09.1.454.CMB.1.raw
  modified_base (435)..(445): a, c, t, g, unknown or other
  misc_feature (435)..(445): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttccccctggccgccctgctccaggacgcacctccgagagcacagcggccctgggctgcctggtcaggactacttcatctacactactgagcgggctggcaaggcgcatagnnnnnnnnnnn

SEQ ID NO: 128562 - DNA, 426 bp, Homo sapiens
  misc_feature: GYAE6OF02FJNYA.37.31.C09.1.454.CMB.1.raw
  modified_base (423)..(426): a, c, t, g, unknown or other
  misc_feature (423)..(426): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaagaacacgctgtatctgcaaatgaacagcctgagagccgaggacacggccgtatattactgtgcgagagatcagacggagtatagcagcagctctgactactggggccacggaaccctggtcaccgtctcctcagcctccaccaagggcccatcggtcttccccctggcaccctcctccaagagcacctctgggggcacagcggccctgggctgcctggtcaaggactacttccatctacactactgagcgggctggcaaggcgcatagnnnn

SEQ ID NO: 128563 - DNA, 444 bp, Homo sapiens
  misc_feature: GYAE6OF02HBV0D.37.31.C09.1.454.CMB.1.raw
  modified_base (436)..(444): a, c, t, g, unknown or other
  misc_feature (436)..(444): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttccccctggccgccctgcctccaggacgcacctccgagagcacagcggccctgggctgcctggtcaggactacttccatcacactactgagcgggctggcaaggcgcatagnnnnnnnnn

SEQ ID NO: 128564 - DNA, 446 bp, Homo sapiens
  misc_feature: GYAE6OF02GFF7C.37.31.C09.1.454.CMB.1.raw
  modified_base (352)..(352): a, c, t, g, unknown or other
  misc_feature (352)..(352): n is a, c, g, or t
  modified_base (438)..(446): a, c, t, g, unknown or other
  misc_feature (438)..(446): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctgggccgtggcaccctggtcactgtctcctcagcctccaccaagggccccatcggtccttcccccgtggccgccctgcctccaggngccacctccgagagcacagcggcctgggctgcctggtcaaggactacttccatcacactactgagcgggctggcaaggcgcatagnnnnnnnnn

SEQ ID NO: 128565 - DNA, 445 bp, Homo sapiens
  misc_feature: GYAE6OF02INPXA.37.31.C09.1.454.CMB.1.raw
  modified_base (298)..(298): a, c, t, g, unknown or other
  misc_feature (298)..(298): n is a, c, g, or t
  modified_base (348)..(348): a, c, t, g, unknown or other
  misc_feature (348)..(348): n is a, c, g, or t
  modified_base (435)..(445): a, c, t, g, unknown or other
  misc_feature (435)..(445): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaagaacaccctgtctctgcaaatgaacaacctgagagccgatgacacggccctatattactgtacgaaaatggcctacggatatgactactattgggactggtacttcgatctctggggccgtggcacctggtcactgtctcctcngcctccaccaagggcccatcggtccttcccctggccgccctgctccaggngcacctccgagagcacagccggcctgggctgcctgggtcaaggactactccatctacactactgagcgggctggcaaggcgcatagnnnnnnnnnnn

SEQ ID NO: 128566 - DNA, 444 bp, Homo sapiens
  misc_feature: GYAE6OF02G04SZ.37.31.C09.1.454.CMB.1.raw
  modified_base (438)..(444): a, c, t, g, unknown or other
  misc_feature (438)..(444): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttccccctggccgccctgctccaggagcacctccgagagcacagcggcccgtgggcctgcctggtcaacggactactccatctacactactgagcgggctggcaaggcgcatagnnnnnnn

SEQ ID NO: 128567 - DNA, 449 bp, Homo sapiens
  misc_feature: GYAE6OF02F4GW3.37.31.C09.1.454.CMB.1.raw
  modified_base (438)..(449): a, c, t, g, unknown or other
  misc_feature (438)..(449): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttccccctggccgccctgctccaggagcacctccgagagcacacgcggccctgggctgcctggtcaaggactacttccatctacactactgagcgggctgggcaaggcgcatagnnnnnnnnnnnn

SEQ ID NO: 128568 - DNA, 436 bp, Homo sapiens
  misc_feature: GYAE6OF02F1AIO.37.31.C09.1.454.CMB.1.raw
  modified_base (432)..(436): a, c, t, g, unknown or other
  misc_feature (432)..(436): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttcccctggcgccctgctccaggagcacctccgagagcacagcggccctgggctgcctggtcaaggctacttccatctacactactgagcgggctggcaaggcgcatgnnnnn

SEQ ID NO: 128569 - DNA, 452 bp, Homo sapiens
  misc_feature: GYAE6OF02H8IP5.37.31.C09.1.454.CMB.1.raw
  modified_base (445)..(452): a, c, t, g, unknown or other
  misc_feature (445)..(452): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctgggccgtggcaccctggtcactgtctcctcagccctccaccaagggcccatcggtccttccccctggccgccctgctccgaggacgcaccctccgagacgcacagcggcccgtgggctgcctggtcaacggactacttccatcctacactactgacgcgggctggcaaggcgcatagnnnnnnnn

SEQ ID NO: 128570 - DNA, 503 bp, Homo sapiens
  misc_feature: GYAE6OF02IZWVI.37.31.C09.1.454.CMB.1.raw
  modified_base (440)..(440): a, c, t, g, unknown or other
  misc_feature (440)..(440): n is a, c, g, or t
  modified_base (475)..(503): a, c, t, g, unknown or other
  misc_feature (475)..(503): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtaacgaaaatggcctacggatatgactactattgggactggtacttgatctctgggccgtggcaccctggtcactgtcctcctcgagccctccaccgaaggggcccagtccggtccttcccccgtggccgccctcgcctaccgaggacgcacctaccggagacgcacgagccggccctgggcctcggcctgggtccaagggacttaccttccactcctacactacncggaggccgggcgtgggcgaagggccgacactagnnnnnnnnnnnnnnnnnnnnnnnnnnnnn

SEQ ID NO: 128571 - DNA, 514 bp, Homo sapiens
  misc_feature: GYAE6OF02I6VM4.37.31.C09.1.454.CMB.1.raw
  modified_base (485)..(514): a, c, t, g, unknown or other
  misc_feature (485)..(514): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtaacaaaatggcctacggatatgactactattgggactggtacttcgatctctggggccgtggcaccctggtcactgtctcctcagcctccaccaacgggcccaagtccggtccttccccctggccgccctgctccgaggacgccaccgtccgagacgccaacgacgccggcccgtgggctcgcccttagggtccaaagggaccttaccgttcccaactcctaaccaccttactaggacggccgggctcggacgaagggcgacaagtagcnnnnnnnnnnnnnnnnnnnnnnnnnnnnnn

SEQ ID NO: 128572 - DNA, 445 bp, Homo sapiens
  misc_feature: GYAE6OF02HQ5UJ.37.31.C09.1.454.CMB.1.raw
  modified_base (432)..(445): a, c, t, g, unknown or other
  misc_feature (432)..(445): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaagaatacggtctatctggaaatgaacagcctgagagccgaggacacggccctctattactgtgcgagagatcagacggagtatagcagcagctctgactactggggccacggaaccctggtcaccgtctcctcagcctccaccaagggcccatcggtcttccccctggccaccctcctccaagacgccacctctggggccacgagcggcccgtgggctcggcctggtcaagggactacgttccatctacactactgagcggctcggcaaggcgcatagnnnnnnnnnnnnnn

SEQ ID NO: 128573 - DNA, 456 bp, Homo sapiens
  misc_feature: GYAE6OF02IDGPI.37.31.C09.1.454.CMB.1.raw
  modified_base (443)..(456): a, c, t, g, unknown or other
  misc_feature (443)..(456): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagccctccaccaagggcccatcggtcttccccctggccgccctgctccaggacgcacctccgagacgcacacgcggccctggggcctgccctggtcaaggactacttcatcctacactactgagcgggctggcaaggcgcatagnnnnnnnnnnnnnn

SEQ ID NO: 128574 - DNA, 463 bp, Homo sapiens
  misc_feature: GYAE6OF02IX9ZZ.37.31.C09.1.454.CMB.1.raw
  modified_base (338)..(338): a, c, t, g, unknown or other
  misc_feature (338)..(338): n is a, c, g, or t
  modified_base (347)..(347): a, c, t, g, unknown or other
  misc_feature (347)..(347): n is a, c, g, or t
  modified_base (445)..(463): a, c, t, g, unknown or other
  misc_feature (445)..(463): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggcccctatattactgtacgaaaatggcctacggatatgactactattgggactggtacttcgatctctggggctggcaccctggtcactgtctcctcagcctccaccaagggcccatcggtcttcccctggcgccctnctccaggancacctccgagacgcacacgcggccctggggctgccctggtccaaaggactacgttcccatcctacacttactgacgcgggctggcaaggcgacatagnnnnnnnnnnnnnnnnnnn

SEQ ID NO: 128575 - DNA, 548 bp, Homo sapiens
  misc_feature: GYAE6OF02JCL1Q.37.31.C09.1.454.CMB.1.raw
  modified_base (475)..(475): a, c, t, g, unknown or other
  misc_feature (475)..(475): n is a, c, g, or t
  modified_base (518)..(548): a, c, t, g, unknown or other
  misc_feature (518)..(548): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaagaacaccctgtctctgcaatgaacaacctgagagccgaggacacggcctatattactgtaacgaaaatcggcctacggatatgactactattggactggtacttcgatctcgtgggccgtgctaccgtggtcacttgtcctcctcacgtccctaccgaccaacgggcccacgttccgtccttcccccgtgccgccctagtcctacgacggtacgacctacccgtccgaacgtcgccaacgtacggccggtccggtcgggcctcggcccgtacggtacgaacggtacccttaccttaccgacttccgaaacctcgttaccgngggtacgggccgggtctagggccgaagggtcccatagagtcgnnnnnnnnnnnnnnnnnnnnnnnnnnnnnnn

SEQ ID NO: 128576 - DNA, 532 bp, Homo sapiens
  misc_feature: GYAE6OF02FU3QF.37.31.C09.1.454.CMB.1.raw
  modified_base (461)..(461): a, c, t, g, unknown or other
  misc_feature (461)..(461): n is a, c, g, or t
  modified_base (506)..(532): a, c, t, g, unknown or other
  misc_feature (506)..(532): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtaacgaaaatggcctacggatatgactactattgggactggtacttcgatctcgtggggccgtggcaccctggtcactgtctcctcagccctccaccaagggccccagtccggtccttccccctgggccgcccctgcctccgaggacgccaccctcggacgagccacgagccgggccctgggggcctcggcccgtgggtacccaaagggtaccttaccgttcccaacgttcctaaccaacgttaccnggaacggccggggtcctagggtaccgaaacggccgctaagtagcnnnnnnnnnnnnnnnnnnnnnnnnnnn

SEQ ID NO: 128577 - DNA, 463 bp, Homo sapiens
  misc_feature: GYAE6OF02GXDYK.37.31.C09.1.454.CMB.1.raw
  modified_base (337)..(337): a, c, t, g, unknown or other
  misc_feature (337)..(337): n is a, c, g, or t
  modified_base (437)..(437): a, c, t, g, unknown or other
  misc_feature (437)..(437): n is a, c, g, or t
  modified_base (443)..(463): a, c, t, g, unknown or other
  misc_feature (443)..(463): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaactccaacaacacgctgtctctgcaacttaacagcctgagagacgaggacacggccgtatattactgtgcgaaggaagggtctagcagtgcctggtactcccactactatatggacgtctggggcaaaggaatcgcggtcaccgtctcctcagcctccaccaagggcccagtccggtcttccccgtgccnccctcctccagacgcacctcgtcggggcacgacgcggccctgggctgcctggtcgaaggacttactccactctacactactgagcgggctggcaagggcncatagnnnnnnnnnnnnnnnnnnnnn

SEQ ID NO: 128578 - DNA, 533 bp, Homo sapiens
  misc_feature: GYAE6OF02HI9LM.37.31.C09.1.454.CMB.1.raw
  modified_base (213)..(213): a, c, t, g, unknown or other
  misc_feature (213)..(213): n is a, c, g, or t
  modified_base (342)..(342): a, c, t, g, unknown or other
  misc_feature (342)..(342): n is a, c, g, or t
  modified_base (348)..(348): a, c, t, g, unknown or other
  misc_feature (348)..(348): n is a, c, g, or t
  modified_base (381)..(381): a, c, t, g, unknown or other
  misc_feature (381)..(381): n is a, c, g, or t
  modified_base (503)..(503): a, c, t, g, unknown or other
  misc_feature (503)..(503): n is a, c, g, or t
  modified_base (506)..(533): a, c, t, g, unknown or other
  misc_feature (506)..(533): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaagaacaccctgtctctagcaaatgaacaacctgagagccgaggacacggcctatattacngtaacgaaaatggcctacggatatgactactagtgggctggtacttcgatctcgtggggccgtggccacctggtcactgtcctcctcacgccctccaaccgaacgggcccagtccggtccttcccccgnggtccnccctgcctccgaggcgcctacccgtccgaacgngccacgtacgccggtcccgtgggctcgccgttcggtaccgaacggtacctaaccgttccattccgtaacctacttacgtcggacggccgggtctaccgggacgaacggccgacgactagcancgnnnnnnnnnnnnnnnnnnnnnnnnnnnn

SEQ ID NO: 128579 - DNA, 524 bp, Homo sapiens
  misc_feature: GYAE6OF02HW60Z.37.31.C09.1.454.CMB.1.raw
  modified_base (343)..(343): a, c, t, g, unknown or other
  misc_feature (343)..(343): n is a, c, g, or t
  modified_base (356)..(356): a, c, t, g, unknown or other
  misc_feature (356)..(356): n is a, c, g, or t
  modified_base (490)..(490): a, c, t, g, unknown or other
  misc_feature (490)..(490): n is a, c, g, or t
  modified_base (498)..(507): a, c, t, g, unknown or other
  misc_feature (498)..(507): n is a, c, g, or t
  modified_base (509)..(511): a, c, t, g, unknown or other
  misc_feature (509)..(511): n is a, c, g, or t
  modified_base (513)..(515): a, c, t, g, unknown or other
  misc_feature (513)..(515): n is a, c, g, or t
  modified_base (517)..(524): a, c, t, g, unknown or other
  misc_feature (517)..(524): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaaagaacaccctgtctctgcaaatgaacaacctgagagcgaggacacggccctatattactgtaacgaaaatggcctacggatatgactactagttgggactggtacttcgatctcgtggggcctggcaccctggtcactgtctcctcagccctccaccgacggcccagtcgtcctccccgtgccgtcccngcctccgaggacnccaccgtccgagagcacacggccggcccgtgggctcgccgtggtacgaacggtacctacgttcccacttcctaactactacgtggacggccgggtctgggaaccgtaagggccgacgtaagtacgcgtcagacncgatgcgnnnnnnnnnngnnngnnngnnnnnnnn

SEQ ID NO: 128580 - DNA, 495 bp, Homo sapiens
  misc_feature: GYAE6OF02GYJQK.37.31.C09.1.454.CMB.1.raw
  modified_base (292)..(292): a, c, t, g, unknown or other
  misc_feature (292)..(292): n is a, c, g, or t
  modified_base (369)..(369): a, c, t, g, unknown or other
  misc_feature (369)..(369): n is a, c, g, or t
  modified_base (417)..(417): a, c, t, g, unknown or other
  misc_feature (417)..(417): n is a, c, g, or t
  modified_base (463)..(463): a, c, t, g, unknown or other
  misc_feature (463)..(463): n is a, c, g, or t
  modified_base (465)..(470): a, c, t, g, unknown or other
  misc_feature (465)..(470): n is a, c, g, or t
  modified_base (472)..(472): a, c, t, g, unknown or other
  misc_feature (472)..(472): n is a, c, g, or t
  modified_base (474)..(495): a, c, t, g, unknown or other
  misc_feature (474)..(495): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatatactgtaacgaaaatggcctacggatatgactactagtgggactggtacttcgatctcgtggggccgtggcaccctggtcactntctcctcagccctccaccgagggcccatccggtccttccccctggccgccctgctacccgaggcgccacctcgaagngccacgagccggcccgtgggctgcctggtaccgaagtacctctacccntcctaacactacgtgcggcggcgtggactaagggccactagtagcngnnnnnnantnnnnnnnnnnnnnnnnnnnnnn

SEQ ID NO: 128581 - DNA, 539 bp, Homo sapiens
  misc_feature: GYAE6OF02FQVA4.37.31.C09.1.454.CMB.1.raw
  modified_base (302)..(302): a, c, t, g, unknown or other
  misc_feature (302)..(302): n is a, c, g, or t
  modified_base (374)..(374): a, c, t, g, unknown or other
  misc_feature (374)..(374): n is a, c, g, or t
  modified_base (385)..(385): a, c, t, g, unknown or other
  misc_feature (385)..(385): n is a, c, g, or t
  modified_base (390)..(390): a, c, t, g, unknown or other
  misc_feature (390)..(390): n is a, c, g, or t
  modified_base (489)..(489): a, c, t, g, unknown or other
  misc_feature (489)..(489): n is a, c, g, or t
  modified_base (498)..(498): a, c, t, g, unknown or other
  misc_feature (498)..(498): n is a, c, g, or t
  modified_base (502)..(502): a, c, t, g, unknown or other
  misc_feature (502)..(502): n is a, c, g, or t
  modified_base (505)..(505): a, c, t, g, unknown or other
  misc_feature (505)..(505): n is a, c, g, or t
  modified_base (507)..(507): a, c, t, g, unknown or other
  misc_feature (507)..(507): n is a, c, g, or t
  modified_base (513)..(513): a, c, t, g, unknown or other
  misc_feature (513)..(513): n is a, c, g, or t
  modified_base (515)..(518): a, c, t, g, unknown or other
  misc_feature (515)..(518): n is a, c, g, or t
  modified_base (520)..(523): a, c, t, g, unknown or other
  misc_feature (520)..(523): n is a, c, g, or t
  modified_base (525)..(530): a, c, t, g, unknown or other
  misc_feature (525)..(530): n is a, c, g, or t
  modified_base (532)..(533): a, c, t, g, unknown or other
  misc_feature (532)..(533): n is a, c, g, or t
  modified_base (535)..(538): a, c, t, g, unknown or other
  misc_feature (535)..(538): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaagaacaccctgtctctgcaaatgaacaacctgagagcgaggacacggcctatagtactagtaacgaaaatcggacctacggatatgactactattggggactggtactcgatctcgtggggcgtggcacccttggcactgtcctcctcncgtcctaccaccgaacgggccccaacgttccggtaccttcccccgtgggcccgtccctcgcctacgaggacncacctccgacngcacncgccggccgtgggcttacgccgtacggtcaacgggaccttacgtaccatacgttaaccacgtacgtagtacgggccgggtgacggcgtaaggcccgganagttacgancacngcncngtcganannnngnnnngnnnnnncnngnnnnc

SEQ ID NO: 128582 - DNA, 500 bp, Homo sapiens
  misc_feature: GYAE6OF02GI01L.37.31.C09.1.454.CMB.1.raw
  modified_base (478)..(500): a, c, t, g, unknown or other
  misc_feature (478)..(500): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagactattccaagagcactctgtatctgcaaatgaacagcctgagtgccgaggacacggccctatattattgtgcgaaatggtggggggagtgggggctactcctggcgttttgactacgtggggccagggagccctggtcaccggtctcctcacgtcctccaaccgaacgggcccaagtccggttaccttccccccgtgggccgtccctcgctccgagggtagcctacctccgagacgtcacgacgccggcccgtcggggcctcggtccgtcggtacaaaggtacctacgttccactctacgactacgtggcgcggctggcaagggcacagtagnnnnnnnnnnnnnnnnnnnnnnn

SEQ ID NO: 128583 - DNA, 589 bp, Homo sapiens
  misc_feature: GYAE6OF02IQUON.37.31.C09.1.454.CMB.1.raw
  modified_base (552)..(552): a, c, t, g, unknown or other
  misc_feature (552)..(552): n is a, c, g, or t
  modified_base (554)..(554): a, c, t, g, unknown or other
  misc_feature (554)..(554): n is a, c, g, or t
  modified_base (557)..(557): a, c, t, g, unknown or other
  misc_feature (557)..(557): n is a, c, g, or t
  modified_base (559)..(559): a, c, t, g, unknown or other
  misc_feature (559)..(559): n is a, c, g, or t
  modified_base (561)..(563): a, c, t, g, unknown or other
  misc_feature (561)..(563): n is a, c, g, or t
  modified_base (566)..(567): a, c, t, g, unknown or other
  misc_feature (566)..(567): n is a, c, g, or t
  modified_base (570)..(572): a, c, t, g, unknown or other
  misc_feature (570)..(572): n is a, c, g, or t
  modified_base (574)..(574): a, c, t, g, unknown or other
  misc_feature (574)..(574): n is a, c, g, or t
  modified_base (576)..(577): a, c, t, g, unknown or other
  misc_feature (576)..(577): n is a, c, g, or t
  modified_base (579)..(589): a, c, t, g, unknown or other
  misc_feature (579)..(589): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtaacgaaaatggcctacggatatgactactattggactggtacttcgatctcgtggggccgtggcaccctggtcactgtcctctcagccctccaccgaacgggcccacgttccggtccttccccccgtcggcccgtccccgtcgtcccttccgagggacgccacccgtcccggagacgaccaccgacggcccggcccggtcgggccttcggtcccgtcgggtaccgtaacgggtaccctttaccttcccgtaacttccgtaaccctaaccgttcgtaacgggacggtccggggtacgtcggggtaccgaaaggggccctaacgtaacgtaagcgtacncncgncngnnngcnngcnnncngnncnnnnnnnnnnn

SEQ ID NO: 128584 - DNA, 624 bp, Homo sapiens
  misc_feature: GYAE6OF02JTM22.37.31.C09.1.454.CMB.1.raw
  modified_base (138)..(138): a, c, t, g, unknown or other
  misc_feature (138)..(138): n is a, c, g, or t
  modified_base (306)..(306): a, c, t, g, unknown or other
  misc_feature (306)..(306): n is a, c, g, or t
  modified_base (344)..(344): a, c, t, g, unknown or other
  misc_feature (344)..(344): n is a, c, g, or t
  modified_base (374)..(374): a, c, t, g, unknown or other
  misc_feature (374)..(374): n is a, c, g, or t
  modified_base (526)..(526): a, c, t, g, unknown or other
  misc_feature (526)..(526): n is a, c, g, or t
  modified_base (536)..(536): a, c, t, g, unknown or other
  misc_feature (536)..(536): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatcncagagacattccaagaacaccctgtctctgctaaatgaacaacctagagagccgaggacgacggccctatattacgtgtaacgaaaatggacctacggtatatgactatagttgggactggtacttcgatcctcggtgggccgtggccaccgtgtcgactgtcctccncacgtcctccgacacggccccagtccggtccttcccgnggtccgtcccgtcgcctcgaacgacgtccnccgtacggacggtacaccaggtacgcccggtccgtacgggtactcggtccgttacggaccggaacgtccttaccgtccctacgttaacctaccgtaactacggcgtacggtcccggggctaacggcggaacggtccgacgtaagttaccggntccggtaacncgtcgatagtctacgcgtcgactcgtacgtactgtgtacgtacgtagtcgtacgtacgtacgtcgtcgacgtacgtacgtactgtacg

SEQ ID NO: 128585 - DNA, 603 bp, Homo sapiens
  misc_feature: GYAE6OF02IOUWV.37.31.C09.1.454.CMB.1.raw
  modified_base (190)..(190): a, c, t, g, unknown or other
  misc_feature (190)..(190): n is a, c, g, or t
  modified_base (541)..(541): a, c, t, g, unknown or other
  misc_feature (541)..(541): n is a, c, g, or t
  modified_base (546)..(546): a, c, t, g, unknown or other
  misc_feature (546)..(546): n is a, c, g, or t
  modified_base (554)..(555): a, c, t, g, unknown or other
  misc_feature (554)..(555): n is a, c, g, or t
  modified_base (557)..(557): a, c, t, g, unknown or other
  misc_feature (557)..(557): n is a, c, g, or t
  modified_base (560)..(560): a, c, t, g, unknown or other
  misc_feature (560)..(560): n is a, c, g, or t
  modified_base (563)..(563): a, c, t, g, unknown or other
  misc_feature (563)..(563): n is a, c, g, or t
  modified_base (567)..(567): a, c, t, g, unknown or other
  misc_feature (567)..(567): n is a, c, g, or t
  modified_base (592)..(592): a, c, t, g, unknown or other
  misc_feature (592)..(592): n is a, c, g, or t
  modified_base (598)..(598): a, c, t, g, unknown or other
  misc_feature (598)..(598): n is a, c, g, or t
  modified_base (601)..(601): a, c, t, g, unknown or other
  misc_feature (601)..(601): n is a, c, g, or t
tcagtagtgtagatcacgaccggtgctcgatttagacgtctcatcaaggaaggaagggactggagtgggtctcaggtattgggtggcagtggtgagaccacatactacgcagactccgtgaagggccggttcaccatctccagagacaattccaaagaacaccctgtctctgcaaatgaacaacctgagngccgaggacacggccctatacttactgtaacgaaaagtggacctacggatatgactactattgggactgtacttcgatctcgtggggccgtggcctacccgtggtccacgttcgtcctcctcacgtccctaccaccgaaccgggccagttccggttacccttcccccgtggcccgcccgtagtcccgtaccgaggacggtccacccgtccgacgacgaccacgacggcccggcccgttggggacctcggtccgtggtaccgaaacggtccttaacctccgtaactactaactaccgttacgtacggacggtcgggtacgaggtacgaaccgggacgacgtaagtacgacgncgtancgagcagnngntanagntacnagcgtactacgctacgtcactcgtnctagcncgngc

SEQ ID NO: 128586 - DNA, 581 bp, Homo sapiens
  misc_feature: GYAE6OF02IAP8K.37.31.C09.1.454.CMB.1.raw
  modified_base (312)..(312): a, c, t, g, unknown or other
  misc_feature (312)..(312): n is a, c, g, or t
  modified_base (361)..(361): a, c, t, g, unknown or other
  misc_feature (361)..(361): n is a, c, g, or t
  modified_base (528)..(528): a, c, t, g, unknown or other
  misc_feature (528)..(528): n is a, c, g, or t
  modified_base (539)..(539): a, c, t, g, unknown or other
  misc_feature (539)..(539): n is a, c, g, or t
  modified_base (544)..(544): a, c, t, g, unknown or other
  misc_feature (544)..(544): n is a, c, g, or t
  modified_base (548)..(548): a, c, t, g, unknown or other
  misc_feature (548)..(548): n is a, c, g, or t
  modified_base (551)..(551): a, c, t, g, unknown or other
  misc_feature (551)..(551): n is a, c, g, or t
  modified_base (553)..(553): a, c, t, g, unknown or other
  misc_feature (553)..(553): n is a, c, g, or t
  modified_base (557)..(557): a, c, t, g, unknown or other
  misc_feature (557)..(557): n is a, c, g, or t
  modified_base (559)..(559): a, c, t, g, unknown or other
  misc_feature (559)..(559): n is a, c, g, or t
  modified_base (561)..(562): a, c, t, g, unknown or other
  misc_feature (561)..(562): n is a, c, g, or t
  modified_base (566)..(567): a, c, t, g, unknown or other
  misc_feature (566)..(567): n is a, c, g, or t
  modified_base (572)..(573): a, c, t, g, unknown or other
  misc_feature (572)..(573): n is a, c, g, or t
  modified_base (575)..(576): a, c, t, g, unknown or other
  misc_feature (575)..(576): n is a, c, g, or t
  modified_base (579)..(579): a, c, t, g, unknown or other
  misc_feature (579)..(579): n is a, c, g, or t
  modified_base (581)..(581): a, c, t, g, unknown or other
  misc_feature (581)..(581): n is a, c, g, or t
tcagtagtgtagatcacgaccggtgctcgattttagacgtctcatcaaggaaggaagggactggagtgggtctcaggtattggtggcagtggtgagaccacatactacgcagactccgtgaagggccgttcaccatctccagagacaattccaagaacaccctgtctctgacaatgaacaacctgagagcgagacacggcctatacttactgtaacgaaaagtggaccgtacgatagtagaactactagttggaactggtacttcgattctcgtggaccggtggccacctggtctactgtcttccgtccganccctccaccgaacgggcccgtaacgtcgttacccttcccccgtcggccnccccgtcgtccgtcgacggagccgtaccctccccgagacgcacgacgccgaccgtcgggctcgccgtggtaccgaacgacgttacctccgtaacttacctaacacttacgtaggtacggaccgggtacgtgggtaaccgacgggaccgtaacgacgttacgagaccncgcacgcagtncgcgngcgngananacgngngnncgtnngtcgnngnngangn

SEQ ID NO: 128587 - DNA, 574 bp, Homo sapiens
  misc_feature: GYAE6OF02G5PPB.37.31.C09.1.454.CMB.1.raw
  modified_base (353)..(353): a, c, t, g, unknown or other
  misc_feature (353)..(353): n is a, c, g, or t
  modified_base (359)..(359): a, c, t, g, unknown or other
  misc_feature (359)..(359): n is a, c, g, or t
  modified_base (395)..(395): a, c, t, g, unknown or other
  misc_feature (395)..(395): n is a, c, g, or t
  modified_base (544)..(544): a, c, t, g, unknown or other
  misc_feature (544)..(544): n is a, c, g, or t
  modified_base (548)..(574): a, c, t, g, unknown or other
  misc_feature (548)..(574): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaagaacaccctgtctctgacaaatgaacaacctgagagccgaggacacggccctatatactgtaacgaaaatggacctacggatatgactactagttgggactggtacttcgatctcgtggggccgtggccaccctggtacacttgtcctcctcacgtccctaccaccgaacgggccctacgtccggttcccttcccccgnggcccncccgtcgcctcccgaggtcgccctaccgtcgacgcnccgaaccgacgggcccgggtacccggtgggtcctccggtccggtacgggtaccgtaaacggtacccttaccgttaccacgtttaccctaaccgtccgtacgtacgggacggtcccgggacgtaccggacggaacggtccgacgtaacgngctnnnnnnnnnnnnnnnnnnnnnnnnnnn

SEQ ID NO: 128588 - DNA, 541 bp, Homo sapiens
  misc_feature: GYAE6OF02GUS5V.37.31.C09.1.454.CMB.1.raw
  modified_base (379)..(379): a, c, t, g, unknown or other
  misc_feature (379)..(379): n is a, c, g, or t
  modified_base (506)..(506): a, c, t, g, unknown or other
  misc_feature (506)..(506): n is a, c, g, or t
  modified_base (509)..(511): a, c, t, g, unknown or other
  misc_feature (509)..(511): n is a, c, g, or t
  modified_base (514)..(514): a, c, t, g, unknown or other
  misc_feature (514)..(514): n is a, c, g, or t
  modified_base (516)..(541): a, c, t, g, unknown or other
  misc_feature (516)..(541): n is a, c, g, or t
tcagtagtgtagatcacgaccggtgctcgatttagacgtctcatcaaggaaggaagggactggagtgggtctcaggtattggtggcagtggtgagaccacatactacgcagactccgtgaagggccggttcaccatctccagagacaattccaagaacaccctgtctctgcaaatgaacaacctgagagccgaggacaccggccctatattactgtaacgaaaatggacctacggatatgactactattgggactggtacttcgattctcgtcggggccgtcggtacccgtggtcactgtcctcctcacgccctaccaaccgaacgggccccagttcccggtcctttcccccgtcgggccctccctcgcctcgacggcnccacccgtcgagcgacacgacggccggcccgtgggcctcggccgtgggtaccgaaggtaccttacttaccatacctaactactacgtaggacggcgggtacgtcgggacgaacgggcacgtataggntgnnngancnnnnnnnnnnnnnnnnnnnnnnnnnn

SEQ ID NO: 128589 - DNA, 181 bp, Homo sapiens
  misc_feature: GYAE6OF01A929O.11.39.D06.1.454.CMB.1.raw
  modified_base (180)..(181): a, c, t, g, unknown or other
  misc_feature (180)..(181): n is a, c, g, or t
tcagcgagagataccacgaccggtgctcgatttagtgacatctcgcagttctttgggtttgtgggaagaggaagactgacggtcccccaggagttcaggtgctgggcacagcggccctgggctgcctggtcaaggactacttccgtatctctcgctgagcgggctggcaaggcgcatagnn

SEQ ID NO: 128590 - DNA, 226 bp, Homo sapiens
  misc_feature: GYAE6OF01CNM5L.11.39.D06.1.454.CMB.1.raw
  modified_base (196)..(196): a, c, t, g, unknown or other
  misc_feature (196)..(196): n is a, c, g, or t
  modified_base (202)..(226): a, c, t, g, unknown or other
  misc_feature (202)..(226): n is a, c, g, or t
tcagcgagagataccacgaccggtgctcgatttagtgacatctcgcgtaggttctttggggtttagggggaagaggaagactgaccggtccccccgaggagttcgaggtgcgtgggcacgaggccggcccgtgggctgcccttggtacgaaggtacttacgttccgtatctctcgctgagcgggctggacaaggcncatagnnnnnnnnnnnnnnnnnnnnnnnnn

SEQ ID NO: 128591 - DNA, 248 bp, Homo sapiens
  misc_feature: GYAE6OF01B3071.11.39.D06.1.454.CMB.1.raw
  modified_base (189)..(189): a, c, t, g, unknown or other
  misc_feature (189)..(189): n is a, c, g, or t
  modified_base (191)..(248): a, c, t, g, unknown or other
  misc_feature (191)..(248): n is a, c, g, or t
tcagcgagagataccacgaccggtgctcgatttagtgacatctcgctaggtttcgtttgggttttggggggaagagggaagactggacggtccccccaggagttcaggtgctgggcacagcggccctgggctgcctggtcaggactacttccgtatctctcgctgagcgggctggcaaggcgccatagntnnnnnnnnnnnnnnnnnnnnnnnnnnnnnnnnnnnnnnnnnnnnnnnnnnnnnnnnnn

SEQ ID NO: 128592 - DNA, 182 bp, Homo sapiens
  misc_feature: GYAE6OF01BBEDE.11.39.D06.1.454.CMB.1.raw
  modified_base (181)..(182): a, c, t, g, unknown or other
  misc_feature (181)..(182): n is a, c, g, or t
tcagcgagagataccacgaccggtgctcgatttagtgacatctcgcagttctttgggttttgggggaagaggaagactgacggtcccccaggagttcaggtgctgggcacagcggccctgggctgcctggtcaaggactacttccgtatctctcgctgagcgggctggcaaggcgcatagnn

SEQ ID NO: 128593 - DNA, 183 bp, Homo sapiens
  misc_feature: GYAE6OF02IQLEP.11.39.D06.1.454.CMB.1.raw
  modified_base (181)..(183): a, c, t, g, unknown or other
  misc_feature (181)..(183): n is a, c, g, or t
tcagcgagagataccacgaccggtgctcgatttagtgacatctcgcagttctttgggttttgggggaagaggaagactgacggtcccccaggagttcaggtgctgggcacagcggccctgggctgcctggtcaaggactacttccgtatctctcgctgagcgggctggcaaggcgcatagnnn

SEQ ID NO: 128594 - DNA, 194 bp, Homo sapiens
  misc_feature: GYAE6OF02G6LNY.11.39.D06.1.454.CMB.1.raw
  modified_base (183)..(194): a, c, t, g, unknown or other
  misc_feature (183)..(194): n is a, c, g, or t
tcagcgagagataccacgaccggtgctcgatttagtgacatctcgcagttctttgggttttggggggaagaggaagactgacggtccccccaggagttcaggtgctgggcacagcggccctgggctgcctggtcaaggactacttccgtatctctcgctgagcgggctggcaaggcgcatagnnnnnnnnnnnn

SEQ ID NO: 128595 - DNA, 179 bp, Homo sapiens
  misc_feature: GYAE6OF01CCIZK.1.43.D10.1.454.CMB.1.raw
  modified_base (154)..(155): a, c, t, g, unknown or other
  misc_feature (154)..(155): n is a, c, g, or t
  modified_base (157)..(179): a, c, t, g, unknown or other
  misc_feature (157)..(179): n is a, c, g, or t
tcagacgagtgcgtcacgaccggtgctcgatttagactagcagtaagggaagggaccaaggtcggaagtcaaacgactgtggctgcaccagtcctgtcttcactcttcccgccctctcacgtctactctgagcgggctggcaaggccgcatagnngnnnnnnnnnnnnnnnnnnnnnnn

SEQ ID NO: 128596 - DNA, 157 bp, Homo sapiens
  misc_feature: GYAE6OF01D3N43.1.43.D10.1.454.CMB.1.raw
  modified_base (151)..(157): a, c, t, g, unknown or other
  misc_feature (151)..(157): n is a, c, g, or t
tcagacgagtgcgtcacgaccggtgctcgatttagactagcagtaagggaagggaccaaggtggaagtcaaacgaactgtggctgcaccatctgtcttcatcttcccgcctcctcacgtctactgctgagcgggctggcaaggcgcatagnnnnnnn

SEQ ID NO: 128597 - DNA, 154 bp, Homo sapiens
  misc_feature: GYAE6OF01D8BAI.1.43.D10.1.454.CMB.1.raw
  modified_base (153)..(154): a, c, t, g, unknown or other
  misc_feature (153)..(154): n is a, c, g, or t
tcagacgagtgcgtcacgaccggtgctcgatttagactagcagtaagggaaagggaccaaggtggaagtcaaacgaactgtggctgcaccatctgtcttcatcttcccaccctcctcacgcactcgtctgagcgggctggcaaggcgcatagnn

SEQ ID NO: 128598 - DNA, 157 bp, Homo sapiens
  misc_feature: GYAE6OF01B7EA8.1.43.D10.1.454.CMB.1.raw
  modified_base (152)..(157): a, c, t, g, unknown or other
  misc_feature (152)..(157): n is a, c, g, or t
tcagacgagtgcgtcacgaccggtgctcgatttagactagcagtaagggaaagggaccaaggtggaagtcaaacgaactgtggctgcaccatctgtcttcatcttcccaccctcctcacgtctactgcgagcgggctggcaaggcgcatagnnnnnn

SEQ ID NO: 128599 - DNA, 153 bp, Homo sapiens
  misc_feature: GYAE6OF01BDLBN.1.43.D10.1.454.CMB.1.raw
  modified_base (153)..(153): a, c, t, g, unknown or other
  misc_feature (153)..(153): n is a, c, g, or t
tcagacgagtgcgtcacgaccggtgctcgatttagactagcagtaagggaaagggaccaaggtggaagtcaaacgaactgtggctgcaccatctgtcttcatcttcccaccctcctcacgtctactgctgagcgggctggcaaggcgcatagn

SEQ ID NO: 128600 - DNA, 164 bp, Homo sapiens
  misc_feature: GYAE6OF01ARQS2.1.43.D10.1.454.CMB.1.raw
  modified_base (152)..(164): a, c, t, g, unknown or other
  misc_feature (152)..(164): n is a, c, g, or t
tcagacgagtgcgtcacgaccggtgctcgatttagactagcagtaagggaagggaccaaggtggaaatcaaacgaactgtggctgcaccatctgtcttcatcttcccgccatctgaacgcactcgtctgagcgggctggcaaggcgcatagnnnnnnnnnnnnn

SEQ ID NO: 128601 - DNA, 154 bp, Homo sapiens
  misc_feature: GYAE6OF01BGGVN.1.43.D10.1.454.CMB.1.raw
  modified_base (153)..(154): a, c, t, g, unknown or other
  misc_feature (153)..(154): n is a, c, g, or t
tcagacgagtgcgtcacgaccggtgctcgatttagactagcagtaagggaaagggaccaaggtggaagtcaaacgaactgtggctgcaccatctgtcttcatcttcccgccctcctcacgtctactgctgagcgggctggcaaggcgcatagnn

SEQ ID NO: 128602 - DNA, 153 bp, Homo sapiens
  misc_feature: GYAE6OF01C6YDQ.1.43.D10.1.454.CMB.1.raw
  modified_base (153)..(153): a, c, t, g, unknown or other
  misc_feature (153)..(153): n is a, c, g, or t
tcagacgagtgcgtcacgaccggtgctcgatttagactagcagtaagggaaagggaccaaggtggaaatcaaacgaactgtggctgcaccatctgtcttcatcttcccgccctcctcacgcactcgtctgagcgggctggcaaggcgcatagn

SEQ ID NO: 128603 - DNA, 155 bp, Homo sapiens
  misc_feature: GYAE6OF01DOR8F.1.43.D10.1.454.CMB.1.raw
  modified_base (153)..(155): a, c, t, g, unknown or other
  misc_feature (153)..(155): n is a, c, g, or t
tcagacgagtgcgtcacgaccggtgctcgatttagactagcagtaagggaaagggaccaaggtggaagtcaaacgaactgtggctgcaccatctgtcttcatcttcccgccctcctcacgtctactgctgagcgggctggcaaggcgcatagnnn

SEQ ID NO: 128604 - DNA, 176 bp, Homo sapiens
  misc_feature: GYAE6OF01B7EAF.1.43.D10.1.454.CMB.1.raw
  modified_base (134)..(134): a, c, t, g, unknown or other
  misc_feature (134)..(134): n is a, c, g, or t
  modified_base (155)..(176): a, c, t, g, unknown or other
  misc_feature (155)..(176): n is a, c, g, or t
tcagacgagtgcgtcacgaccggtgctcgatttagactagcagtaagggaaaggggaccaaggtggaagtcgaaacgaactgtggctgcaccatctgtcttcatcttcccgccctcctcacgtctactgctgancgggctggcaaggcgcatagnnnnnnnnnnnnnnnnnnnnnn

SEQ ID NO: 128605 - DNA, 152 bp, Homo sapiens
  misc_feature: GYAE6OF01D1HNG.1.43.D10.1.454.CMB.1.raw
  modified_base (149)..(152): a, c, t, g, unknown or other
  misc_feature (149)..(152): n is a, c, g, or t
tcagacgagtgcgtcacgaccggtgctcgatttagactagcagtaagggaaagggaccaaggtggaagtcaaacgaactgtggctgcaccatctgtcttcatcttcccacctcctcacgtctgctgagcgggctggcaaggcgcatagnnnn

SEQ ID NO: 128606 - DNA, 178 bp, Homo sapiens
  misc_feature: GYAE6OF01CFX4K.1.43.D10.1.454.CMB.1.raw
  modified_base (146)..(146): a, c, t, g, unknown or other
  misc_feature (146)..(146): n is a, c, g, or t
  modified_base (152)..(178): a, c, t, g, unknown or other
  misc_feature (152)..(178): n is a, c, g, or t
tcagacgagtgcgtcacgaccggtgctcgatttagactagcagtaagggaaagggaccaaggtggaagtcaaacgaactgtggctgcaccatctgtcttcatcttcccgccctctcacgtctactgctgagcgggctggcaaggcncatagnnnnnnnnnnnnnnnnnnnnnnnnnnn

SEQ ID NO: 128607 - DNA, 164 bp, Homo sapiens
  misc_feature: GYAE6OF01E4YC0.1.43.D10.1.454.CMB.1.raw
  modified_base (147)..(147): a, c, t, g, unknown or other
  misc_feature (147)..(147): n is a, c, g, or t
  modified_base (153)..(164): a, c, t, g, unknown or other
  misc_feature (153)..(164): n is a, c, g, or t
tcagacgagtgcgtcacgaccggtgctcgatttagactagcagtaagggaaagggaccaaggtggaaatcaaacgaactgtggctgcaccatctgtcttcatcttcccaccctcctcacgcactcgtctgagcgggctggcaaggcncatagnnnnnnnnnnnn

SEQ ID NO: 128608 - DNA, 152 bp, Homo sapiens
  misc_feature: GYAE6OF02GI0X5.1.43.D10.1.454.CMB.1.raw
tcagacgagtgcgtcacgaccggtgctcgatttagactagcagtaagggaaagggaccaaggtggaagtcaaacgaactgtggctgcaccatctgtcttcatcttcccgccctcctcacgtctactgctgagcgggctggcaaggcgcatag

SEQ ID NO: 128609 - DNA, 155 bp, Homo sapiens
  misc_feature: GYAE6OF02H63F8.1.43.D10.1.454.CMB.1.raw
  modified_base (153)..(155): a, c, t, g, unknown or other
  misc_feature (153)..(155): n is a, c, g, or t
tcagacgagtgcgtcacgaccggtgctcgatttagactagcagtaagggaaagggaccaaggtggaagtcaaacgaactgtggctgcaccatctgtcttcatcttcccaccctcctcacgtctactgctgagcgggctggcaaggcgcatagnnn

SEQ ID NO: 128610 - DNA, 155 bp, Homo sapiens; identical to SEQ ID NO: 128609
  misc_feature: GYAE6OF02FXAQ0.1.43.D10.1.454.CMB.1.raw
  modified_base (153)..(155): a, c, t, g, unknown or other
  misc_feature (153)..(155): n is a, c, g, or t

SEQ ID NO: 128611 - DNA, 153 bp, Homo sapiens; identical to SEQ ID NO: 128602
  misc_feature: GYAE6OF02G8UXM.1.43.D10.1.454.CMB.1.raw
  modified_base (153)..(153): a, c, t, g, unknown or other
  misc_feature (153)..(153): n is a, c, g, or t

SEQ ID NO: 128612 - DNA, 154 bp, Homo sapiens
  misc_feature: GYAE6OF02IKOJT.1.43.D10.1.454.CMB.1.raw
  modified_base (153)..(154): a, c, t, g, unknown or other
  misc_feature (153)..(154): n is a, c, g, or t
tcagacgagtgcgtcacgaccggtgctcgatttagactagcagtaagggaaagggaccaaggtggaaatcaaacgaactgtggctgcaccatctgtcttcatcttcccgccatctgaacgcactcgtctgagcgggctggcaaggcgcatagnn

SEQ ID NO: 128613 - DNA, 155 bp, Homo sapiens
  misc_feature: GYAE6OF02HHKKY.1.43.D10.1.454.CMB.1.raw
  modified_base (153)..(155): a, c, t, g, unknown or other
  misc_feature (153)..(155): n is a, c, g, or t
tcagacgagtgcgtcacgaccggtgctcgatttagactagcagtaagggaaagggaccaaggtggaaatcaaacgaactgtggctgcaccatctgtcttcatcttcccgccatctgaacgcactcgtctgagcgggctggcaaggcgcatagnnn

SEQ ID NO: 128614 - DNA, 179 bp, Homo sapiens
  misc_feature: GYAE6OF02FI5Z1.1.43.D10.1.454.CMB.1.raw
  modified_base (158)..(179): a, c, t, g, unknown or other
  misc_feature (158)..(179): n is a, c, g, or t
tcagacgagtgcgtcacgaccggtgctcgatttagactagcagtaagggaagggaccaaggtcggaaggtcaaacgaactgtggctgcaccagtcctgtcttcactcttcccgccctcctcacgtctactctcgagcgggctggcaaggcgcgatagnnnnnnnnnnnnnnnnnnnnnn

SEQ ID NO: 128615 - DNA, 154 bp, Homo sapiens
  misc_feature: GYAE6OF02GD8WH.1.43.D10.1.454.CMB.1.raw
  modified_base (153)..(154): a, c, t, g, unknown or other
  misc_feature (153)..(154): n is a, c, g, or t
tcagacgagtgcgtcacgaccggtgctcgatttagactagcagtaagggaaagggaccaaggtggaagtcaaacgaactgtggctgcaccatctgtcttcatcttcccaccctcctcacgtctactgctgagcgggctggcaaggcgcatagnn

SEQ ID NO: 128616 - DNA, 154 bp, Homo sapiens; identical to SEQ ID NO: 128612
  misc_feature: GYAE6OF02FP3ES.1.43.D10.1.454.CMB.1.raw
  modified_base (153)..(154): a, c, t, g, unknown or other
  misc_feature (153)..(154): n is a, c, g, or t

SEQ ID NO: 128617 - DNA, 154 bp, Homo sapiens; identical to SEQ ID NO: 128612
  misc_feature: GYAE6OF02FVSJ9.1.43.D10.1.454.CMB.1.raw
  modified_base (153)..(154): a, c, t, g, unknown or other
  misc_feature (153)..(154): n is a, c, g, or t

SEQ ID NO: 128618 - DNA, 181 bp, Homo sapiens
  misc_feature: GYAE6OF02GEVJO.1.43.D10.1.454.CMB.1.raw
  modified_base (151)..(181): a, c, t, g, unknown or other
  misc_feature (151)..(181): n is a, c, g, or t
tcagacgagtgcgtcacgaccggtgctcgatttagactagcagtaagggaaagggaccaaggtggaagtcaaacgaactgtggctgcaccatctgtcttcatcttcccgccctctcacgtctactgctgagcggctggcaaggcgcatagnnnnnnnnnnnnnnnnnnnnnnnnnnnnnnn

SEQ ID NO: 128619 - DNA, 163 bp, Homo sapiens
  misc_feature: GYAE6OF02F4FZZ.1.43.D10.1.454.CMB.1.raw
  modified_base (152)..(163): a, c, t, g, unknown or other
  misc_feature (152)..(163): n is a, c, g, or t
tcagacgagtgcgtcacgaccggtgctcgatttagactagcagtaagggaagggaccaaggtggaagtcaaacgaactgtggctgcaccatctgtcttcatcttcccgccatctgaacgcactcgtctgagcgggctggcaaggcgcatagnnnnnnnnnnnn

SEQ ID NO: 128620 - DNA, 551 bp, Homo sapiens
  misc_feature: GYAE6OF01DMQMA.19.45.E01.1.454.CMB.1.raw
  modified_base (518)..(518): a, c, t, g, unknown or other
  misc_feature (518)..(518): n is a, c, g, or t
  modified_base (520)..(551): a, c, t, g, unknown or other
  misc_feature (520)..(551): n is a, c, g, or t
tcagtactctcgtgcacgaccggtgctcgatttagtgagtcagtaagggaaaggggactgggagtgggtttcatacattagtagtagtagtagcaccatatactacgcagactctgtgaagggccgattcaccatctccagagacaatgccaagaacttcactgtatctgacaaatgaacagcctggagagccggaggacacggctggtgtattactgtgcgagaacgtaggatacgtccgggagggcccgtcttttgactacggtcggggccgacgggtaaccctggtacctaccggttcctccgtcacgtccctaccaaccgaacggggcccctagtcccggttcccttcccccgtggcccgccgtcgcctcgaggcgccacctaccgagacgcaacgacggacccggacccgtgggacctcggcctagggttaccaaacgggtacctaccgtcccgaagacgtacgtacctggaccgggcggggtcctagggaaccgtaacgggcgactagacgnannnnnnnnnnnnnnnnnnnnnnnnnnnnnnnn

SEQ ID NO: 128621 - DNA, 538 bp, Homo sapiens
  misc_feature: GYAE6OF01AXOOJ.19.45.E01.1.454.CMB.1.raw
  modified_base (503)..(507): a, c, t, g, unknown or other
  misc_feature (503)..(507): n is a, c, g, or t
  modified_base (509)..(538): a, c, t, g, unknown or other
  misc_feature (509)..(538): n is a, c, g, or t
tcagtactctcgtgcacgaccggtgctcgatttagtgagtcagtaagggaaagggactggagtgggtttcatacattagtagtagtagtagcaccatatactacgcagactctgtgaagggccgattcaccatctccagagacaatgccaagaactcactgtatctgcaaatgaacagcctgagagccgaggacacggctgtgtattactgtgcgagaactaggatacgtccggggaggccgtcttttgactacgtggggccgacgggaaccctggtccaccgtcctcctcacgccctccaccgaacgggccccagtccggtcccttcccccgtcgggcccgcccgtcgcctcccgacgggacgcccaccctccggagacgccacgacggcccggcccgtgggctcgccgtcggtccgaaacggtaccttaccgttcccgacgtagtacgtacgtggacgggccggggcgtcggaccgaaagggccgacgtaagtaggcacgnnnnngnnnnnnnnnnnnnnnnnnnnnnnnnnnnnn

SEQ ID NO: 128622 - DNA, 621 bp, Homo sapiens
  misc_feature: GYAE6OF01DRIIV.19.45.E01.1.454.CMB.1.raw
  modified_base (327)..(327): a, c, t, g, unknown or other
  misc_feature (327)..(327): n is a, c, g, or t
  modified_base (383)..(383): a, c, t, g, unknown or other
  misc_feature (383)..(383): n is a, c, g, or t
  modified_base (577)..(578): a, c, t, g, unknown or other
  misc_feature (577)..(578): n is a, c, g, or t
  modified_base (581)..(581): a, c, t, g, unknown or other
  misc_feature (581)..(581): n is a, c, g, or t
  modified_base (583)..(583): a, c, t, g, unknown or other
  misc_feature (583)..(583): n is a, c, g, or t
  modified_base (592)..(592): a, c, t, g, unknown or other
  misc_feature (592)..(592): n is a, c, g, or t
  modified_base (597)..(597): a, c, t, g, unknown or other
  misc_feature (597)..(597): n is a, c, g, or t
  modified_base (599)..(600): a, c, t, g, unknown or other
  misc_feature (599)..(600): n is a, c, g, or t
  modified_base (604)..(606): a, c, t, g, unknown or other
  misc_feature (604)..(606): n is a, c, g, or t
  modified_base (608)..(610): a, c, t, g, unknown or other
  misc_feature (608)..(610): n is a, c, g, or t
  modified_base (615)..(618): a, c, t, g, unknown or other
  misc_feature (615)..(618): n is a, c, g, or t
  modified_base (620)..(621): a, c, t, g, unknown or other
  misc_feature (620)..(621): n is a, c, g, or t
tcagtactctcgtgcacgaccggtgctcgatttagtgagtcagtaagggaaagggactggagtgggtttcatacattagtagtagtagtagcaccatatactacgcagactctgtgaagggccgattcaccatcctaccagagacaatgaccaagaactcactgtatctgcaaatgaacagcctagagagccgaagacgacgctgtagttattacgtggtacgcgaagaaacgttaggacttcggaccggggtacgccgttacttttgaccgtacggtcggggaccgtaagggtaaccccgtggtacctacccgttacctccctacnccggtaccctaccgaaccgaacgggccctacgttcccggttccctttccccccggnggtcccgtccctggtacctaccccggaaggaccgtacccgtaccctaccggagtaccgacgtaaccgacggcccgggtccggtcggctcgaccggtgacgtaaaccggtcctaccgtacccgaaggacgtacgtacgtacggccgggcgggacgtacgaacggtaggaccgtagtcgtaaggcagctagctaanngangntcgcgcagnctgcncnncgcnnncnnncgtcnnnngnn

SEQ ID NO: 128623 - DNA, 709 bp, Homo sapiens
  misc_feature: GYAE6OF01AIB1E.19.45.E01.1.454.CMB.1.raw
  modified_base (671)..(671): a, c, t, g, unknown or other
  misc_feature (671)..(671): n is a, c, g, or t
  modified_base (678)..(709): a, c, t, g, unknown or other
  misc_feature (678)..(709): n is a, c, g, or t
tcagtactctcgtgcacgaccggtgctcgatttagtgagtcagtaagggaaagggactggagtgggtttcatacattagtagtagtagtagcaccatatactacgcagactctgtgaacgggccgattcaccatctccagagacaatgccaagaactcactgtatctgacaaatgaaacagcctgagaggccgaggaccacggctgtgttattctgtgcgagaacgtaggatacggtccggggagggtcccgtcgtttttaggaccgttacggtcgggggacccgtaacgggggtaaccccttcgggtcctaacccggttccttcccgtacctacggccccttaccccgtaaccccgaaacccgggggtccccctaacggttccccgggttccccgtttcccccccgtggggccccggtccccgtcggtccccgttacccggaacgggaccgttaccccgaccccgtttacccgggaacgtaccgggacccaaaccggaccgggccccgggttcccccggtagggggtcccgttccggtcccggttacggggttaaaccggtaaaccgggttacccgtttaaaccccgtttaccccggaacggtaaacgggtaccgttacggtacgggacgggtccgggcgttagggaccggtaagggccgtacgagtacngactgcnnnnnnnnnnnnnnnnnnnnnnnnnnnnnnnn

SEQ ID NO: 128624 - DNA, 517 bp, Homo sapiens
  misc_feature: GYAE6OF02FMU7B.19.45.E01.1.454.CMB.1.raw
  modified_base (483)..(483): a, c, t, g, unknown or other
  misc_feature (483)..(483): n is a, c, g, or t
  modified_base (485)..(517): a, c, t, g, unknown or other
  misc_feature (485)..(517): n is a, c, g, or t
tcagtactctcgtgcacgaccggtgctcgatttagtgagtcagtaagggaaagggactggagtgggtttcatacattagtagtagtagtagcaccatatactacgcagactctgtgaagggccgattcaccatctccagagacaatgccaagaactcactgtatctgcaaatgaacagcctgagagccgaggacacggctgtgtattactgtgcgagaactaggatatccggggagggccgcttttgactactggggccagggaaccctggtcaccgtctcctcagcctccaccacgggcccagtccggtccttcccccgtggccgccctgcctccaggacgccaccctccggagacggcacgaggccgggcccctggggcctcgccgtgggtccaaacgggtaccttaccgttccccgaacgaggtacgttaaccgtggaaggccggggcttcgggaccgaaagggccggccaagtacggangnnnnnnnnnnnnnnnnnnnnnnnnnnnnnnnnn

SEQ ID NO: 128625 - DNA, 667 bp, Homo sapiens
  misc_feature: GYAE6OF02I44DL.19.45.E01.1.454.CMB.1.raw
  modified_base (579)..(579): a, c, t, g, unknown or other
  misc_feature (579)..(579): n is a, c, g, or t
  modified_base (582)..(582): a, c, t, g, unknown or other
  misc_feature (582)..(582): n is a, c, g, or t
  modified_base (586)..(586): a, c, t, g, unknown or other
  misc_feature (586)..(586): n is a, c, g, or t
  modified_base (588)..(588): a, c, t, g, unknown or other
  misc_feature (588)..(588): n is a, c, g, or t
  modified_base (591)..(591): a, c, t, g, unknown or other
  misc_feature (591)..(591): n is a, c, g, or t
  modified_base (595)..(595): a, c, t, g, unknown or other
  misc_feature (595)..(595): n is a, c, g, or t
  modified_base (609)..(609): a, c, t, g, unknown or other
  misc_feature (609)..(609): n is a, c, g, or t
  modified_base (615)..(615): a, c, t, g, unknown or other
  misc_feature (615)..(615): n is a, c, g, or t
tcagtactctcgtgcacgaccggtgctcgatttagtgagtcagtaagggaaagggactggagtgggtttcatacattagtagtagtagtagcaccatatactacgcagactctgtgaagggccgattcaccatctccagagacaatgccaagaactcactgtatcctgcaaatgaacagcctgagacgccgaaggacacggctagtgtattactggtgcgagaacgtaggactaggtccggggacgggccttacgttttcgaacgtacgtcggggaccgaacggggtaaccctgggtaccgaccgttcctacccgttacacgtcccctacccgaaccgtaaccggggaccccttaggttcccggtttaccccgttcccccggtcgggcccccgtacccgtccggtacccgtccggaacgggtaccgaccctaccccggtaccgaaacggaccgaccgtaacgaccgggtccccgggcccgttagggcctcggtaccgtacggtacgacgtaacctccgttacccgacgtaggtcgtaacgcggacggcggccgtaggacgacggaacgccttaagcggnacngacnancgntcgntacgactagctgcncgcgtnagacagcgtctacgtacgtacgtacgtacgtacgtctagtagcgacgagtcg

SEQ ID NO: 128626 - DNA, 287 bp, Homo sapiens
  misc_feature: GYAE6OF01BHMPM.44.6.A06.1.454.CMB.1.raw
  modified_base (285)..(287): a, c, t, g, unknown or other
  misc_feature (285)..(287): n is a, c, g, or t
tcagacagtatatacacgaccggtgctcgatttagatctactgacagggtcactggcaccccagacaggttcagtggcagtgggtctgggacagacttcactctcaccgtcagcaatgtacagcctgaagattttgcagtttattactgtcagcagcgttcctccaggccgctcactttcggcgggggaccaaggtggagatcagacgaactgtggctgcaccatctgtcttcatcttccgccatctgatatatactgtctgagcgggctggcaaggcgcatagnnn

SEQ ID NO: 128627 - DNA, 213 bp, Homo sapiens
  misc_feature: GYAE6OF01A9L18.44.6.A06.1.454.CMB.1.raw
  modified_base (182)..(213): a, c, t, g, unknown or other
  misc_feature (182)..(213): n is a, c, g, or t
tcagacagtatatacacgaccggtgctcgatttagatctactgacaacgactacaagggcccatcggtcttcccctggcgccctgctccaggagacacctctggggcacagcggccctgggctgcctggtccaaggactacttcctcgactcgcgtctgagcgggctggcaaggcgcatagnnnnnnnnnnnnnnnnnnnnnnnnnnnnnnnn

SEQ ID NO: 128628 - DNA, 287 bp, Homo sapiens
  misc_feature: GYAE6OF01BJWUA.44.6.A06.1.454.CMB.1.raw
  modified_base (283)..(287): a, c, t, g, unknown or other
  misc_feature (283)..(287): n is a, c, g, or t
tcagacagtatatacacgaccggtgctcgatttagatctactgacagggtcactggcaccccagacaggttcagtggcagtgggtctgggacagacttcactctcaccgtcagcaatgtacagcctgaagattttgcagtttattactgtcagcagcgttcctccaggccgctcactttcggcgggggaccaaggtggagatcagacgaactgtggctgcaccatctgtcttcatcttccgcatctgatatatactgtctgagcggctggcaaggcgcatagnnnnn

SEQ ID NO: 128629 - DNA, 233 bp, Homo sapiens
  misc_feature: GYAE6OF01C6Z5S.44.6.A06.1.454.CMB.1.raw
  modified_base (182)..(187): a, c, t, g, unknown or other
  misc_feature (182)..(187): n is a, c, g, or t
  modified_base (189)..(233): a, c, t, g, unknown or other
  misc_feature (189)..(233): n is a, c, g, or t
tcagacagtatatacacgaccggtgctcgatttagatctactgacaacgactacaagggcccatcggtcttcccctggcgccctgctccaggagacaccctctggggcacagcggccctgggctgcctggtcaaggactacttcctcgactcgcgtctgagcgggctggcaaggcgcatagnnnnnncnnnnnnnnnnnnnnnnnnnnnnnnnnnnnnnnnnnnnnnnnnnnn

SEQ ID NO: 128630 - DNA, 290 bp, Homo sapiens
  misc_feature: GYAE6OF01DM6GF.44.6.A06.1.454.CMB.1.raw
  modified_base (287)..(290): a, c, t, g, unknown or other
  misc_feature (287)..(290): n is a, c, g, or t
tcagacagtatatacacgaccggtgctcgatttagatctactgacagggtcactggcaccccagacaggttcagtggcagtgggtctgggacagacttcactctcaccgtcagcaatgtacagcctgaagattttgcagtttattactgtcagcagcgttcctccaggccgctcacgtttcggcgggggaccaaggtggagatcagacgaactgtggctgcaccatctgtcttcactcttccgccatctgatatatactgtctgagcgggctggcaaggcgcatagnnnn

SEQ ID NO: 128631 - DNA, 288 bp, Homo sapiens
  misc_feature: GYAE6OF01EGDUO.44.6.A06.1.454.CMB.1.raw
  modified_base (284)..(288): a, c, t, g, unknown or other
  misc_feature (284)..(288): n is a, c, g, or t
tcagacagtatatacacgaccggtgctcgatttagatctactgacagggtcactggcaccccagacaggttcagtggcagtgggtctgggacagacttcactctcaccgtcagcaatgtacagcctgaagattttgcagtttattactgtcagcagcgttcctccaggccgctcactttcggcgggggaccaaggtggagatcagacgaactgtggctgcaccatctgtcttcatcttcccgcatctgatatatactgtctgagcggctggcaaggcgcatagnnnnn

SEQ ID NO: 128632 - DNA, 292 bp, Homo sapiens
  misc_feature: GYAE6OF01BHSHE.44.6.A06.1.454.CMB.1.raw
  modified_base (284)..(292): a, c, t, g, unknown or other
  misc_feature (284)..(292): n is a, c, g, or t
tcagacagtatatacacgaccggtgctcgatttagatctactgacagggtcactggcaccccagacaggttcagtggcagtgggtctgggacagacttcactctcaccgtcagcaatgtacagcctgaagattttgctagtttattactgtcagcagcgttcctccaggccgctcactttcggcgggggaccaaggtggagatcagacgaactgtggctgcaccatctgtcttcatcttccgcatctgatatatactgtctgagcggctggcaaggcgcatagnnnnnnnnn

SEQ ID NO: 128633 - DNA, 354 bp, Homo sapiens
  misc_feature: GYAE6OF01ECCLN.44.6.A06.1.454.CMB.1.raw
  modified_base (268)..(268): a, c, t, g, unknown or other
  misc_feature (268)..(268): n is a, c, g, or t
  modified_base (283)..(283): a, c, t, g, unknown or other
  misc_feature (283)..(283): n is a, c, g, or t
  modified_base (304)..(304): a, c, t, g, unknown or other
  misc_feature (304)..(304): n is a, c, g, or t
  modified_base (307)..(309): a, c, t, g, unknown or other
  misc_feature (307)..(309): n is a, c, g, or t
  modified_base (311)..(354): a, c, t, g, unknown or other
  misc_feature (311)..(354): n is a, c, g, or t
tcagacagtatatacacgaccggtgctcgatttagatctactgacagggtcactggcaccccagacaggttcagtggcagtgggtctgggacagacttcactctcaccgtcagcaatgtacagcctgaagatttttgcagttttattactgtcagcagtatagtgactggcctccgttcacttttcggccctgggaccacagtccgatttcaaacgactgtggctgccaccatctgtcttcattcttcccgctatctgattatatacngttctggacgcgggntcgggcaagggcgactatagntgnnntnnnnnnnnnnnnnnnnnnnnnnnnnnnnnnnnnnnnnnnnnnnn

SEQ ID NO: 128634 - DNA, 307 bp, Homo sapiens
  misc_feature: GYAE6OF01AL53S.44.6.A06.1.454.CMB.1.raw
  modified_base (292)..(307): a, c, t, g, unknown or other
  misc_feature (292)..(307): n is a, c, g, or t
tcagacagtatatacacgaccggtgctcgatttagatctactgacagggtcactggcaccccagacaggttcagtggcagtgggtctgggacagacttcactctcaccgtcagcaatgtacagcctgaagattttgctagttttattactgtcagcagcgttcctcaggccgctcacgtttcggcgggggaccaaggtggagatcagacgaacgtgtggctgcaccatctgtcttcacttttcccgctatcctgatatatactgtctgacgcggctggcaaggcgcagtagnnnnnnnnnnnnnnnn

SEQ ID NO: 128635 - DNA, 293 bp, Homo sapiens
  misc_feature: GYAE6OF01CCF8T.44.6.A06.1.454.CMB.1.raw
  modified_base (257)..(257): a, c, t, g, unknown or other
  misc_feature (257)..(257): n is a, c, g, or t
  modified_base (281)..(281): a, c, t, g, unknown or other
  misc_feature (281)..(281): n is a, c, g, or t
  modified_base (286)..(293): a, c, t, g, unknown or other
  misc_feature (286)..(293): n is a, c, g, or t
tcagacagtatatacacgaccggtgctcgatttagatctactgacagggtcactggcaccccagacaggttcagtggcagtgggtctgggacagacttcactctcaccatcagcagcctagagcctgagattttgctagtttatgactgtcagcagcgtagcaactggcgatcaccttcggaccaagggcacgactggaagattaaacgactgtggctgcaccatctgtcttcactccttcccgcctatctgatatntactgtctgagcggctggcaaggncatgnnnnnnnn

SEQ ID NO: 128636 - DNA, 351 bp, Homo sapiens
  misc_feature: GYAE6OF02JIOH7.44.6.A06.1.454.CMB.1.raw
  modified_base (294)..(294): a, c, t, g, unknown or other
  misc_feature (294)..(294): n is a, c, g, or t
  modified_base (305)..(305): a, c, t, g, unknown or other
  misc_feature (305)..(305): n is a, c, g, or t
  modified_base (307)..(307): a, c, t, g, unknown or other
  misc_feature (307)..(307): n is a, c, g, or t
  modified_base (317)..(317): a, c, t, g, unknown or other
  misc_feature (317)..(317): n is a, c, g, or t
  modified_base (322)..(323): a, c, t, g, unknown or other
  misc_feature (322)..(323): n is a, c, g, or t
  modified_base (325)..(326): a, c, t, g, unknown or other
  misc_feature (325)..(326): n is a, c, g, or t
  modified_base (328)..(351): a, c, t, g, unknown or other
  misc_feature (328)..(351): n is a, c, g, or t
tcagacagtatatacacgaccggtgctcgatttagatctactgacagggtcactggcacccagacaggttcagtggcagtgggtctgggacaggacttcactctcaccgtcagcaatgtacagcctgaagattttgcagtttatactgtcagcagcgttcctcaggccgctcactttcggcgggggaccaaggtcggagatcgagacgaactgtggctggcaccatcgtgtccttgatcgttccgcattcctgatatatacctgtcctgaggtccgggcttggcccaaaggccncattaggcagntncttgctggangtcgnngnngnnnnnnnnnnnnnnnnnnnnnnnn

SEQ ID NO: 128637 - DNA, 288 bp, Homo sapiens
  misc_feature: GYAE6OF02IUBKL.44.6.A06.1.454.CMB.1.raw
  modified_base (284)..(288): a, c, t, g, unknown or other
  misc_feature (284)..(288): n is a, c, g, or t
tcagacagtatatacacgaccggtgctcgatttagatctactgacagggtcactggcaccccagacaggttcagtggcagtgggtctgggacagacttcactctcaccgtcagcaatgtacagcctgaagattttgcagtttattactgtcagcagcgttcctccaggccgctcactttcggcgggggaccaaggtggagatcaaacgactgtggctgcaccatctgtcttcatcttcccgccatctgatatatactgtctgagcggctggcaaggcgcatagnnnnn

SEQ ID NO: 128638 - DNA, 301 bp, Homo sapiens
  misc_feature: GYAE6OF02FO1BK.44.6.A06.1.454.CMB.1.raw
  modified_base (172)..(172): a, c, t, g, unknown or other
  misc_feature (172)..(172): n is a, c, g, or t
  modified_base (269)..(269): a, c, t, g, unknown or other
  misc_feature (269)..(269): n is a, c, g, or t
  modified_base (281)..(281): a, c, t, g, unknown or other
  misc_feature (281)..(281): n is a, c, g, or t
  modified_base (287)..(301): a, c, t, g, unknown or other
  misc_feature (287)..(301): n is a, c, g, or t
tcagacagtatatacacgaccggtgctcgatttagatctactgacagggtcactggcaccccagacaggttcagtggcagtgggtctgggacagacttcactctcaccgtcagcaatgtacagcctgaagattttgcagtttattactgtcagcagcgttcctccaggccgntcactttcggcgggggaccaaggtggagatcagacgaactgtggctgcaccatctgtcttcatccttccgccatctgatatatactgtctgagcggntggacaaggcgnactagnnnnnnnnnnnnnnn

SEQ ID NO: 128639 - DNA, 526 bp, Homo sapiens
  misc_feature: GYAE6OF01D4ZBF.44.66.F11.1.454.CMB.1.raw
  modified_base (221)..(221): a, c, t, g, unknown or other
  misc_feature (221)..(221): n is a, c, g, or t
  modified_base (491)..(491): a, c, t, g, unknown or other
  misc_feature (491)..(491): n is a, c, g, or t
  modified_base (497)..(526): a, c, t, g, unknown or other
  misc_feature (497)..(526): n is a, c, g, or t
tcagacagtatatacacgaccggtgctcgatttagtcacgcgagaaagggtaaagggggctggtgtgggtctcacgtattaatagtgatgggagtagcacaaggcctacgcggactccgtgaagggcccgattcaccatctccagagacaacgccaagaacacgctagtatctgcaaaatcgaacagtctgacgacgccgaggacacggctgtgtattacngtgcaagagccggtgcgggagttccgggggattgcatactactactacggtatgtacgttactggggtccaaagggaccaacgggtcaaccggtctcccttaccagtctttccaccgaaggggccccatccggtcttcccccctggaccgcccttggacctccgagggacgccaacctcgtgggggccacgaggccgggccctggggcctggcctaggtccaaggaccttacgttcctatactactacgtctgagcgggctggcaaggcnatacgnnnnnnnnnnnnnnnnnnnnnnnnnnnnnn

SEQ ID NO: 128640 - DNA, 156 bp, Homo sapiens
  misc_feature: GYAE6OF02I0K0X.44.66.F11.1.454.CMB.1.raw
  modified_base (150)..(156): a, c, t, g, unknown or other
  misc_feature (150)..(156): n is a, c, g, or t
tcagacagtatatacacgaccggtgctcgatttagtcacgcgagaaggaagggacacgacttgagattaagcgaactgtggctgcaccatctgtcttcatcttcccgccatctgatatatactgtctgagcggctggcaaggcgcatagnnnnnnn

SEQ ID NO: 128641 - DNA, 505 bp, Homo sapiens
  misc_feature: GYAE6OF01EN57E.42.10.A10.1.454.CMB.1.raw
  modified_base (196)..(196): a, c, t, g, unknown or other
  misc_feature (196)..(196): n is a, c, g, or t
tcagtgacgtatgtcacgaccggtgctcgatttagcgtcgatctcagggggaggaactgctcagttaggacccagagggaaccatggaagtcccagctcagcttctcttcctcctgctactctggctcccagatagtaccggagagattgtgttgacacagtatccagccaccctgtctttgtctccaggggaaangccaccctctcctgttgggccagtcagagtattaacaactacttagcctggtaccagcagagacctggccaggctcccaggctcctcatttatgatgcatccaacagggccactggcatcccagccaggttcagtggcagtgggtctgggacagacttcactctcaccatcagcagattagagcctgaagtattttgctagtttactattgtcagcaccgcagcagctcggcccgtcgggtttcggcggagggaccaaggtagagatacaaacgacgtgtggctgcacatctcgtcttcctcccgctac

SEQ ID NO: 128642 - DNA, 842 bp, Homo sapiens
  misc_feature: GYAE6OF01AONUB.42.10.A10.1.454.CMB.1.raw
  modified_base (228)..(228): a, c, t, g, unknown or other
  misc_feature (228)..(228): n is a, c, g, or t
  modified_base (339)..(339): a, c, t, g, unknown or other
  misc_feature (339)..(339): n is a, c, g, or t
tcagtgacgtatgtcacgaccggtgctcgatttagcgtcgatctcagggggaggaactgcctcacgttagggaccctacgaaggggaaccattcggaagttcccgagctcagcttctcttacctcctgctactctggctcccgagtagtagtaccggagagagttttgtgtttgactacctagtaagtcctacgcctacccttgttctttgtctccgaggggtaaagnggccacccggtctccttggttcgggccggtagtcagagtattaacactacttagcctggtaccagtcagagacctcggccaggtctcccctaggcctccgtccactttagngtactgggacgtatccgaaacgtcggggccacgttcgggactacgttccccgaagtccctaaggggttccgaaggtcgggtcgtaacggttcggggttccttacgggggaacctacgggtaacctttcgaacgttccgtacggaccctaagttccgaaggtcctaacggtactttaacggaacgtacccgtaagggtaaacgtaactttttacggaccttaaggttttacctaagtttccgtaactaaggtaccgtaacccggtactaacggtccgtaacggtccggttaccgggggtacccccgggtttacggggtttacccggggaaccgggttaaaccgggtaacccgtaaaaggttcgggtaaacggtacggtaaaccccgtaaaaacgggtaaccgtttcgggtaacgggtacccgttacggacccggtaaaccgttacgggtttaccgggttacggttacccggtttacccggttcgtttcccggttaccccccggg

SEQ ID NO: 128643 - DNA, 536 bp, Homo sapiens
  misc_feature: GYAE6OF01DQ16G.42.10.A10.1.454.CMB.1.raw
  modified_base (196)..(196): a, c, t, g, unknown or other
  misc_feature (196)..(196): n is a, c, g, or t
  modified_base (352)..(352): a, c, t, g, unknown or other
  misc_feature (352)..(352): n is a, c, g, or t
  modified_base (381)..(381): a, c, t, g, unknown or other
  misc_feature (381)..(381): n is a, c, g, or t
  modified_base (417)..(417): a, c, t, g, unknown or other
  misc_feature (417)..(417): n is a, c, g, or t
tcagtgacgtatgtcacgaccggtgctcgatttagcgtcgatctcagggggaggaactgctcagttaggacccagagggaaccatggaagtcccagctcagcttctcttcctcctgctactctggctcccagatagtaccggagagattgtgttgacacagtatccagccaccctgtctttgtctccaggggaaangccaccctctcctgttggccagtcagagtattaacaactacttagcctggtaccagcagagacctggccaggcctcccaggcctcctcatttatgatgaatccaaacagggccactggcactcccagccaggttcagtgcagtggtctggacgganacttcactctcaccatcagcagattaganctagaatatttgctagtttactattgtcagcaccgnacgcagcgtcggcccgttcggttccgggcggacgggaccaaaggtagagtactacgaaaacgtacgtggtcgtctagccacctattccgtcgttaccttactacttccgttccccgacc

SEQ ID NO: 128644 - DNA, 518 bp, Homo sapiens
  misc_feature: GYAE6OF01DGTK0.42.10.A10.1.454.CMB.1.raw
  modified_base (196)..(196): a, c, t, g, unknown or other
  misc_feature (196)..(196): n is a, c, g, or t
  modified_base (287)..(287): a, c, t, g, unknown or other
  misc_feature (287)..(287): n is a, c, g, or t
  modified_base (300)..(300): a, c, t, g, unknown or other
  misc_feature (300)..(300): n is a, c, g, or t
  modified_base (346)..(346): a, c, t, g, unknown or other
  misc_feature (346)..(346): n is a, c, g, or t
  modified_base (505)..(505): a, c, t, g, unknown or other
  misc_feature (505)..(505): n is a, c, g, or t
tcagtgacgtatgtcacgaccggtgctcgatttagcgtcgatctcagggggaggaactgctcagttaggacccagagggaaccatggaagtcccagctcagcttctcttcctcctgctactctggctcccagatagtaccggagagattgtgttgacacagtatccagccaccctgtctttgtctccaggggaaangccacctctcctgttggccagtcagagtattaacaactacttagcctggtaccagcagagacctggccaggctcccaggctcctcatttangatgcatccaacngggccactggcatcccagccaggttcagtgcagtgggtctgggacngacttcactctcaccatcagcagattagagcctgaagtattttgactagtttactattgtctagcaccgtcacgcagcgtcggcccgttcgggttcggcggaggaccaagtagagatacgaaacgacgtgtaggctgactaccagtctacgttcttacncgttccttccccg

SEQ ID NO: 128645 - DNA, 595 bp, Homo sapiens
  misc_feature: GYAE6OF01CHOI1.42.10.A10.1.454.CMB.1.raw
  modified_base (197)..(197): a, c, t, g, unknown or other
  misc_feature (197)..(197): n is a, c, g, or t
  modified_base (292)..(292): a, c, t, g, unknown or other
  misc_feature (292)..(292): n is a, c, g, or t
tcagtgacgtatgtcacgaccggtgctcgatttagcgtcgatctcagggggaggaactgctcagttaggacccagagggaaccatggaagtcccagctcagcttctcttcctcctgctactctggctcccagatagtaccggagagattgtgttgacacagtatccagccaccctgtctttgtctccgaggggaaangcccaccctctcctgttggccagtcagagtattaacaactacttagcctggtaccagcagagacctggccaggctcccgaggcctcctcatttangatgcatccaacgaggccactggcactcccagccaggttcaggtggcaggtgggtctaggggacaggaccttcgactctacaccatccagcagattagagtcctagaagtattttgacttaagtttactagttgtacagcaccgcacgcagtccgtcgggtccccgttcggggtttccggacgggtacgggaaccgtaaaggtacgaagtacgtaaccgaaacggtaaccgtgggtacggacgttcggacccgtaacctacgttccgttacgttaccttacctaccgttccccgttacccccg

SEQ ID NO: 128646 - DNA, 504 bp, Homo sapiens
  misc_feature: GYAE6OF01C061C.42.10.A10.1.454.CMB.1.raw
  modified_base (195)..(195): a, c, t, g, unknown or other
  misc_feature (195)..(195): n is a, c, g, or t
  modified_base (287)..(287): a, c, t, g, unknown or other
  misc_feature (287)..(287): n is a, c, g, or t
  modified_base (490)..(490): a, c, t, g, unknown or other
  misc_feature (490)..(490): n is a, c, g, or t
  modified_base (496)..(496): a, c, t, g, unknown or other
  misc_feature (496)..(496): n is a, c, g, or t
tcagtgacgtatgtcacgaccggtgctcgatttagcgtcgatctcagggggaggaactgctcagttaggacccagagggaaccatggaagtcccagctcagcttctcttcctcctgctactctggctcccagatagtaccggagagattgtgttgacacagtatccagccaccctgtctttgtctccaggggaangccacctctcctgttgggccagtcagagtattaacaactacttagcctggtaccagcagagacctggccaggctcccaggctcctcatttangatgcatccaacagggccactggcatcccagccaggttcaggtgcaggtgggtctgggacagacttcactctcacatcagcagattagagcctgaagtattttgctagtttactattgtcagcaccgcagcagcgtcggcccggttcggttcggcggacggaccgaagtagagactacgaaacgacgtgtggctgcacatctntcttcntcctcccg

SEQ ID NO: 128647 - DNA, 519 bp, Homo sapiens
  misc_feature: GYAE6OF01AQT1G.42.10.A10.1.454.CMB.1.raw
  modified_base (196)..(196): a, c, t, g, unknown or other
  misc_feature (196)..(196): n is a, c, g, or t
  modified_base (505)..(505): a, c, t, g, unknown or other
  misc_feature (505)..(505): n is a, c, g, or t
tcagtgacgtatgtcacgaccggtgctcgatttagcgtcgatctcagggggaggaactgctcagttaggacccagagggaaccatggaagtcccagctcagcttctcttcctcctgctactctggctcccagatagtaccggagagattgtgttgacacagtatccagccaccctgtctttgtctccaggggaaangccaccctctcctgttgggccagtcagagtattaacaactacttagcctggtaccagcagagacctggccaggcctcccaggctcctcatttatgatgcatccaacagggccacgtggccatccccagccaggttcagtcggcagtgggtctgggacagtacttcactctcacatcagcagattagagcctagaagtattttgactaagtttactattgtcagctaccgcacgcacgctcggtcccggtcgggttcggacggacgggaccaaggtagagactacaaacgacgtgtaggctgcacatctntctctatctacccg

SEQ ID NO: 128648 - DNA, 518 bp, Homo sapiens
  misc_feature: GYAE6OF01BIAD1.42.10.A10.1.454.CMB.1.raw
  modified_base (196)..(196): a, c, t, g, unknown or other
  misc_feature (196)..(196): n is a, c, g, or t
  modified_base (289)..(289): a, c, t, g, unknown or other
  misc_feature (289)..(289): n is a, c, g, or t
  modified_base (302)..(302): a, c, t, g, unknown or other
  misc_feature (302)..(302): n is a, c, g, or t
  modified_base (506)..(506): a, c, t, g, unknown or other
  misc_feature (506)..(506): n is a, c, g, or t
tcagtgacgtatgtcacgaccggtgctcgatttagcgtcgatctcagggggaggaactgctcagttaggacccagagggaaccatggaagtcccagctcagcttctcttcctcctgctactctggctcccagatagtaccggagagattgtgttgacacagtatccagccaccctgtctttgtctccaggggaaangccacctctcctgttggccagtcagagtattaacaactacttagcctggtaccagcagagacctggccaggcctcccaggctcctcattttangatgcatccaacngggccactggcatcccagccaggttcagtggcaggtgggtctgggacagacttcactctcaccatccagcagattagagcctagaagtattttgactagtttactattgtacagcaccgcagcagctcggcccgtcggttcggacggaggaccgaagtacgagactagaaaacgtagtgtgctgaccacattcctgttccttcncgttcctacccg

SEQ ID NO: 128649 - DNA, 607 bp, Homo sapiens
  misc_feature: GYAE6OF01ER6FK.42.10.A10.1.454.CMB.1.raw
  modified_base (197)..(197): a, c, t, g, unknown or other
  misc_feature (197)..(197): n is a, c, g, or t
  modified_base (296)..(296): a, c, t, g, unknown or other
  misc_feature (296)..(296): n is a, c, g, or t
  modified_base (409)..(409): a, c, t, g, unknown or other
  misc_feature (409)..(409): n is a, c, g, or t
tcagtgacgtatgtcacgaccggtgctcgatttagcgtcgatctcagggggaggaactgctcagttaggacccagagggaaccatggaagtcccagctcagcttctcttcctcctgctactctggctcccagatagtaccggagagattgtgttgacacagtatccagccaccctgtctttgtctccgaggggaaangcccaccctctcctggttcggccagtcagagtattaacaactacttagcctggtaccagcagacgacctggccaggcctcccgaggcctcctcatttangatgcactccaaacgacgggccacgtggcactcccagcctaggttcaggtggcaggtggtctgggacagtcttcactctacaccatcagcaagtatagacgcctagtaagttntttagacttagtttactagttgtacagtaccaccgtcacgcacgtcgtcgggtccccggttcggggtttccgggacgggtaacgggaaccgtaaaggtacgacgtaacgtaccgaaaaccgtacggtcggtacggacgttcgaccgtaaccgtacgttaccgttacgttacctttacctaccgttcccgttacccccg

SEQ ID NO: 128650 - DNA, 534 bp, Homo sapiens
  misc_feature: GYAE6OF01C8D4I.42.10.A10.1.454.CMB.1.raw
  modified_base (195)..(195): a, c, t, g, unknown or other
  misc_feature (195)..(195): n is a, c, g, or t
  modified_base (288)..(288): a, c, t, g, unknown or other
  misc_feature (288)..(288): n is a, c, g, or t
  modified_base (520)..(520): a, c, t, g, unknown or other
  misc_feature (520)..(520): n is a, c, g, or t
tcagtgacgtatgtcacgaccggtgctcgatttagcgtcgatctcagggggaggaactgctcagttaggacccagagggaaccatggaagtcccagctcagcttctcttcctcctgctactctggctcccagatagtaccggagagattgtgttgacacagtatccagccaccctgtcttgtctccaggggaaangccaccctctcctgttgggccagtcagagtattaacaactacttagcctggtaccagcagagacctggccaggctcccaggctcctcatttangatgcatccaacagggccactggcactcccagccaggttcagtggcagtgggtctgggacagacttcactctcacatcagcagattagacgcctgaagtattttgacttagtttacttatttgtactagccaccgcacgcagctcgggtcccgttcgggttcggcggtacggaccgaaggtagacgatacgaaacgtacgtggtaggctgaccacctattcctgtcctttcncttcccttaccccg

SEQ ID NO: 128651 - DNA, 600 bp, Homo sapiens
  misc_feature: GYAE6OF01C3MMY.42.10.A10.1.454.CMB.1.raw
  modified_base (197)..(197): a, c, t, g, unknown or other
  misc_feature (197)..(197): n is a, c, g, or t
  modified_base (297)..(297): a, c, t, g, unknown or other
  misc_feature (297)..(297): n is a, c, g, or t
tcagtgacgtatgtcacgaccggtgctcgatttagcgtcgatctcagggggaggaactgctcagttaggacccagagggaaccatggaagtcccagctcagcttctcttcctcctgctactctggctcccagatagtaccggagagattgtgttgacacagtatccagccaccctgtctttgtctccgaggggaaanagccaccctctcctggttcgggccagtcagagtattaaacaactacttagcctggtaccagcagagacctggccaggcctcccgaggctcctctatttangatgcatccaacgagggccacgtggcactccccagccgtaggttcaggtggactaggtgggtctagggacagtacttcactctcaccatcagcagattagacgcgtagtaagtattttagacttaagtttactagttgtcgacgcaccgcagcacggtcgtcggtcccggttcgggttccgggacgggtaacgggtaaccaaggtacgaaggtactaacggaaaccgtaacgtacgggtacgtacggtacgaccgtacctacgttccttacgtttacttccgtaacctttccccgttaccccg

SEQ ID NO: 128652 - DNA, 510 bp, Homo sapiens
  misc_feature: GYAE6OF01CZJBN.42.10.A10.1.454.CMB.1.raw
  modified_base (197)..(197): a, c, t, g, unknown or other
  misc_feature (197)..(197): n is a, c, g, or t
  modified_base (288)..(288): a, c, t, g, unknown or other
  misc_feature (288)..(288): n is a, c, g, or t
  modified_base (301)..(301): a, c, t, g, unknown or other
  misc_feature (301)..(301): n is a, c, g, or t
  modified_base (331)..(331): a, c, t, g, unknown or other
  misc_feature (331)..(331): n is a, c, g, or t
  modified_base (346)..(346): a, c, t, g, unknown or other
  misc_feature (346)..(346): n is a, c, g, or t
tcagtgacgtatgtcacgaccggtgctcgatttagcgtcgatctcagggggaggaactgctcagttaggacccagagggaaccatggaagtcccagctcagcttctcttcctcctgctactctggctcccagatagtaccggagagattgtgttgacacagtatccagccaccctgtctttgtctccgaggggaaangccaccctctcctgttggccagtcagatattaacaactactagcctggtaccagcagagacctggccaggctcccaggcctcctcatttangatgcatccaacngggccatggcatcccagccaggtcagtgcngtggtctagggaaancttcactctcaccatcagcagtattagagcctagaagtatttgactagtttactattgtacacgcacgcagcagcgtggtccgtcggttcggcggaggacaagtagagacgtacgaaacgacgtggtcggctgcacctatctcgtcttcacttcgttccgtacc

SEQ ID NO: 128653 - DNA, 595 bp, Homo sapiens
  misc_feature: GYAE6OF01CDTN9.42.10.A10.1.454.CMB.1.raw
  modified_base (197)..(197): a, c, t, g, unknown or other
  misc_feature (197)..(197): n is a, c, g, or t
  modified_base (291)..(291): a, c, t, g, unknown or other
  misc_feature (291)..(291): n is a, c, g, or t
  modified_base (304)..(304): a, c, t, g, unknown or other
  misc_feature (304)..(304): n is a, c, g, or t
tcagtgacgtatgtcacgaccggtgctcgatttagcgtcgatctcagggggaggaactgctcagttaggacccagagggaaccatggaagtcccagctcagcttctcttcctcctgctactctggctcccagatagtaccggagagattgtgttgacacagtatccagccaccctgtctttgtctccgaggggaaanagccaccctctcctgttgggccagtcagagtattaacaactacttagcctggtaccagcagagacctggccaggctcccaggctcctcatttangatgcatccaacngggccacgtggcactccccagccaggttcaggtggcaggtggtctgggacaggacttcactctcaccatcagcagattagacgtcctagaagtattttgactagtttacttattcgtacacgtcaccgtcacgacacggtcgtacgggccccggtttcgggtttccgggaccgggtacgggtaacccgaaggttaacggagtaacgtaccgaaaaccgtaacgtcggttacggaccgtcgaccaaccgtacttccgttacggttccctttactaacttcccgttacccccg

SEQ ID NO: 128654 - DNA, 661 bp, Homo sapiens
  misc_feature: GYAE6OF01BHUBZ.42.10.A10.1.454.CMB.1.raw
  modified_base (196)..(196): a, c, t, g, unknown or other
  misc_feature (196)..(196): n is a, c, g, or t
  modified_base (629)..(629): a, c, t, g, unknown or other
  misc_feature (629)..(629): n is a, c, g, or t
  modified_base (637)..(637): a, c, t, g, unknown or other
  misc_feature (637)..(637): n is a, c, g, or t
  modified_base (647)..(647): a, c, t, g, unknown or other
  misc_feature (647)..(647): n is a, c, g, or t
tcagtgacgtatgtcacgaccggtgctcgatttagcgtcgatctcagggggaggaactgctcagttaggacccagagggaaccatggaagtcccagctcagcttctcttcctcctgctactctggctcccagatagtaccggagagattgtgttgacacagtatccagccaccctgtctttgctccgaggggaaangcccacctctcctggtggccagtcagagtattaacaactacttagcctggtaccagcagacgacctggaccaggcctcccgaggtcctcctactaattttactggaacttgacctaagtacccaaaacggcgggtcccaacgttcgggcctaacgtcccccgaaggtccccgtaagggtttccaagggttcggactaggggttcggggtaccgtaggggaacctagtaccctttcgaacctctacaaccctatcgaagcaagtagtacgagacctagtaacgttagtttacgacttaagtttacttagttacgtacgtacgtacctaccgacgtagcgacgccgttcgggtcccggttcgggttccgggacgggaacggtaaccgaaggtacgaagaactacgaaacgtacgtacgtaggacgtgaccgtacnctacgttntacctttacncgttcccgtacccg

SEQ ID NO: 128655 - DNA, 699 bp, Homo sapiens
  misc_feature: GYAE6OF01CV9R4.42.10.A10.1.454.CMB.1.raw
  modified_base (195)..(195): a, c, t, g, unknown or other
  misc_feature (195)..(195): n is a, c, g, or t
  modified_base (286)..(286): a, c, t, g, unknown or other
  misc_feature (286)..(286): n is a, c, g, or t
tcagtgacgtatgtcacgaccggtgctcgatttagcgtcgatctcagggggaggaactgctcagttaggacccagagggaaccatggaagtcccagctcagcttctcttcctcctgctactctggctccagatagtaccggagagattgtgttgacacagtatccagccaccctgtctttgtctccaggggaaancgccacctctcctgtggccagtcagagtataacactacttagcctggtaccagcagagacctggccaggcctcccaggcctcctcatttangatgcactaccaacgcgggcccaacgtggccactccccgagcccgtaggttccaggtcggacctaggttcggggtacttggggaactaggtaccctttcgaaccttcctaccaaccctatccgaagacctaagtaacgttaacgacggtaccgttaggtaaacgttactttttacggactttaacgtttttacttagtttacgtactacgaccgtaccgtacgtacggaccgtacggtccgttccgggtccccgggtttcggggtttccgggacgggtaacgggtaaccgtaaaggtacggtaaacggtaacgtaaccggtaaaacgtaacgtacgggttacggtaccgtacgaccgtaacccgtacgttaccgttacgttaccctttaaccgtccgtttccccgttaccccg

SEQ ID NO: 128656 - DNA, 669 bp, Homo sapiens
  misc_feature: GYAE6OF01AS68L.42.10.A10.1.454.CMB.1.raw
tcagtgacgtatgtcacgaccggtgctcgatttagcgtcgatctcagggggaggaactgctcagttaggacccagagggaaccatggaagtcccagctcagcttctcttcctcctgctactctggctcccagatagtaccggagagattgtgttgacacagtatccagccaccctgtctttgtctccgaggggaaagcgccaccctctcctggttcggccagtcagagtattaacaacttacttagcctggtaccagcagagacctggccaggctcccgaggcctcctctattatgatgcactaccaacgagggccacgtcggcactcccagccgtaggttcaggtcggcaggtcggtcgtgggacagtaccttcactctacaactagtcaagcctaagtaagttacgacgccgttaggtaacgttagttttacggactttaaggttttaactagtttacggtacacgtaccaccggtcgagtaccgtacggtccgtacgggtccccgggttcggggtttaccgggaccggggtaacgggtaaccgaaacgggtacgaacggtaacgtaacccggaaacgtaacggttcgggtacggtaccgttcggaccgtaaccgtacgttaccgttaccggtttacgtttaccctacgtttccccgttaacccccg

SEQ ID NO: 128657 - DNA, 655 bp, Homo sapiens
  misc_feature: GYAE6OF01A1THG.42.10.A10.1.454.CMB.1.raw
  modified_base (198)..(198): a, c, t, g, unknown or other
  misc_feature (198)..(198): n is a, c, g, or t
tcagtgacgtatgtcacgaccggtgctcgatttagcgtcgatctcagggggaggaactgctcagttaggacccagagggaaccatggaagtcccagctcagcttctcttcctcctgctactctggctcccagatagtaccggagagattgtgttgacacagtatccagcccaccctgtctttgtctccgaggggaaanagcccaccctctcctgttcggccagtcagagtattaacaactacttagcctggaccagcagagacctggccaggcctcccgaggcctcctctatttactgatgcactcccgaacgacgggcccacgtcggctacctccccgaagcctaggttccaggtcggacgtacggtggggtcgtaggggactaggtacctcactctacccacgataccgagacaagtattacggacgtccgtagtaagttagtttagacgttaagttttactattacgtacgacgtacgaccgacgacgacgacgtccgttccgggtcccgggttaccgggtttccggggacgggtaacgggtaaccgtaaaggtaacggaacggtaacgtaaacggaaaaccgtacgtcggtaggacctcggacctaccgtacgttaccgttacgttccttacctcgttccccgttaccccg

SEQ ID NO: 128658 - DNA, 558 bp, Homo sapiens
  misc_feature: GYAE6OF01BUIKJ.42.10.A10.1.454.CMB.1.raw
  modified_base (196)..(196): a, c, t, g, unknown or other
  misc_feature (196)..(196): n is a, c, g, or t
  modified_base (292)..(292): a, c, t, g, unknown or other
  misc_feature (292)..(292): n is a, c, g, or t
  modified_base (306)..(306): a, c, t, g, unknown or other
  misc_feature (306)..(306): n is a, c, g, or t
tcagtgacgtatgtcacgaccggtgctcgatttagcgtcgatctcagggggaggaactgctcagttaggacccagagggaaccatggaagtcccagctcagcttctcttcctcctgctactctggctcccagatagtaccggagagattgtgttgacacagtatccagccaccctgtctttgctccgaggggaaangccaccctctcctggttgggccagtcagagtattaacaactacttagcctggtaccagcagagacctggccaggcctcccaggcctcctcatttangatgcatccaacgngggccacgtggcactcccagccaggttcagtggcaggtgggtctgggacagtacttcactctcaccatcagcagatagacgcctagaagtatttgactagtttactattgtacagccgaccgcacgcagcgtcggtcccggttcgggtttccgggacgggtacgggaaccgtaaggtacgagtacgtaccgaaaccgtacgtggtacgcgtcgacctaccgtactcgttcgttaccttctcttccttacccg

SEQ ID NO: 128659 - DNA, 616 bp, Homo sapiens
  misc_feature: GYAE6OF01DDPC7.42.10.A10.1.454.CMB.1.raw
  modified_base (194)..(194): a, c, t, g, unknown or other
  misc_feature (194)..(194): n is a, c, g, or t
  modified_base (287)..(287): a, c, t, g, unknown or other
  misc_feature (287)..(287): n is a, c, g, or t
tcagtgacgtatgtcacgaccggtgctcgatttagcgtcgatctcagggggaggaactgctcagttaggacccagagggaaccatggaagtcccagctcagcttctcttcctcctgctactctggctcccagatagtaccggagagattgtgttgacacagtatccagccaccctgtcttgtctcgaggggaangccacctctcctgttggccagtcagagtattaacaactacttagcctggtaccagcagacgacctggccaggctcccaggcctcctcatttangatgcatccaacgacggccacgtggaccactccccagccaggttcaggtggacgagtcggggtctaggggactagtacttcacgtctcaaccagtccaagcagtatagagacctagtaagtattttagactaagttttactatttcgtactacgcaccgctacgacgacggtccgtacgggtcccggttccggggtttacgggaccgggtaacgggaaccgtaaaggtacggaacgtaacgtaaccgaaaaccgtacggtaggtacgggtactcggacctaaccgtacgttccgttacgttacctttaccgtacgttcccgttaccccg

SEQ ID NO: 128660 - DNA, 557 bp, Homo sapiens
  misc_feature: GYAE6OF01CCZBD.42.10.A10.1.454.CMB.1.raw
  modified_base (197)..(197): a, c, t, g, unknown or other
  misc_feature (197)..(197): n is a, c, g, or t
  modified_base (290)..(290): a, c, t, g, unknown or other
  misc_feature (290)..(290): n is a, c, g, or t
  modified_base (303)..(303): a, c, t, g, unknown or other
  misc_feature (303)..(303): n is a, c, g, or t
  modified_base (369)..(369): a, c, t, g, unknown or other
  misc_feature (369)..(369): n is a, c, g, or t
  modified_base (376)..(376): a, c, t, g, unknown or other
  misc_feature (376)..(376): n is a, c, g, or t
tcagtgacgtatgtcacgaccggtgctcgatttagcgtcgatctcagggggaggaactgctcagttaggacccagagggaaccatggaagtcccagctcagcttctcttcctcctgctactctggctcccagatagtaccggagagattgtgttgacacagtatccagccaccctgtctttgtctccgaggggaaangcccaccctctcctgttgggccagtcagagtattaacactacttagcctggtaccagcagagacctggccaggctcccaggctcctcatttangatgcatccaacngggccacgtggcatcccagcctaggttcaggtggcaggtggctgggacagacttcactcgtcaccntcagcanattagactcctgaagtatttagacttagtttactattgtacacgtcaccgcacgcagcgtacggtcccggtcgggtttccggacggtaacgggaaccgtaaggtaagagtacgtacgaaacgtacgttcggaggctcgaccaccgtacgtcttcgttacttcctaccgttccgttaccccg

SEQ ID NO: 128661 - DNA, 562 bp, Homo sapiens
  misc_feature: GYAE6OF01E0KWW.42.10.A10.1.454.CMB.1.raw
  modified_base (196)..(196): a, c, t, g, unknown or other
  misc_feature (196)..(196): n is a, c, g, or t
tcagtgacgtatgtcacgaccggtgctcgatttagcgtcgatctcagggggaggaactgctcagttaggacccagagggaaccatggaagtcccagctcagcttctcttcctcctgctactctggctcccagatagtaccggagagattgtgttgacacagtatccagccaccctgtctttgtctccaggggaaangccaccctctcctgttggccagtcagagtattaacaactacttagcctggtaccagcagacgacctggccaggcctcccaggctcctctatttatgatgcatcccaacgacgggccacgtggcactccccagccaggttcaggtggcaggtggtctgggacagtacttcactctaccacatcagcagtatagacgctagaacgtattttgctagtttactattgtcagtcaccgcacgcacgcgtacggtcccggttcgggttcgggacgggtaacgggaaccgaaaggtagacgtacgtaacgaaaacgtacgtggtaggcgtcgaccaaccacgttctacgttccttctacgtccgttaccccg

SEQ ID NO: 128662 - DNA, 661 bp, Homo sapiens
  misc_feature: GYAE6OF01DPONJ.42.10.A10.1.454.CMB.1.raw
  modified_base (196)..(196): a, c, t, g, unknown or other
  misc_feature (196)..(196): n is a, c, g, or t
tcagtgacgtatgtcacgaccggtgctcgatttagcgtcgatctcagggggaggaactgctcagttaggacccagagggaaccatggaagtcccagctcagcttctcttcctcctgctactctggctcccagatagtaccggagagattgtgttgacacagtatccagccaccctgtctttgtctccgaggggaancgcccacctctcctgttggccagtcagagtattaacaactatagcctggtaccagcagagacctggccaggcctcccgaggcctcctcatttatgatgcataccaacgagggcccacgtggacactcccagccaggttcaggtggcaggtgggtctaggggacagtacttcactctacaccatcagctagtagttagacgtacctaggtaaacgttattttgaccgttaagttttaccttagtttcgtaccgtacgtacctacccggctaacgccgtacggtccgtccgggtccccgggtttccggggtttaccggggacgggtaaccggggtaacccgtaaagggtaacggaacggtaacgttacccggaaaaacggtaccgttacgggttacggtacctacggacccgtaacctacgttaccgttcgtttaccgtttacctaacgtttccccgttaacccccg

SEQ ID NO: 128663 - DNA, 590 bp, Homo sapiens
  misc_feature: GYAE6OF01C5IWF.42.10.A10.1.454.CMB.1.raw
  modified_base (197)..(197): a, c, t, g, unknown or other
  misc_feature (197)..(197): n is a, c, g, or t
  modified_base (297)..(297): a, c, t, g, unknown or other
  misc_feature (297)..(297): n is a, c, g, or t
  modified_base (388)..(388): a, c, t, g, unknown or other
  misc_feature (388)..(388): n is a, c, g, or t
tcagtgacgtatgtcacgaccggtgctcgatttagcgtcgatctcagggggaggaactgctcagttaggacccagagggaaccatggaagtcccagctcagcttctcttcctcctgctactctggctcccagatagtaccggagagattgtgttgacacagtatccagccaccctgtctttgtctccgaggggaaancgcccaccctctcctgttcgggccagtcagagtattaacactacttagcctggtaccagcagacgacctggccaggcctcccgaggcctcctctatttangatgctactaccaacgacgggcccacgtggaccactccccagccctaggttcaggtcggactaggtgggtctagggacagtacttcactcncaccatcagcagtattagacgtcctagtaagtattttagacttagtttacttagttcgtcacgtaccaccggcacgcgagtccgtccgggtcccggttcgggttccgggacgggtaacgggaaccgtaaggtacgagtaacgtacgaaacggtacgtcggtggactcgacctactactcttcgtaccttctcttcctacccg

SEQ ID NO: 128664 - DNA, 596 bp, Homo sapiens
  misc_feature: GYAE6OF01DF0MR.42.10.A10.1.454.CMB.1.raw
  modified_base (196)..(196): a, c, t, g, unknown or other
  misc_feature (196)..(196): n is a, c, g, or t
tcagtgacgtatgtcacgaccggtgctcgatttagcgtcgatctcagggggaggaactgctcagttaggacccagagggaaccatggaagtcccagctcagcttctcttcctcctgctactctggctcccagatagtaccggagagattgtgttgacacagtatccagccaccctgtctttgtctcgaggggaaancgccaccctctcctgtggccagtcagatataacactacttagcctggtaccagcagacgacctggaccaggcctcccgaggccttcctcatttatgatgacatcccaaacgacgggccacgtggaccactccccagcctaggttcaggtggcgtaggtgggtctagggacagtacttcactctacacatcagcagatagacgctagaacgtattttgacgttaagtttacttagttagtactacgacctaccgcagcgacgtcgtcgggtcccggttcgggttccgggacgggtaacgggaaccgtaaaggtagaacgtacgtaacgaaacgtaacggtgtacggtactcggacctacctacgttccttacgttccttactaccgttcccgttacccccg

SEQ ID NO: 128665 - DNA, 617 bp, Homo sapiens
  misc_feature: GYAE6OF01A3T9V.42.10.A10.1.454.CMB.1.raw
  modified_base (197)..(197): a, c, t, g, unknown or other
  misc_feature (197)..(197): n is a, c, g, or t
  modified_base (295)..(295): a, c, t, g, unknown or other
  misc_feature (295)..(295): n is a, c, g, or t
tcagtgacgtatgtcacgaccggtgctcgatttagcgtcgatctcagggggaggaactgctcagttaggacccagagggaaccatggaagtcccagctcagcttctcttcctcctgctactctggctcccagatagtaccggagagattgtgttgacacagtatccagccaccctgtctttgtctccgaggggaaangccaccctctcctggttcgggccagtcagagtattaacaactacttagcctggtaccagcagagacctggccaggcctcccaggcctcctctatttangatgcatccaacgacgggccacgtggcactcccagccaggttcaggtgcaggtgggtctgggacagtacttcacctctcaccatccagcaagtattagacgtccgtagtaagttagtttacgacgttaagtttactagtttcgtacgacgtccgaccgcacgaccacgtccgtacgggtcccggtttcggggtttaccgggacgggtaacgggaaccgtaaagggtacgaacggtacgtaaccgaaaacggtaacggtcggtacggacgtcggacctaacccgtacttcgttacgttaccttcgtacctttcccgtaccccg

SEQ ID NO: 128666 - DNA, 782 bp, Homo sapiens
  misc_feature: GYAE6OF01CFF2A.42.10.A10.1.454.CMB.1.raw
  modified_base (197)..(197): a, c, t, g, unknown or other
  misc_feature (197)..(197): n is a, c, g, or t
tcagtgacgtatgtcacgaccggtgctcgatttagcgtcgatctcagggggaggaactgctcagttaggacccagagggaaccatggaagtcccagctcagcttctcttcctcctgctactctggctcccagatagtaccggagagattgtgttgacacagtatccagccaccctgtctttgtctccgaggggaaancgccaccctctcctggttgggccagtcagagtattaacaactacttagcctgtaccagcagacgacctggccaggcctacccgaggcctcctctaattttatgtatcgcactaccaacgacggccctacgtcggccactccccgacgtccgtaggttccaggtcggacgtaggttcggggtcgtagggggaacctacggtacctttcccaaccttccgtaccaacccctaagttacccgaacggtaccgtaaggtaacgtttaacgggaaccggtacccgttaaggtaaacgtttaagtttttacggtaaccgtttaacgtttttaaacttagtttacggtaccgtaacgtacccgtaacccgtaccgacggtaccgtacggtcccggttccggggttccccggggtttaccgggggtttccggggtaacggggtaaacggggaaacccggtaaagggtaacgtaacggtaaacgtaaaccggtaaaaccggtaaccggttacgggttacggtaccgttaccgaccgtaaccgtacgtttaccgttacgtttaccgtttacccgtaccgttcccgttacccccgg

SEQ ID NO: 128667 - DNA, 663 bp, Homo sapiens
  misc_feature: GYAE6OF01D00II.42.10.A10.1.454.CMB.1.raw
  modified_base (195)..(195): a, c, t, g, unknown or other
  misc_feature (195)..(195): n is a, c, g, or t
  modified_base (306)..(306): a, c, t, g, unknown or other
  misc_feature (306)..(306): n is a, c, g, or t
  modified_base (352)..(352): a, c, t, g, unknown or other
  misc_feature (352)..(352): n is a, c, g, or t
tcagtgacgtatgtcacgaccggtgctcgatttagcgtcgatctcagggggaggaactgctcagttaggacccagagggaaccatggaagtcccagctcagcttctcttcctcctgctactctggctcccagatagtaccggagagattgtgttgacacagtatccagccacctgtctttgtctccgaggggaangccacctctcctgttggccagtcagagtataacaactacttagcctggtaccagcagagacctggccaggcctcccgaggcctcctctatttatgatgctactccgaacgngggcccacgtggcactcccagcctaggttcagtcgcaggtcggtcngggacagtacttcactctaccaccatcagactaagtagttaacgacgtccgtagtaagttagttttagacttaagttttaccttagtttcgtacgtacgtacctacccgtcgagaccgcggtccgtaccgggtccccgggtttcggggttccgggtaccggggtaaccggggtaacccgtaaagggtacggtaacggtaacgttaacccgtaaaacggtaaaccggttacgggtacgggtacgttaccgacccgtaaccgtaacgtttccgttacgttaccctttaccgtaccgtttcccgttacccccgg

SEQ ID NO: 128668 - DNA, 666 bp, Homo sapiens
  misc_feature: GYAE6OF01DV3YB.42.10.A10.1.454.CMB.1.raw
  modified_base (144)..(144): a, c, t, g, unknown or other
  misc_feature (144)..(144): n is a, c, g, or t
  modified_base (208)..(208): a, c, t, g, unknown or other
  misc_feature (208)..(208): n is a, c, g, or t
  modified_base (395)..(395): a, c, t, g, unknown or other
  misc_feature (395)..(395): n is a, c, g, or t
  modified_base (431)..(431): a, c, t, g, unknown or other
  misc_feature (431)..(431): n is a, c, g, or t
tcagtgacgtatgtcacgaccggtgctcgatttagcgtcgatctcagggggaggaactgctcagttaggacccaggagggaaccatggaagtcccagctcagcttctcttcctcctgctactctggctccagatagtaccgganagtattgtgttgacacagtatccagccctacccttgttctttgtcctaccgagggggtaaaacncgcccctacccttctcccgtggttccggggacctaggtcaaggtagttaactttaaaccaactttacttacgcccttaggtaccagccaggacgacccgtgggccaggcctcccgaggtcctcctctagtttatgacttgactactaccgaacgcgggccacgtcgcactcccagtccaggttcagnggccgtaggtcggtcgtcggactagtcttcacttcncaccatacagacagtagtagacgtactagtaattgtttagacttagtttacttactcgtactacgaccgtaccgcgacgtacgtcgtaccgtcgggtccccggtttcggggttacgggaccgggtaacggaaccgaaggtacggaacgaacgtaaccgaaccggtaacgtcggtagttccgtacgtaccgtacctacggttcttacgttactttccttccgttacccgtaccccg

SEQ ID NO: 128669 - DNA, 665 bp, Homo sapiens
  misc_feature: GYAE6OF01D563Q.42.10.A10.1.454.CMB.1.raw
tcagtgacgtatgtcacgaccggtgctcgatttagcgtcgatctcagggggaggaactgctcagttaggacccagagggaaccatggaagtcccagctcagcttctcttcctcctgctactctggctcccagatagtaccggagagattgtgttgacacagtatccagccaccctgtctttgtctccgaggggaaagcgcccacccctctcctgttgggccagtcagagtaattaacaactacttagcctggtaccagcagagacctggccaggcctcccaggcctcctctattttatgatgcactaccaacgacgggcccacgtggccactcccacgccgtaggttcaggtggcgtaggtgggtcgtagggacacgtacgttccactcctaccacctatccagacgagtaattagacgtaccgttagaaacgttattttcgacgttaagtttacttagtttgtcacgtccaccgctacgccacggtccgtccgggtccccgggtttccggggtttccgggaccggggtaacggggaacccgtaaacgggtaacgtaacggtaacgtaaccgtaaaaccggtaaccgtagggtacggcggttacggacccgtacctaacgtttccgttacgttacctttacccgttacgttccccgttacccccg

SEQ ID NO: 128670 - DNA, 682 bp, Homo sapiens
  misc_feature: GYAE6OF01D6BM5.42.10.A10.1.454.CMB.1.raw
  modified_base (306)..(306): a, c, t, g, unknown or other
  misc_feature (306)..(306): n is a, c, g, or t
  modified_base (422)..(422): a, c, t, g, unknown or other
  misc_feature (422)..(422): n is a, c, g, or t
tcagtgacgtatgtcacgaccggtgctcgatttagcgtcgatctcagggggaggaactgctcagttaggacccagagggaaccatggaagtcccagctcagcttctcttcctcctgctactctgctcccagatagtaccggagagattgtgttgacacagtactccagccctaccctgttctttgtcctccgagggaaacgcgcccaccctctcctggtcggccagtcagagttattaacatacttagccttaggtaccagcagacgaccgtcggccaggcctccgaggtcctacctctatttagnacttcgctaactaccgaaacggtaccgggaccctacgtcggtacaccgtaccccgaagccgtacggttcgaaggtcggtacgtacggtcgggtacgtagggactacggtacttccnctctacgccctaagtcacggactaagtacgttaacgactaccgtaagtagttagtttcgtaatttacggttactttagttgtacctaccgaccgtaccgagacgaaccgtccgggtacgtcccggggttacccggttccgggttaacggggaccggtaacgggtaaccgaaggtacgaaggttaacgaaccgtaacggtacgtcggtcggacgtcggacctacgtacttacgtcgttaccttctaccgtccccgtaaccg

SEQ ID NO: 128671 - DNA, 831 bp, Homo sapiens
  misc_feature: GYAE6OF01C6BK0.42.10.A10.1.454.CMB.1.raw
  modified_base (204)..(204): a, c, t, g, unknown or other
  misc_feature (204)..(204): n is a, c, g, or t
  modified_base (323)..(323): a, c, t, g, unknown or other
  misc_feature (323)..(323): n is a, c, g, or t
tcagtgacgtatgtcacgaccggtgctcgatttagcgtcgatctcagggggaggaactgctcagttaggacccagagggaaccatggaagtcccagctcagcttctcttcctcctgctactctggcctcccagataggtaccggagagtattgtgttgacacagtactccagcccaccctgttctttcgtctccgaaggggaanacgcccaccctctccgtggttcggccagtcagagtaacttaacaactacttacgctaggtaccagcaagacgaccgtggaccacgggtcctacccgacggtccttccctatattttagngattcgactaacacccaaacgacggccctagtcggacacctccccaggccgtaacggttcgaggtacggcgtaggtcgggtacgtgggacctagtaccttccactcctaccaacctgtaccgagccgtaaagtagttacgacgtaccgttaaggtaaacgtttagttttacgtaacgttttaacgttttaacgtttacgtttggttaaacccgaccgggtacccgtaaccgtaccgaacggtaccgtaccggtaaccggggtttccccgggttcccccgggggttttaccggggtttaacccggggggaacccggggttaaacggggaaaccccggtttaaaagggaaacggtaaaccgggttaaaccaaaacccgggttaaaaaccgggtaaacccggtttacggggttaccgggtaccgttaacccggaacccgttacccgttaaccgttaaccgtttcccggtttacctttacccgtttaacccgtttccccccgttaaccccgg

SEQ ID NO: 128672 - DNA, 831 bp, Homo sapiens
  misc_feature: GYAE6OF01AFT6I.42.10.A10.1.454.CMB.1.raw
  modified_base (200)..(200): a, c, t, g, unknown or other
  misc_feature (200)..(200): n is a, c, g, or t
  modified_base (202)..(202): a, c, t, g, unknown or other
  misc_feature (202)..(202): n is a, c, g, or t
  modified_base (275)..(275): a, c, t, g, unknown or other
  misc_feature (275)..(275): n is a, c, g, or t
tcagtgacgtatgtcacgaccggtgctcgatttagcgtcgatctcagggggaggaactgctcagttaggaccagagggaaccatggaagtcccagctcagcttctcttcctctgctactctggctcccagatacgtaccggagagtacttggtgttcgacacagtatccagccacccttgtctttgactcgaggggaaancnccaccctctccgtggttcgggacctagtcgtaacggagttacttaaacgaacttcttacgccgtaggtaaccngacaagtcgacctggccaaggcctaccgaggccttacctactagttttacgcgtaagtccgtacctaacgttacccaacgggtacggaccctaacggtccggaccctaccttcccgaacgggtaccctaagggtttccgaacgttcgggactacggggttacggtactacgggggaccttaggtaaccgttccacgttcctaaccgcctaagttccgaaggttactacggtaacgttacggtacgtaaccgtcggtaaagtttacttacgtacgttaagttttaaccgtagtttcggtaaccggtacgtacccggtacccgtacgtaacgtccgtaaccgggtttccgtacccggggttacccggtttaccgggtttaccgggggacggtaaaccgggggtaaaccctttaaggggacccggttaaacggtaccgttaaaacccggttaaaccggtacgggtttacgggtcccgggttaacgtacggtaaccggtaacccgttaagggttcctttaccggtttaacggttacccgttacgttcccggttaaccccg

SEQ ID NO: 128673 - DNA, 767 bp, Homo sapiens
  misc_feature: GYAE6OF01B683G.42.10.A10.1.454.CMB.1.raw
  modified_base (204)..(204): a, c, t, g, unknown or other
  misc_feature (204)..(204): n is a, c, g, or t
  modified_base (307)..(307): a, c, t, g, unknown or other
  misc_feature (307)..(307): n is a, c, g, or t
  modified_base (314)..(314): a, c, t, g, unknown or other
  misc_feature (314)..(314): n is a, c, g, or t
tcagtgacgtatgtcacgaccggtgctcgatttagcgtcgatctcgagggggaggaactgctcagttaggacccagagggaaccatggaagtcccagctcagcttctcttcctcctgctactctggcctcccagatagtaccggagagtattgtgttgacacagtatccagcccaccctgttctttgtcctccgaaggggaaancgccctaccctctccttggttcgggcctagtcagagttaattaacaacttacttagccttggtaccagcagacgacctggccaggcctcccgaggtcctcctntatttangtatgactacgtacccgaacgacgggccctacgtcggaccactccccgagccgtaggttccaggtcggcgtaggtcgggtacgtaggggacctaggtcccttcaaccttccgtaccaaccgtagtccgacgtactaagtacgttaacgacggtaccgttaagtaaacgttacgttttacgtactttaacggttttaaccttagtttacgtacgtacgacctaccggacgtacgtaccgtacggtccgtcccggggttcccgggtttaccggggtttccggggacggggtaaccgggtaaccggtaaacggttaacggaacggttaacgtaaaacccgtaaaaccgggttaccggttacgggttaccgggtaccgtttcgaaccccgttaacccgtaccgtttaccgttaccggtttaccctttacccgttacccgtttccccgtttaccccgg

SEQ ID NO: 128674 - DNA, 877 bp, Homo sapiens
  misc_feature: GYAE6OF01BQ5DT.42.10.A10.1.454.CMB.1.raw
  modified_base (158)..(158): a, c, t, g, unknown or other
  misc_feature (158)..(158): n is a, c, g, or t
  modified_base (204)..(204): a, c, t, g, unknown or other
  misc_feature (204)..(204): n is a, c, g, or t
  modified_base (233)..(233): a, c, t, g, unknown or other
  misc_feature (233)..(233): n is a, c, g, or t
  modified_base (389)..(389): a, c, t, g, unknown or other
  misc_feature (389)..(389): n is a, c, g, or t
tcagtgacgtatgtcacgaccggtgctcgatttagcgtcgatctcgagggggagaactgctcagttacggaccaggagggaaccagtggaagtcccagctcacgtcttcctcttcctcctgtcctactcgtcggccctacgagtacgtacggacgganagtgttgtagtacgaacctagattaccaccgaccgtccctccgttnttcgtttacgtaccgaacgggaaaggacnccctccctaccgttctcggttgggcgactaggtcaaggtaacttaactaacctacgttacgtcgtacgttacgaacgcgagtacggaccggttacgccggaccggttacgcccgaccgggtccctccttacctattttaagttacgtacggttacncctaacgtaacccgtaaccgaacggggcccgttaacgaccggttaccggaacctcccgtacccggtaacgggtaaccggttcggttaaaccgggtggttaaccggtcggggttacggggtacgggttaaccgggtacggtaacggttaacctttacccccggtacttaacccgtcttaaaaacccgcgtaacgttacccgggattaacgtaacggttaacgttacgtaacggttaaccgttaagttacggttttataaccggttaacgtttacggtttaacttcgtacgttaccgaacgtaccgtcgtactcggtaaccgtccgggttacggtcccgggtttcggtaccgggggttcggtaaccgggaaggtaacgtaacgggaacgttacgaaaccgttaaaccggacgttccggtaacgtaccgggctaacgccgtaaaccgttcttaacccggtacttcccgtaccttcccggttcccgtaaccg

SEQ ID NO: 128675 - DNA, 731 bp, Homo sapiens
  misc_feature: GYAE6OF01BYY94.42.10.A10.1.454.CMB.1.raw
  modified_base (200)..(200): a, c, t, g, unknown or other
  misc_feature (200)..(200): n is a, c, g, or t
  modified_base (331)..(331): a, c, t, g, unknown or other
  misc_feature (331)..(331): n is a, c, g, or t
tcagtgacgtatgtcacgaccggtgctcgatttagcgtcgatctcagggggaggaactgctcagttaggacccagagggaaccatggaagtcccagctcagcttctcttcctcctgctactctggctcccagatagtaccggagagattgtgttgacacagtatccagccctaccctgtctttgtcctccgaggggaaancgccctaccctctcctggttcggcctagtcgagagtacttaacaactacgttagcctggtaccagcagacgacctggcccaggcctcccgaggtcctcctacgtatttactgattcgactatacccaacgngggtcccagtcggactactcccgagctaggttccaggttcgacgtaggtcgggtactaggggaccagtacgttccaaccgtctaccgaacctagtccaccgtagtaacgtagtacggtacgtacgtaggtaaagttacgttttcgacgtttaagtttacttaacgtttacgttacgtaacgtacccgtaccggtaccacggtaccgtacggtccggtaccgggtaccccggtttccggggttccgggtaaccgggtaacgggtaaacggaacggttaacggaacggtaaccgtaaccggtaaaaccgtccggtacggttacgggtaccgttaccggaccgttaaccgtaccgtttaccgttacgtttaccgttacctacccggttcccgttaccccccgg

SEQ ID NO: 128676 - DNA, 798 bp, Homo sapiens
  misc_feature: GYAE6OF01B2HR1.42.10.A10.1.454.CMB.1.raw
  modified_base (613)..(613): a, c, t, g, unknown or other
  misc_feature (613)..(613): n is a, c, g, or t
tcagtgacgtatgtcacgaccggtgctcgatttagcgtcgatctcagggggaggaactgctcagttaggacccagagggaaccatggaagtcccagctcagcttcctcttcctcctgctactctggcctcccagatagtaccggagagattgtgttgacacagtactccagccctacccttgttcttttcgtcctaccggaagggggaaacaccgccctaaccccttctccgtggttcgggacctacgtcaagtagttaacttaaactaactacttacgcctaggtaccagcaagacgaccgtcggaccgacggtccctacccgacggtcccttccgttactaactttaagtcgaagtccgactaccgtacccgaaacggaccggtacccgtaaccgtacggaccctaccgtaccccgtaacgtaccccggttagggttaaccgcggggttcggaaccggttaacgggttcgggtacccggtagggggaacctacggttaacccctttccgtaccctacccttacgaacccagttacccgaacgacgtaagtacgtaacggtaccgtacgttaagtaagtttatttacgtaacgttaacgttttatacgtttnacctacgtccaaccgtcacgtccgtacgtccgtaccgggtcccggttcggggttaccgggcgggttaaccgtaacggaacggtagtaacgtaaccgtaaaccggtaaaccgtaggttccggatacccggtacaccgtaacaccgtttccgtaacggtttccttacccgtctttaccccgtacccg

SEQ ID NO: 128677 - DNA, 749 bp, Homo sapiens
  misc_feature: GYAE6OF01BUN25.42.10.A10.1.454.CMB.1.raw
  modified_base (212)..(212): a, c, t, g, unknown or other
  misc_feature (212)..(212): n is a, c, g, or t
tcagtgacgtatgtcacgaccggtgctcgatttagcgtcgatctcgagggggaggaactgctcagttaggacccagagggaaccagtggaagtcccagctcagcttctcttcctcctgctactctggcctcccagatagtaccggagagtattgtgttgacacagtactccagccctaccctgttcttttacgtcctaccggaaggggaaanccgccctaccctctccgtggttcggccagtcgagtataactaacaactctacgcgtagtaccagcagacgacctcggaccaggtccctacccgaggtcctacctacgttatttagcgtactgacctaccgtaaccgaaccggacgggtccctacggtccggacctacccgtacccgacgtaccggtaggtacgtaggtcggacgtagggttccgggtacgtagggaacctcgtacctacctacgtctaacccgactagtaccgagtactaagtaacgttagaaccgtacgtagtacgttagtttacgtacgtttaacgtttaagttacgtttcggtacgtaccgaccgtaaccgtacgtacgtaccgtaccggttcccgggtcccggggttaaccccggtttccgggggtaaccgggtaacgggtaacggtaacgtaaacgggtacggaacgtaaccgaacggtaaaaccgttggtaccggtaggacctccgaaccgtctaccgttcttcgttaacctcttacccgtcccgtacccg

SEQ ID NO: 128678 - DNA, 786 bp, Homo sapiens
  misc_feature: GYAE6OF01DZWNR.42.10.A10.1.454.CMB.1.raw
  modified_base (609)..(609): a, c, t, g, unknown or other
  misc_feature (609)..(609): n is a, c, g, or t
  modified_base (731)..(731): a, c, t, g, unknown or other
  misc_feature (731)..(731): n is a, c, g, or t
  modified_base (777)..(777): a, c, t, g, unknown or other
  misc_feature (777)..(777): n is a, c, g, or t
tcagtgacgtatgtcacgaccggtgctcgatttagcgtcgatctcagggggaggaactgctcagttaggacccaggagggaaccatggaagtcccagctcagtcttctccttcctcctgctactctggcctcccagagtaggtaccggagagtattgtgttgacacagtactccacgccctacccttgttctttcgtaccgtaccggaaaggggaaacgccgacccctaccccttcgtcccgttgggttcgggacctagtacaaggtaattaacttaacgtaacttacgttacgccgtacggtaaccagacagaccgtaccgtcggccacggcctacccgaggtcccttcctagttacttagcgtagtacacctacgtaacccgaacggtacccgaccgtaccggtaccggaccaccccgtacgccggtaccgtaacggttcggacgggtggtaacggtcggggtcggtaacggtacgggactcgttacctccgtacctactaacccgactacgtacgacgtacgtaaagtagtacggactaggtaacggttactttagttacgacgttttaactttatacggttcgactaccgacctacgacgtaccnggtaccggtccggttcccgggtcccgggttaacgggtacggggaacccggtaaacggtaaccgtaagtaccggaaccgtaacggtaacccgtaagggtggttaccgacgtccggttaaaccncccgttaactacgggttcccttaccgttaaccgttccctttacccncccggttac

SEQ ID NO: 128679 - DNA, 914 bp, Homo sapiens
  misc_feature: GYAE6OF01AIUEN.42.10.A10.1.454.CMB.1.raw
  modified_base (209)..(209): a, c, t, g, unknown or other
  misc_feature (209)..(209): n is a, c, g, or t
tcagtgacgtatgtcacgaccggtgctcgatttagcgtcgatctcagggggaggaactgctcagttaggacccagagggaaccatggaagtcccagctcagcttctcttcctcctgctactctggctcccagatagtaccggagagtattgtgttgacacagtactccacgccctacccttgttctttcgtcctccggaaggggaaacncgcccaccctcctccgtggttcggccagtcagtagttaattaaaccaacttactacgccgtacggtaccgagacacggacgccgtcggccgacggtccctacccgaggtcccttcctacgttaatttagtacggtacttcgacctacctaacccgaaacggaccgggtaccctacgtcggaccctaacctaccccggaacggtaccggttacgggttaccggtacgggtacgggtaccggttaacggggttcggggttaaccgaacgggggtaaccgtaacggtttacccttaaccgaccctttaccaccctaaacccgtaacttaccggaacgtacgtaacgtagttaacggaacggttaccgttaaggtttaaacgtttacggttttttaccggtaacgttttaacggtttttaaccttaacgggtttaccgtaacccggttaacgaccccggtaaccggtacgtacccggtacgtacccgggttcccggttacccgggggttcccccggggtttaccggggttacccggggaacccgggggaaacgggtttaaccggaaaggttaacccggtaacggtaaaaccgtaaacccggtaaaccggttacgggttcggtacccggttacggtacccgtaacccgtacccgtttacgttccccgtttacgtttactttccccgtacccgtttccccggttaaccccg

SEQ ID NO: 128680 - DNA, 874 bp, Homo sapiens
  misc_feature: GYAE6OF01ETJEX.42.10.A10.1.454.CMB.1.raw
  modified_base (201)..(201): a, c, t, g, unknown or other
  misc_feature (201)..(201): n is a, c, g, or t
  modified_base (303)..(303): a, c, t, g, unknown or other
  misc_feature (303)..(303): n is a, c, g, or t
tcagtgacgtatgtcacgaccggtgctcgatttagcgtcgatctcagggggaggaactgctcagttaggacccagagggaaccatggaagtcccagctcagcttctcttcctcctgctactctggctcccagatagtaccggagagattgtgttgacacagtactccagccctacccttgtctttgcctccgaggggaaangcccaccctctccgtggttcggcagtcagagttataacaactactacgcctggaccagcagcgacctcggccacggcctcccgaggcctcctactatttacngtatcgacactccgaaacgcgggaccacgtcggactactcccgaacgtcgtaacggttcgacggtcgggacgtaggggttccggggttacgtacggggtaaccgtaacggttacctttaccggtaacccttccgttacccaaccctaacgttaccgacgggtacctaaacggttaacgtttaacggaccggttaccgttaacgggttaaaagttttacgtttttaacggtaaccgttttaacggtttttaaccgtttaagttttaccgggtaaccgtaacccgtcccgggtaaccccgtacgttaaccggcccgttaaacgggtccccgggtttaccccgggggttaccccggggttttaccggggggtttaacccgggggtaaccgggggtaaaccggggtaaacccgttaaaaacggggttaaccgggaaaaccggttaaccggttaaaacccgtaaaacccggggttacggttacgggtacccgggtacggttaccgaaacccggttaacctaccggtttccgttacgttttacccgtaacctttccgttaacccccggtttaccccg

SEQ ID NO: 128681 - DNA, 820 bp, Homo sapiens
  misc_feature: GYAE6OF01BNDH2.42.10.A10.1.454.CMB.1.raw
tcagtgacgtatgtcacgaccggtgctcgatttagcgtcgatctcagggggaggaactgctcagttaggacccagagggaaccatggaagtcccagctcagcttctcttcctcctgctactcgtggctcccagatagtaccggagagtattgtgttagacacagtactccacgcctaccttgttctttgtcctaccggaaggggaagccgacccaccctctccgtggttcgggcctagtacgagtagttaacttaaacctaacttactacgtccgtacggtaccagtcagacgaccgtcggccgacggtcctacccgaggtccctaccgttacgtaagttttagacggtagttcgaccgtaaccgttaccccgaaacggtaccgggacccctacggtaccgacccgtaaccgtccccgtaacgtaccggttaacggttacgtaacgggtcggtaccgggttaagggttccggggtacgtacggggtaaaccgtacgtttacccgtaacctacccgtaccttaccccgaacgtaacgtccgaatccgtaaggtaccgttacgtacgtaccgttaggtaactttacggtttaacgtaacttttaaacggttacttaagttaccgtagaacccgtcccggacgtacgacggtaccgttcgggtccggttacccggggttcccgggttaaccgggtacggggaaccggtaaacgggtaaaccgttaacggaacggtaacgtaaccggttaacgaacggttacgtcggtacgtaccgtacgaccttaccgcgttacttccgtaacttccctcccgtcctaacccg

SEQ ID NO: 128682 - DNA, 835 bp, Homo sapiens
  misc_feature: GYAE6OF01B54UK.42.10.A10.1.454.CMB.1.raw
  modified_base (329)..(329): a, c, t, g, unknown or other
  misc_feature (329)..(329): n is a, c, g, or t
tcagtgacgtatgtcacgaccggtgctcgatttagcgtcgatctcaggggggaggaactgctcagttaggacccagagggaaccatggaagtcccagctcagcttctcttcctcctgctactctggcctcccagatagtaccggagagtattgtgttgacacagtactccagccctaccctggttctttgtcctccgaaggggaaacgacgcccaccgtcctccgtggttcgggccagtacagtagtaactaacaactactagcctggtaccagcagacgaccgtcggccgacggaccctcccgacggccttcctctatttactgtatnacacctaccgaacggtacggcctacgtacggtccactcccacgtaccgtacgggtaccaggtcgacgggttacggtcggggttaccggacgggtacgtaacggttacccttacgacccttaccgtaccctaaccgtacgttacaacggtaccgtaaaggttacggttaaacggaccgttaacggttaacggtaaagttttacggtttttacgtaaccggttttaagttttaaccgtttacgttacgggttacaaaccggtacccgtaacccgtacggtaccggacgtaccgggtacccgggtttcccgggggttaccccggggtttaccggggggtttacccgggaacggggggttaaacccgggtaaaccgtaaaacgggttcgggtaaaccgaaacccgttaaacgggaaaaccggttacccgggttggtacggtacccggtacggtacctaacccgttcgttacgttacccggtttaccacgttccgtttccccctaacccgg

SEQ ID NO: 128683 - DNA, 528 bp, Homo sapiens
  misc_feature: GYAE6OF01DZBS3.42.10.A10.1.454.CMB.1.raw
  modified_base (284)..(284): a, c, t, g, unknown or other
  misc_feature (284)..(284): n is a, c, g, or t
  modified_base (349)..(349): a, c, t, g, unknown or other
  misc_feature (349)..(349): n is a, c, g, or t
  modified_base (380)..(380): a, c, t, g, unknown or other
  misc_feature (380)..(380): n is a, c, g, or t
  modified_base (421)..(421): a, c, t, g, unknown or other
  misc_feature (421)..(421): n is a, c, g, or t
  modified_base (491)..(491): a, c, t, g, unknown or other
  misc_feature (491)..(491): n is a, c, g, or t
tcagtgacgtatgtcacgaccggtgctcgatttagcgtcgatctcagggggaggaactgctcagttaggacccagagggaaccatggaagtcccagctcagcttctcttcctcctgctactctggctcccagatagtaccggagagattgtgttgacacagtatccagccaccctgtcttgtctccgagggaaagcgccaccctctcctgttgggccagtcagagtattaacaactacttagcctggaccagcagagcctgccaggctccagctcctcattatnatgcactaccaacacgggccactggcactcccagccaggttcagtggcgaggtgggtctgggacngacttcgactctcaccatcagcagtatagancctagaagtattttgctagtttactattagtcagctaccgnacgcacgcgtcggtccccggttgggttccgggcggacggaacaaggtagaagtacacgaaacgacgtcgngctcgaccacctagtcctagtacctctctccgtcccg

SEQ ID NO: 128684 - DNA, 894 bp, Homo sapiens
  misc_feature: GYAE6OF01EWLZ1.42.10.A10.1.454.CMB.1.raw
tcagtgacgtatgtcacgaccggtgctcgatttagcgtcgatctcagggggaggaactgctcagttaggacccagagggaaccatggaagtcccagctcagcttctcttcctcctgctactctggctcccagatagtaccggagagattgtgttgacacagtatccagccacctgttctttgtcctaccgaaggggaaacacgcccacccttctccgttggtcgggccagtcgaagacgttaattaaaccaaacttacgttacgcctggtaccagacaaggacgaccgttcgggacccgtaacgggcccttaccccgacgggtccctaccgttacttaactttttagtacggaatttcggacctaaaccgtttaaccccgaaaacggtaccccgggggtaccctaaccggtcggggtacccaaccgtttacccccgaacgggtaccccgttaacgggtttaaccggaacgggttacggggacctaagggggttccggggttacggtacggggaaaccgtacgtacccgtttaacctaccctaccttacccggaaacctactaccgtaacggacgttaacgtaagttaacggtaacccgtaaccgttaagggttaaacgtttaaggttttaccgtaacgtttaacgtttttacgtttacgtttacgttacgtaacgacccgtaccgacgacgccgtacgccggttaccggtacccgggttcggggttaaccgggacccggggtaacgggtaaacccgtaaaggtaccgtaaaggttaacccgtaaaccgtaaaaccgggtacgtagggttaacccggactacggtaacccgtaaccttaccgtaccgttttacgggttaccctttaacccgttacccgttccccgttaacccccg

SEQ ID NO: 128685 - DNA, 692 bp, Homo sapiens
  misc_feature: GYAE6OF01A3AZN.42.10.A10.1.454.CMB.1.raw
  modified_base (480)..(480): a, c, t, g, unknown or other
  misc_feature (480)..(480): n is a, c, g, or t
  modified_base (581)..(581): a, c, t, g, unknown or other
  misc_feature (581)..(581): n is a, c, g, or t
  modified_base (633)..(633): a, c, t, g, unknown or other
  misc_feature (633)..(633): n is a, c, g, or t
  modified_base (637)..(637): a, c, t, g, unknown or other
  misc_feature (637)..(637): n is a, c, g, or t
  modified_base (657)..(657): a, c, t, g, unknown or other
  misc_feature (657)..(657): n is a, c, g, or t
  modified_base (675)..(675): a, c, t, g, unknown or other
  misc_feature (675)..(675): n is a, c, g, or t
  modified_base (682)..(682): a, c, t, g, unknown or other
  misc_feature (682)..(682): n is a, c, g, or t
tcagtgacgtatgtcacgaccggtgctcgatttagcgtcgatctcagggggaggaactgctcagttaggacccagagggaaccatggaagtcccagctcagtcttctcttccctcctgctactctggcctcccagatacggtaccggagagtattggtgttcgacacagtatccacgccctaccctgttcttgtcctaccgaaggggaagcgcccaccctcgtcctggttcgggcctagtcgaagtagttaacttaacctaacttactacgccgtagtaccagccagtacgaccgtcggacccgaggtcccacccggagtccctccctattaatttacgtgtatcacctaactacccgaaacggtaccgggacctacggtacgccgtaccctacccgacgtccggtaagtacgtagggtcggacgtaggggtcggtcggacgggaactacggtacgttaccctacgtacacctaccgtanaccgacgtaccgtagttaagtacggtacgtaccgttaagttaacgtttcgtttacggtactttaagtttacttagttaccggtacaccgtaccacgtacgngtacctagggtccgtcgggtaccggttcgggtaccggagtaacggaacgtangganaccgagaacctgtgacgtcncacgacttcgtatccttnacccttntcccggtacc

SEQ ID NO: 128686 - DNA, 493 bp, Homo sapiens
  misc_feature: GYAE6OF02H23VK.42.10.A10.1.454.CMB.1.raw
  modified_base (195)..(195): a, c, t, g, unknown or other
  misc_feature (195)..(195): n is a, c, g, or t
tcagtgacgtatgtcacgaccggtgctcgatttagcgtcgatctcaggggaggaactgctcagttaggacccagagggaaccatggaagtcccagctcagcttctcttcctcctgctactctggctcccagatagtaccggagagattgtgttgacacagtatccagccaccctgtctttgtctccaggggaaangccaccctctcctgttgggccagtcagagtattaacaactacttagcctggtaccagcagagacctggccaggctcccaggctcctcatttatgatgcatccaacagggccactggcatcccagccaggttcagtggcagtgggtctgggacagacttcactctcaccatcagcagattagagcctgaagatttgcagtttactattgtcagcacgcagcagctgcccgtcggttcggcggagggaccaaagtagagatacaacgacgtgtggctgcaccatctgtcttcatctcccg

SEQ ID NO: 128687 - DNA, 520 bp, Homo sapiens
  misc_feature: GYAE6OF02JEWCI.42.10.A10.1.454.CMB.1.raw
  modified_base (200)..(200): a, c, t, g, unknown or other
  misc_feature (200)..(200): n is a, c, g, or t
  modified_base (296)..(296): a, c, t, g, unknown or other
  misc_feature (296)..(296): n is a, c, g, or t
  modified_base (309)..(309): a, c, t, g, unknown or other
  misc_feature (309)..(309): n is a, c, g, or t
tcagtgacgtatgtcacgaccggtgctcgatttagcgtcgatctcaggggaggaactgctcagttaggacccagagggaaccatggaagtcccagctcagcttctcttcctcctgctactctggctcccagatagtaccggagagattggtgttgacacgtagtatccagcctaccctgtctttgtctccaggggaaagngccacctctcctgttgggccaggtcagagtattaacaactacgttagcctggtaccagcagagacctggccaggctcccgaggcctcctcatttangatgcatccaacngggccactggcactccgagccaggttcagtgcagtgggtctgggacagacttcactctcacatcagcagatagagcctagagatttgactagtttactattgtacagacacgcagcagctgacccgtgttcggacggaggtaccaaagtagagacgtacgaaacgacgtgtaggcgttagacctaccagtcgtgtccttcactccttcccg

SEQ ID NO: 128688 - DNA, 498 bp, Homo sapiens
  misc_feature: GYAE6OF02GU0PE.42.10.A10.1.454.CMB.1.raw
  modified_base (195)..(195): a, c, t, g, unknown or other
  misc_feature (195)..(195): n is a, c, g, or t
  modified_base (287)..(287): a, c, t, g, unknown or other
  misc_feature (287)..(287): n is a, c, g, or t
  modified_base (472)..(472): a, c, t, g, unknown or other
  misc_feature (472)..(472): n is a, c, g, or t
tcagtgacgtatgtcacgaccggtgctcgatttagcgtcgatctcagggggaggaactgctcagttaggacccagagggaaccatggaagtcccagctcagcttctcttcctcctgctactctggctcccagatagtaccggagagattgtgttgacacagtatccagccaccctgtctttgtctccaggggaangccacctctcctgttgggccagtcagagtattaacaactacttagcctggtaccagcagagacctggccaggctcccaggctcctcatttangatgcatccaacagggccactggcatcccagccaggttcagtgcagtgggtctggggacagacttcactctcaccatcagcagattagagcctagaagtatttgctagtttactattgtcagcaccgcagcagctggcccgtcggtttcggcggacgggaccaaagtagagatacgaacgagtgngctgcacatctgtcttcactctcccg

SEQ ID NO: 128689 - DNA, 507 bp, Homo sapiens
  misc_feature: GYAE6OF02I1PDZ.42.10.A10.1.454.CMB.1.raw
  modified_base (302)..(302): a, c, t, g, unknown or other
  misc_feature (302)..(302): n is a, c, g, or t
  modified_base (494)..(494): a, c, t, g, unknown or other
  misc_feature (494)..(494): n is a, c, g, or t
tcagtgacgtatgtcacgaccggtgctcgatttagcgtcgatctcagggggaggaactgctcagttaggacccagagggaaccatggaagtcccagctcagcttctcttcctcctgctactctggctcccagatagtaccggagagattgtgttgacacagtatccagccaccctgtctttgtctccaggggaaagagccaccctctcctgttgggccagtcagagtattaacaactacttagcctggtaccagcagagacctggccaggctcccaggctcctcatttatgatgcatccaanagggccactggcatcccagccaggttcagtggcagtgggtctgggacaggacttcactctcaccatcagcagattagagcctgaagtattttgctagttttactattgttcagcaccgcacgcagctcggcccgtcggtttcggcggacgggacaaaggtagagatacgaacgagtgtggctgcaccatctntctctatctcccg

SEQ ID NO: 128690 - DNA, 495 bp, Homo sapiens
  misc_feature: GYAE6OF02F1BDV.42.10.A10.1.454.CMB.1.raw
  modified_base (196)..(196): a, c, t, g, unknown or other
  misc_feature (196)..(196): n is a, c, g, or t
  modified_base (479)..(479): a, c, t, g, unknown or other
  misc_feature (479)..(479): n is a, c, g, or t
tcagtgacgtatgtcacgaccggtgctcgatttagcgtcgatctcagggggaggaactgctcagttaggacccagagggaaccatggaagtcccagctcagcttctcttcctcctgctactctggctcccagatagtaccggagagattgtgttgacacagtatccagccaccctgtctttgtctccaggggaaangccaccctctcctgttggccagtcagagtattaacaactacttagcctggtaccagcagagacctggccaggctcccaggctcctcatttatgatgcatccaacagggccactggcatcccagccaggttcagtggcagtgggtctgggacagacttcactctcaccatcagcagattagagcctgaagtatttgctagtttactattgtcagcaccgcagcagctggcccgtcggttcggcggagggaccaaagtagagatacgaagacgtgtagctgcacntctgtctcatctcccg

SEQ ID NO: 128691 - DNA, 519 bp, Homo sapiens
  misc_feature: GYAE6OF02HNBAZ.42.10.A10.1.454.CMB.1.raw
  modified_base (196)..(196): a, c, t, g, unknown or other
  misc_feature (196)..(196): n is a, c, g, or t
tcagtgacgtatgtcacgaccggtgctcgatttagcgtcgatctcagggggaggaactgctcagttaggacccagagggaaccatggaagtcccagctcagcttctcttcctcctgctactctggctcccagatagtaccggagagattgtgttgacacagtatccagccaccctgtctttgtctccaggggaaangccaccctctcctgttgggccagtcagagtattaacaactacttagcctggtaccagcagagacctggccaggctcccaggctcctcatttatgatgcatccaacagggccactggcatcccagccaggttcagtggcagtgggtctgggacagacttcactctcaccatcagcagattagagcctagaagtattttgacttagtttactattgtcagcaccgcagcagcctcggcccgtcgggtttcggcggacgggaaccgaaaggtagagatacaaacgtacgtggtggctgaccacatctgttcttctacttcctcccg

SEQ ID NO: 128692 - DNA, 527 bp, Homo sapiens
  misc_feature: GYAE6OF02G03HD.42.10.A10.1.454.CMB.1.raw
  modified_base (198)..(198): a, c, t, g, unknown or other
  misc_feature (198)..(198): n is a, c, g, or t
  modified_base (293)..(293): a, c, t, g, unknown or other
  misc_feature (293)..(293): n is a, c, g, or t
  modified_base (393)..(393): a, c, t, g, unknown or other
  misc_feature (393)..(393): n is a, c, g, or t
  modified_base (505)..(505): a, c, t, g, unknown or other
  misc_feature (505)..(505): n is a, c, g, or t
  modified_base (511)..(511): a, c, t, g, unknown or other
  misc_feature (511)..(511): n is a, c, g, or t
tcagtgacgtatgtcacgaccggtgctcgatttagcgtcgatctcagggggaggaactgctcagttaggacccagagggaaccatggaagtcccagctcagcttctcttcctcctgctactctggctcccagatagtaccggagagtattgtgttgactacagtatccagccaccctgtcttgtctccgaggggaaangccgacctctcctgtgggccagtcagagtattaacaactacttagcctggtaccagcagagacctggccaggcctcccaggcctcctcattttanggatgacatccaaacgacgggccactggcactcccagcctaggttccaggtgcaggtgggtctgggacagtacttcactctcaccatccagcagattagngctagaagtatttgactagtttactagttgtacagcacgcagcagctcggcccgtggttcggcggacggaacgtaaagagagatacgaaacgtacgtgcgtcgtcgactacnttcgtntcttctcgtcctaccg

SEQ ID NO: 128693 - DNA, 525 bp, Homo sapiens
  misc_feature: GYAE6OF02IXJKL.42.10.A10.1.454.CMB.1.raw
  modified_base (195)..(195): a, c, t, g, unknown or other
  misc_feature (195)..(195): n is a, c, g, or t
tcagtgacgtatgtcacgaccggtgctcgatttagcgtcgatctcagggggaggaactgctcagttaggacccagagggaaccatggaagtcccagctcagcttctcttcctcctgctactctggctcccagatagtaccggagagattgtgttgacacagtatccagccaccctgtctttgtctccaggggaanagccaccctctcctgttgggccagtcagagtattaacaactacttagcctggtaccagcagagacctggccaggctcccaggctcctcatttatgatgcatccaacagggccactggcatcccagccaggttcagtgcagtggtctgggacagacttcactctcaccatcagcagattagagctagaagtatttgactagtttactattgtcagccaccgcgagcagccgttcggcccgttcgggtttccggcgggacgggaaccgaaagtagagataccgaaacgacgtggtacggacgtgccacctatctgttcttcactcctacccg

SEQ ID NO: 128694 - DNA, 587 bp, Homo sapiens
  misc_feature: GYAE6OF02I1M7X.42.10.A10.1.454.CMB.1.raw
  modified_base (194)..(194): a, c, t, g, unknown or other
  misc_feature (194)..(194): n is a, c, g, or t
  modified_base (202)..(202): a, c, t, g, unknown or other
  misc_feature (202)..(202): n is a, c, g, or t
  modified_base (285)..(285): a, c, t, g, unknown or other
  misc_feature (285)..(285): n is a, c, g, or t
  modified_base (355)..(355): a, c, t, g, unknown or other
  misc_feature (355)..(355): n is a, c, g, or t
tcagtgacgtatgtcacgaccggtgctcgatttagcgtcgatctcagggggaggaactgctcagttaggacccagagggaaccatggaagtcccagctcagcttctcttcctcctgctactctggctcccagatagtaccggagagattgtgttgacacagtatccagccacctgtctttgtctccagggaaangccacctntcctgttggccagtcagagtattaacaactacttagcctggtaccagcagagacctggccaggctcccaggctcctcatttangatgcatccaacacggccacgtggcactcccagcaggttcagtgcagtggtctgggacagacttcactcncaccatcagacagtacttagacgcctagaatagttttgacgtagtttaactagttgtactagtcaccgcgacgtcagtcgtcggtacccggttcgggtttaccgggccgggtaacgggtaacccgaaaaggttacgaaggtaaccgtacgaaaacggtaaccgttgggtaccggtcgtacgtaccgaaccgtacgtttccgtagttcctttactacgttcccttacccccgg

SEQ ID NO: 128695 - DNA, 523 bp, Homo sapiens
  misc_feature: GYAE6OF02IOENG.42.10.A10.1.454.CMB.1.raw
  modified_base (197)..(197): a, c, t, g, unknown or other
  misc_feature (197)..(197): n is a, c, g, or t
  modified_base (303)..(303): a, c, t, g, unknown or other
  misc_feature (303)..(303): n is a, c, g, or t
  modified_base (418)..(418): a, c, t, g, unknown or other
  misc_feature (418)..(418): n is a, c, g, or t
tcagtgacgtatgtcacgaccggtgctcgatttagcgtcgatctcagggggaggaactgctcagttaggacccagagggaaccatggaagtcccagctcagcttctcttcctcctgctactctggctcccagatagtaccggagagattgtgttgacacagtatccagccaccctgtctttgtctccaggggaaagngccaccctctcctgttgggccagtcagagtattaacaactacttagcctggtaccagcagagacctggccaggctcccaggctcctcatttatgatgcatccaacngggccactggcatcccagccaggttcagtgcagtgggtctgggacagacttcactctcaccatcagcagattagagcctagaagtattttgctagtttactattgtcagcaccgnagcagctcggcccgtcggtttcggcggtacgggaccgaaagtagagacgtacgaaacgacgtgtacggctgacaccgatcgtgttccttactacttccttccccg

SEQ ID NO: 128696 - DNA, 497 bp, Homo sapiens
  misc_feature: GYAE6OF02HM717.42.10.A10.1.454.CMB.1.raw
  modified_base (196)..(196): a, c, t, g, unknown or other
  misc_feature (196)..(196): n is a, c, g, or t
  modified_base (258)..(258): a, c, t, g, unknown or other
  misc_feature (258)..(258): n is a, c, g, or t
  modified_base (289)..(289): a, c, t, g, unknown or other
  misc_feature (289)..(289): n is a, c, g, or t
  modified_base (302)..(302): a, c, t, g, unknown or other
  misc_feature (302)..(302): n is a, c, g, or t
  modified_base (479)..(479): a, c, t, g, unknown or other
  misc_feature (479)..(479): n is a, c, g, or t
tcagtgacgtatgtcacgaccggtgctcgatttagcgtcgatctcagggggaggaactgctcagttaggacccagagggaaccatggaagtcccagctcagcttctcttcctcctgctactctggctcccagatagtaccggagagattgtgttgacacagtatccagccaccctgtctttgtctccaggggaaangccaccctctcctgttgggccagtcagagtattaacaactacttagcctggtaccagcaganacctggccaggctcccaggctcctcatttangatgcatccaacngggccactggcatcccagccaggttcagtgcaggtggtctgggacagacttcactctcaccatcagcagatagagctagaagtatttgactagtttactattgtacagcacgcagcagcgtcggccgtcggttcggcggacggacaaagagagatacaacgtacgtgcggctgcacntctgtctctctctacccg

SEQ ID NO: 128697 - DNA, 619 bp, Homo sapiens
  misc_feature: GYAE6OF02JZV63.42.10.A10.1.454.CMB.1.raw
  modified_base (195)..(195): a, c, t, g, unknown or other
  misc_feature (195)..(195): n is a, c, g, or t
  modified_base (292)..(292): a, c, t, g, unknown or other
  misc_feature (292)..(292): n is a, c, g, or t
tcagtgacgtatgtcacgaccggtgctcgatttagcgtcgatctcagggggaggaactgctcagttaggacccagagggaaccatggaacgtccagctcagcttctcttcctcctgctactctggctcccagatagtaccggagagattgtgttgacacagtatccagcccacctgtcttgtctccgaggggaangccacctctccgtgttcgggccagtcagagtattaacactactagcctggtaccagcagacgacctggccaggcctcccaggcctcctctatttacngaatgcactccaacgtacgggacccacgtggccacgtcccagcctaggttccaggtcggacaggtggtctgggacagtaccgttcacgtctaccacctatcgacgcctaagtacgttaggacgtcctaggtaacgttacttttagacgttagttttacgtattcgtactacgaccgtaaccgtctacggtacacgtccgttccggtcccggttacgggttcggacgggtacggtaacgtaacgtaaggacgtaacgtacgaaacggtacgtcggtaacgcgtacgaccgtactacgtcgttacgttactacgtacgtccttaccccg

SEQ ID NO: 128698 - DNA, 539 bp, Homo sapiens
  misc_feature: GYAE6OF02HWOLP.42.10.A10.1.454.CMB.1.raw
  modified_base (193)..(193): a, c, t, g, unknown or other
  misc_feature (193)..(193): n is a, c, g, or t
  modified_base (286)..(286): a, c, t, g, unknown or other
  misc_feature (286)..(286): n is a, c, g, or t
  modified_base (345)..(345): a, c, t, g, unknown or other
  misc_feature (345)..(345): n is a, c, g, or t
  modified_base (415)..(415): a, c, t, g, unknown or other
  misc_feature (415)..(415): n is a, c, g, or t
tcagtgacgtatgtcacgaccggtgctcgatttagcgtcgatctcagggggaggaactgctcagttaggacccagagggaaccatggaagttcccagctcagcttctcttcctcctgctactctggctcccagatagtaccggagagattgtgttgacacagtatccagccacctgtctttgtctcagggaangccacctctcctgttcgggccagtcagagtattaacactacttagcctggtaccagcagagacctggccaggctcccaggctcctcattttangatgcatccaacagggccactggcatcccagccaggttcagtgcagtgggtctgggacngacttcactctcaccatccagcagtattagagcctgaagtattttgctagtttactattgtcagcaccgnacgcagcgtcggcccgttcgggtttcggacgggtacgggtaaccaaaggtacgagactacgaacgtaacgtggtacggctacgaccaccgtacgttctacgttcctttacgacttccttacccg

SEQ ID NO: 128699 - DNA, 572 bp, Homo sapiens
  misc_feature: GYAE6OF02IACYH.42.10.A10.1.454.CMB.1.raw
tcagtgacgtatgtcacgaccggtgctcgatttagcgtcgatctcagggggaggaactgctcagttaggacccagagggaaccatggaagtcccagctcagcttctcttcctcctgctactctggctcccagatagtaccggagagattgtgttgacacagtatccagccaccctgtctttgctccaggggaaagagccaccctctcctgtgggccagtcagagtattaacaactacttagcctggtaccagcagacgacctggccaggcctcccaggcctcctcatttatgatgcatccaaacgagggccactggcactcccagcctaggttcagtggcaggtgggtctgggacagacttcactctacaccatcagcagattagacgctagaagtattttgactagtttactattagtactagcaccgtcagacagtccgtacggtcccgttcgggtttcgggacgggaacgggaaccgaaaggtacgaagactacgaaaacggtacgtacggtacggctacgacctaccgtacttccgtacgttacctttacgtacttcccgttaccccg

SEQ ID NO: 128700 - DNA, 523 bp, Homo sapiens
  misc_feature: GYAE6OF02F8GUS.42.10.A10.1.454.CMB.1.raw
  modified_base (195)..(195): a, c, t, g, unknown or other
  misc_feature (195)..(195): n is a, c, g, or t
  modified_base (204)..(204): a, c, t, g, unknown or other
  misc_feature (204)..(204): n is a, c, g, or t
  modified_base (288)..(288): a, c, t, g, unknown or other
  misc_feature (288)..(288): n is a, c, g, or t
  modified_base (499)..(499): a, c, t, g, unknown or other
  misc_feature (499)..(499): n is a, c, g, or t
tcagtgacgtatgtcacgaccggtgctcgatttagcgtcgatctcagggggaggaactgctcagttaggacccagagggaaccatggaagtcccagctcagcttctcttcctcctgctactctggctcccagatagtaccggagagattgtgttgacacagtatccagccaccctgtctttgtctccaggggaangccaccctntcctgttgggccagtcagagtattaacaactacttagcctggtaccagcagagacctggccaggctcccaggctcctcatttangatgcatccaacagggccactggcactcccagccaggttcagtggcagtgggtctgggacagacttcactctcaccatcagcagattagagcctagaagtattttgctagtttactattgtcagcaccgcagcagcgtcggcccggttcggttcggcggtacggaaccaaaggtagagactacgaaacgtacgtggtacgcgtcgcaccgntcttgtcttctacttccttacccg

SEQ ID NO: 128701 - DNA, 550 bp, Homo sapiens
  misc_feature: GYAE6OF02G8A3N.42.10.A10.1.454.CMB.1.raw
  modified_base (196)..(196): a, c, t, g, unknown or other
  misc_feature (196)..(196): n is a, c, g, or t
  modified_base (306)..(306): a, c, t, g, unknown or other
  misc_feature (306)..(306): n is a, c, g, or t
tcagtgacgtatgtcacgaccggtgctcgatttagcgtcgatctcagggggaggaactgctcagttaggacccagagggaaccatggaagtcccagctcagcttctcttcctcctgctactctggctcccagatagtaccggagagattgtgttgacacagtatccagccaccctgtctttgtctccaggggaaanaggccaccctctcctgttcgggccagtcagagtattaacaactacttagcctggtaccagcagagacctggccaggctcccgaggctcctcatttatgatgcatccaacngggccactggcatcccagccaggttcagtggcaggtgggtctggggacaggtacttcactctcacctatcagcagattagagcctagaagtattttgcttaagtttactattgtcagtctaccgcagcagccgtcggtcccgttcgggtttcggcgggacgggtaaccgtaaaggtagagactacgaaacgtacgtcggtaggctcgactacgtactcgttcgttcttactactccttaccccg

SEQ ID NO: 128702 - DNA, 586 bp, Homo sapiens
  misc_feature: GYAE6OF02JGKCQ.42.10.A10.1.454.CMB.1.raw
  modified_base (191)..(191): a, c, t, g, unknown or other
  misc_feature (191)..(191): n is a, c, g, or t
  modified_base (297)..(297): a, c, t, g, unknown or other
  misc_feature (297)..(297): n is a, c, g, or t
tcagtgacgtatgtcacgaccggtgctcgatttagcgtcgatctcagggggaggaactgctcagttaggacccagagggaaccatggaagtcccagctcagcttctcttcctcctgctactctggctcccagatagtaccggagagattgtgttgacacagtatccagccacctgtctttgctcagggaangccacctctcctgttggccagtcagagtattaacaactacttagcctggtaccagcagagacctggccaggctcccgaggctcctcatttatgatgcatccaacgngggccacgtggacatcccagccaggttcaggtcggcgaggtcgggtctgggacaggacttcactctaccacatcgagctagtattagacgtcctagaagtatttagacgttaacgtttactattagtactagtaccgaccgctagcgtacgtcgtaccggtcccggttacgggtttccgggacggtaacgggtaaccgtaaaggtacgaacgtacgtacgtaaacgtacggtaggtacgacgtacgaccgtacgtacgtcgttacgtacttactacttcccgttacccg

SEQ ID NO: 128703 - DNA, 550 bp, Homo sapiens
  misc_feature: GYAE6OF02FNJNH.42.10.A10.1.454.CMB.1.raw
  modified_base (196)..(196): a, c, t, g, unknown or other
  misc_feature (196)..(196): n is a, c, g, or t
  modified_base (290)..(290): a, c, t, g, unknown or other
  misc_feature (290)..(290): n is a, c, g, or t
tcagtgacgtatgtcacgaccggtgctcgatttagcgtcgatctcagggggaggaactgctcagttaggacccagagggaaccatggaagtcccagctcagcttctcttcctcctgctactctggctcccagatagtaccggagagattgtgttgacacagtatccagccaccctgtctttgtctccaggggaaangccaccctctcctgttgggccagtcagagtattaacaactacttagcctggtaccagcagagacctggccaggcctcccaggctcctcatttangatgcatccaacagggccactggcatcccagccaggttcagtggcagtgggtctgggacagacttcactctcacctatcagcagattagacgcctgaagtatttgctagtttactattgtcagcaccgcagcacgcgtcggtcccgttcggtttcgggcgggacgggaacccgtaaaggtagagacgtacgaaacggtaaccgtggtacggtacctacggtacctaccgtagttcctgttccttctacttccgttccccg

SEQ ID NO: 128704 - DNA, 700 bp, Homo sapiens
  misc_feature: GYAE6OF02HQH58.42.10.A10.1.454.CMB.1.raw
  modified_base (304)..(304): a, c, t, g, unknown or other
  misc_feature (304)..(304): n is a, c, g, or t
  modified_base (412)..(412): a, c, t, g, unknown or other
  misc_feature (412)..(412): n is a, c, g, or t
  modified_base (444)..(444): a, c, t, g, unknown or other
  misc_feature (444)..(444): n is a, c, g, or t
tcagtgacgtatgtcacgaccggtgctcgatttagcgtcgatctcagggggaggaactgctcagttaggacccagagggaaccatggaagtcccagctcagcttctcttcctcctgctactctggctcccagatagtaccggagagattgtgttgacacagtatccagccaccctgttctttgtctccgagggaaacgagaccgaccctctcctgttcggccagtcagagttacttaacgaacttacttacgccttagtaccagcaggacgacctcggcaggcctccgaggcctcctcatttancgtactgactactaccgtaaccgacgggtacccacgttcggacctaccgtaccccgacgtccgtacggttaccgaggttcggcgtagggttcgggtacgtgggtaacncggtacttaccgaacgttcgtaccaccgtacncgaacgacaacgtactacggaccgtcgtagtaaagttacgttttacggaacgttaagtttactttacgttacgttacttacggactacgaacgtacggaccttacgggaccgttaccgggtcccggttccgggttacggaccgggtaacggtaaccggaaagtacgggacgtaacggtaccgtaaacggtacgtcggttacggaccgttaccggactacgtcttaccggtcttaccgttctaccttccgtaccccg

SEQ ID NO: 128705 - DNA, 724 bp, Homo sapiens
  misc_feature: GYAE6OF02JPVWH.42.10.A10.1.454.CMB.1.raw
  modified_base (197)..(197): a, c, t, g, unknown or other
  misc_feature (197)..(197): n is a, c, g, or t
  modified_base (289)..(289): a, c, t, g, unknown or other
  misc_feature (289)..(289): n is a, c, g, or t
  modified_base (297)..(297): a, c, t, g, unknown or other
  misc_feature (297)..(297): n is a, c, g, or t
tcagtgacgtatgtcacgaccggtgctcgatttagcgtcgatctcaggggaggaactgctcagttaggacccagagggaaccatggaagtcccagctcagcttctcttcctcctgctactctggcctcccagatagtaccggagagattgtgttgacactagtatccagccacctgtctttgacctccgaggggaancgcccacctctcctgttgggccagttcagtagtattaacactaacttgaccttggaccagccagacgacctggccaggctcccgagcctccntactttangactgcaactccaacgtaggccctaacgtggaccaacttccccagttaccgacggtttccaacgttgggacctaggttggggtccgtcggggacctaaggtacccgtttacaacccgttctaccaacccgtacttaccgaaggaccgtaaacgtaacgttaggaccgtaccgtcggtaaacgttagttttacgaccgttaacgttttaactacgtttacgttaccgtaagttacccgtaccggaactacggacggtaacgtccgttaccgggtaccccggtttcggggtttaacccggccgggtaaacgggtaacccgaaaggttaaccggaagtaacgttaccgaaaccgtaacggttaacgggtactacggtccgtacccgaacggtcttaccggtattacccgttattaccgtcccgttacccg

SEQ ID NO: 128706 - DNA, 710 bp, Homo sapiens
  misc_feature: GYAE6OF02JP7Z4.42.10.A10.1.454.CMB.1.raw
  modified_base (195)..(195): a, c, t, g, unknown or other
  misc_feature (195)..(195): n is a, c, g, or t
tcagtgacgtatgtcacgaccggtgctcgatttagcgtcgatctcagggggaggaactgctcagttaggacccagagggaaccatggaagtcccagctcagcttctcttcctcctgctactctggctcccagatagtaccgagagattgtgttgacacagtatccagccaccctgtctttgtctcgaggggaaancgccacctctcctgttggccagtcagtagtattaacaactacttacgccgtaggtaaccaggcacgacgaccccgcgaggcctcccgaggtcctccgtactatttagcactgccaatacccgaaagcgggtcccaagtcggtaccacgttccccaaggtcccgtaaggttcaagggtcgacgtaggtcgggtctaaggggactacggtcctttacaaccttcgtacacctaacgtcgacgacgtaacgttagttacggacgtacccgtaggtaaacgttaacgttttcgaaaccgtttaaggtttaactagtttacggtacgtaaccgtaccgtacccggagtacgacgtaccggtcggtaccgggttcccggttaggggtttcccgggacggtaacggggtaaacccaaaaggttacggaacgtaacgttaccgaaacgttacggttacggtcggtactaccgaacgtacctacggttcttccggtaccgttacgtacttcccgtacccgtacc

SEQ ID NO: 128707 - DNA, 571 bp, Homo sapiens
  misc_feature: GYAE6OF02HPRYN.42.10.A10.1.454.CMB.1.raw
  modified_base (196)..(196): a, c, t, g, unknown or other
  misc_feature (196)..(196): n is a, c, g, or t
  modified_base (287)..(287): a, c, t, g, unknown or other
  misc_feature (287)..(287): n is a, c, g, or t
  modified_base (293)..(293): a, c, t, g, unknown or other
  misc_feature (293)..(293): n is a, c, g, or t
  modified_base (308)..(308): a, c, t, g, unknown or other
  misc_feature (308)..(308): n is a, c, g, or t
tcagtgacgtatgtcacgaccggtgctcgatttagcgtcgatctcagggggaggaactgctcagttaggacccagagggaaccatggaagtcccagctcagcttctcttcctcctgctactctggctcccagatagtaccggagagattgtgttgacacagtatccagccaccctgtctttgtctccaggggaaancgccaccctctcctgttggccagtcagagtattaacacttacttagccttggtaccagcagagacctggccaggcctcccgaggcctcctnatttangatgcactccaacgngggcccacgtggaccactccccagccaggttcaggtggactaggtgggtctggggacagtaccttcacttctacacccatcagctagtatagagtctagaagttatttgtacttagtttacttattgtcacgcaccgcgagcagccgtcggtcccggttcgggtttacgggcgggtaacggaaccgaaagtacgagactacgaaacgtacgtggtacggtcgtcgaccacctacttcgtcgttcttactacttcccgttcccg

SEQ ID NO: 128708 - DNA, 545 bp, Homo sapiens
  misc_feature: GYAE6OF02IFHMO.42.10.A10.1.454.CMB.1.raw
  modified_base (198)..(198): a, c, t, g, unknown or other
  misc_feature (198)..(198): n is a, c, g, or t
tcagtgacgtatgtcacgaccggtgctcgatttagcgtcgatctcagggggaggaactgctcagttaggacccagagggaaccatggaagtccccagctcagcttctcttcctcctgctactctggctcccagatagtaccggagagattgtgttgacacagtatccagccaccctgtctttgtctccaggggaaagngccaccctctcctgttgggccagtcagagtattaacaactacttagcctggtaccagcaagagacctggccaggctcccaggcctcctcatttatgatgcatccaacagggccacgtggcactcccagccaggttcagtggcaggtggtctgggacagacttcactctcaccatcagcagattagagtcctagaagtatttgctagtttactattgtactagcaccgcagcagcgtacggcccggttcggtttcggcgggaggaaccgtaaaggtagaagactacgaaaacgtacgtcggtgtcgtgaccaccgattcgttacgttcttactacgttccttaccccg

SEQ ID NO: 128709 - DNA, 641 bp, Homo sapiens
  misc_feature: GYAE6OF02JGN6P.42.10.A10.1.454.CMB.1.raw
  modified_base (197)..(197): a, c, t, g, unknown or other
  misc_feature (197)..(197): n is a, c, g, or t
  modified_base (207)..(207): a, c, t, g, unknown or other
  misc_feature (207)..(207): n is a, c, g, or t
  modified_base (262)..(262): a, c, t, g, unknown or other
  misc_feature (262)..(262): n is a, c, g, or t
  modified_base (302)..(302): a, c, t, g, unknown or other
  misc_feature (302)..(302): n is a, c, g, or t
  modified_base (488)..(488): a, c, t, g, unknown or other
  misc_feature (488)..(488): n is a, c, g, or t
tcagtgacgtatgtcacgaccggtgctcgatttagcgtcgatctcagggggaggaactgctcagttaggacccagagggaaccatggaagtcccagctcagcttctcttcctcctgctactctggcctcccagatagtaccggagagattgtgttgacacagtatccagccaccctgtcttgctccgaaggggaaancgccaccctntcctggttacggccagtcagagttattaacactacttagcctggtaccagcaagngacctggccaggcctcccgaggtcctacctcgaattttangatcgctactaccaacgcgggccactggccaactcccagcccgaggtttccaggtcggacctaggttcgggtcgtacgggacaggtaccttcgactctactaccgatcgaagcaagtacttagacgactagtaagtattttcgacttaagtttaccttagttcgtacgtacgacgtaccgacgacnccgaacgtcggtccggtcccggtacggggttcggacgggtacggggaaccctaaaggtaacgacgtaacgtacgaaaccgtacgtacgggtcgacgtacgacctaaccgttacgttaccgttgttaccttactaccgtttcccgttacccccg

SEQ ID NO: 128710 - DNA, 612 bp, Homo sapiens
  misc_feature: GYAE6OF02GSX04.42.10.A10.1.454.CMB.1.raw
  modified_base (196)..(196): a, c, t, g, unknown or other
  misc_feature (196)..(196): n is a, c, g, or t
tcagtgacgtatgtcacgaccggtgctcgatttagcgtcgatctcagggggaggaactgctcagttaggacccagagggaaccatggaagtcccagctcagcttctcttcctcctgctactctggctcccagatagtaccggagagattgtgttgacacagtatccagccaccctgtctttgtctccaggggaaanagcccacctctcctgttgggccagtcagagtattaacaactacttagcctggtaccagcagagacctggccaggcctcccgaggcctcctcatttatgatgcataccaacgacgggccacgtggccactccccagcccgtaaggtttcaggttcggcgtaggtcggggtctggggacaggtacttcgactctcaccatacacgtacagtattacggacgtacctaggaagttattttgacttagtttactagtttcgtactacgcaccgcgagccgacgcgtccgggtcccggttcgggtttccgggacgggtaacgggaacctaaaggtagtagaactacgaaccggtacgttggcggtacgtacggacctaaccgtacttccgttacgttaccttctaccgttcccgttacccg

SEQ ID NO: 128711 - DNA, 650 bp, Homo sapiens
  misc_feature: GYAE6OF02IG3Q1.42.10.A10.1.454.CMB.1.raw
  modified_base (191)..(191): a, c, t, g, unknown or other
  misc_feature (191)..(191): n is a, c, g, or t
  modified_base (199)..(199): a, c, t, g, unknown or other
  misc_feature (199)..(199): n is a, c, g, or t
  modified_base (291)..(291): a, c, t, g, unknown or other
  misc_feature (291)..(291): n is a, c, g, or t
tcagtgacgtatgtcacgaccggtgctcgatttagcgtcgatctcagggggaggaactgctcagttaggacccagagggaaccatggaagtcccagctcagcttctcttcctcctgctactctggctcccagatagtaccggagagattgtgttgacacagtatccagccacctgtctttgctcagggaangccacctntctggttcggccagtcagatattaacaactacttagcctaggtaccagcaagagacctggccaggcctcccgaggcctcctactattttacngatcgacactaccaacgagggccctagtcggcaactcccaagccgtaggttccagtggctaggtgggtctagggacacgtacttcaccgtcacaccatccgagcaagtaagttacgacgtaccgtagaagttatttcggaacgttaacgttttacgttacgtttcggtactacgtaccaccgactacgccgtaacgccggttaccgggtcccggtttacggggtttaccgggaccgggtaacgggaaccgtaaaaggtaacggaacgtaaccgtaacggaaacgttacggtacggttacggacgtcgaccgtaccgtacgttccgtacggttaccgttacctacgttacccttacccgg

SEQ ID NO: 128712 - DNA, 611 bp, Homo sapiens
  misc_feature: GYAE6OF02I7JLN.42.10.A10.1.454.CMB.1.raw
  modified_base (198)..(198): a, c, t, g, unknown or other
  misc_feature (198)..(198): n is a, c, g, or t
  modified_base (303)..(303): a, c, t, g, unknown or other
  misc_feature (303)..(303): n is a, c, g, or t
tcagtgacgtatgtcacgaccggtgctcgatttagcgtcgatctcagggggaggaactgctcagttaggacccagagggaaccatggaagtcccagctcagcttctcttacctcctgctactctggctcccagatagtaccggagagattgtgttgacacagtatccagccaccctgtctttgtctccgaggggaaangccacctctcctgttgggccagtcagatattaacaactacttagcctggtaccagcagagacctggcctaggcctaccccgagggccttcccgtctatttttaancggaattggaccaatcccaaacgagggccctaacgtggaccaactccccaggcctaggttcaagtcggacaggttgggtccgtagggcaaggtcttcgactctacacctatcagctaagactagaacgtctagaagttatttgacgttagtttaactagttagttacacgtacacgacgtagcagcgtcggtccgttacgggttcggacgggtaagggaaccgtaaaggtaacgagttaacgacgtaaaagtaccggtagtacggctaggctaaccgagttccgttcgttactcctacttcctacccg

SEQ ID NO: 128713 - DNA, 626 bp, Homo sapiens
  misc_feature: GYAE6OF02HGLL9.42.10.A10.1.454.CMB.1.raw
  modified_base (194)..(194): a, c, t, g, unknown or other
  misc_feature (194)..(194): n is a, c, g, or t
tcagtgacgtatgtcacgaccggtgctcgatttagcgtcgatctcagggggaggaactgctcagttaggacccagagggaaccatggaagtcccagctcagcttctcttcctcctgctactctggctcccagatagtaccggagagattgtgttgacacagtatccagccaccctgtctttgtctccagggaancgccacctctcctgttggccagtcagagtattaaacaactacttacgcctggtaccagcaagacgacctggccacggctcccaggctccgtactatttatggatgacactaccaacgagggcccagtcggacactcccagccgaggttcagtggcgaggtggtctgggacagtacttcactcacacctatacagctagagttagacgactaggaacttatttcgacttagtttacttagttacgtactacgtaccaccgcgacgtacgacgtcgtccgggtcccggtttccggggtttaccgggaccggggaacgggtaaccgtaaaggtaggaacgtaacgtaacgtaaacgtaccggttaggtacggccgttaacggaccctacgtaccgttacgttccgtttccgttacttaccgttcccgttaccccg

SEQ ID NO: 128714 - DNA, 702 bp, Homo sapiens
  misc_feature: GYAE6OF02JTQY0.42.10.A10.1.454.CMB.1.raw
  modified_base (197)..(197): a, c, t, g, unknown or other
  misc_feature (197)..(197): n is a, c, g, or t
  modified_base (306)..(306): a, c, t, g, unknown or other
  misc_feature (306)..(306): n is a, c, g, or t
tcagtgacgtatgtcacgaccggtgctcgatttagcgtcgatctcagggggaggaactgctcagttaggacccagagggaaccatggaagtcccagctcagcttctcttcctcctgctactctggctcccagatagtacccggagagattgtgttgacacagtatccagccaccctgtctttgctccgaggggaaangcccacctctcctggttcggccagtcagtagtacttaacaacttacttagccttggtacccagccagacgacctggacccaggcctacccagggtcctcctcattttanagattcgctacgtccaacgacgggtccacgtggtcactccgagcgtaggtcacgtggccaggttcggtactgggacagtacttacacgttcaccgtacattccgacgacgacgtaacgttacgacgtccgtacggtaagttacgtttaagtaccgttaacggtttacttaacgttacggttaactacgaccgttaccgaaccgtgtaccgacgtccgttccggtacccggttccgggtttaccggggaccgggttaacggggtaaccgtaaacggtacgggaaacgtacgtaaccgtaaacgtaacccggttaggtaaccggtcgtaccgtacccgaaccgttaccggttaccggttaacgttcccgttaacggttacccttaccgtttcccccgg

SEQ ID NO: 128715 - DNA, 839 bp, Homo sapiens
  misc_feature: GYAE6OF02HM6PL.42.10.A10.1.454.CMB.1.raw
  modified_base (197)..(197): a, c, t, g, unknown or other
  misc_feature (197)..(197): n is a, c, g, or t
  modified_base (258)..(258): a, c, t, g, unknown or other
  misc_feature (258)..(258): n is a, c, g, or t
  modified_base (283)..(283): a, c, t, g, unknown or other
  misc_feature (283)..(283): n is a, c, g, or t
  modified_base (290)..(290): a, c, t, g, unknown or other
  misc_feature (290)..(290): n is a, c, g, or t
tcagtgacgtatgtcacgaccggtgctcgatttagcgtcgatctcagggggaggaactgctcagttaggacccagagggaaccatggaagtcccagctcagcttctcttcctcctgctactctggctcccagatagtaccggagagattgtgttgacacagtatccagccaccctgtctttgtctccgaggggaaanagccaccctctcctgttggccagtcagagtataacaactacttagcctggtaccagcaganacctggcaggctcccgaggctcctnattttangatgacactaccaaacgacgggcccacgtcggaccactccccagacccgtagggtttccaagggttcggacgtaggttcggggttcctagggggaaccaggtaaccctttccaaccgtttcctaccaacccctattaccgaacggtccaaggttaacgtttaacggaccggtaccgttaagggtaaagtttacgtttttacgaccgtttaaacggtttttaactttatttacgggttacctaagggtaccccgtaacccggtacacggtacccggtaacggtcccgggtttacccggggttacccccgggttttaccgggggtttttacccgggggaccgggggtaaaccgggggtaaaaccccgttaaaaaggggttaaccgggtaaacggttaaccggttaaacccggtaaaaaaccgggttaaccggttacggggttaccgggtaaccgtttacccgggaaacccttaaccccgttaacggtttacccgtttaccggtttaccccgttttaaccgttaaccccgttttcccccgtttaccccccgg

SEQ ID NO: 128716 - DNA, 787 bp, Homo sapiens
  misc_feature: GYAE6OF02IJGNQ.42.10.A10.1.454.CMB.1.raw
  modified_base (149)..(149): a, c, t, g, unknown or other
  misc_feature (149)..(149): n is a, c, g, or t
tcagtgacgtatgtcacgaccggtgctcgatttagcgtcgatctcgagggggaggaactgctcagttaggacccagagggaaccatggaagtcccagctcagcttctcttccctcctgctactctggctcccagatagtaccggagagnttggtgttgacaacagtactccagcccaccctgttcctttgtcctccgaaggggaaagcgcccaccctctccgtggttcggctacgtcagtagtaacttaacaactacttaggccttaggaccagcaagacgacctggccacggtcctcccgagggcccttcctactagttttaacgtcgacgtcgtccgacttaaccgaacggtacgggtacccaacggttcggaaccctacgtacccccgaaggtccctaacggtttagacggttacggaaccgtgggtcggggtctacggggaacacggtacttacacgttaccctaccaacctacgttaaccgaagcgttaaaccggtaattaaccgggtacgtaacgtaccggttaaagttaccggttttacctaggttaaaccggttttttaacacgtttcggttaaccaagggtaccctaacccgggttacaggaaccgtaacggtcccggttagggttaccccgtttcggggggtttacccgggaaccgggtacgggtaaaaacccgtaaagggttagaacccgggttaactacccgggtaaaaacgtccggtggtaccgacgtacgaacctcggtactcggttaactcgtttaccacggttccctaccg

SEQ ID NO: 128717 - DNA, 854 bp, Homo sapiens
  misc_feature: GYAE6OF02GVPTH.42.10.A10.1.454.CMB.1.raw
  modified_base (193)..(193): a, c, t, g, unknown or other
  misc_feature (193)..(193): n is a, c, g, or t
tcagtgacgtatgtcacgaccggtgctcgatttagcgtcgatctcagggggaggaactgctcagttaggacccagagggaaccatggaagtcccagctcagcttctcttcctcctgctactctggcctcccagatagtaccggagagattgtgttgacacagtatccagccacctgtctttgctcgagggaangccacctctcctggttcggccagtcagagtacttaacaactacttagcctggtaccagcagacgactggccaggctcccgaggctccgtactatttacgtgattgacctacgtacccaaaggcgggtaccctacggttacggacctaccgttaccccgaggtacccgtaaggggttttccaagggttccgggaccgtaagggttcgggggttaccgtagggggacctacgggttacccttacgtaaccgttccgtaccctaaccctacgttacccgaagtaccgtaaaggtaacgtttaacgggtaccgtacccggttaaggaaacgtttttacggttttaaccggtacggtttaacgtttttaaccgttacggttttacggttaacgaacggttaccccgtaccggtaacgtacggtacctaccgggttccggttaacccggggttcccgggttttacccggggtttacggggggaacccgggttaaacgggggtaaaccccgtttaaaaggggtaaaccgtacgggtaaacccgttaaacgggtaaacccggtaacgggttacgggttaccgggtacgtaacccggtacccgttaacgtaccggtttccgtttaaccggttacctttccgttaccccgtttaccccggttaaccccccg

SEQ ID NO: 128718 - DNA, 778 bp, Homo sapiens
  misc_feature: GYAE6OF02JK7SN.42.10.A10.1.454.CMB.1.raw
  modified_base (364)..(364): a, c, t, g, unknown or other
  misc_feature (364)..(364): n is a, c, g, or t
tcagtgacgtatgtcacgaccggtgctcgatttagcgtcgatctcagggggaggaactgctcagttaggacccagagggaaccatggaagtcccagctcagcttctcttcctcctgctactctggcctcccagatagtaccggagagtattgtgttagacacagtactccagcccacccttgttctttcgtccgtaccgaaggggaacgacgtccctacccttccgtccgttggttcgggccctaggtcaagtaacgttaacttaaaccaacttaacgttacgtacccgtaggtaccacggactaacggacgaaccgtggacccgacggtacctaccccgcggccttccctactaatttttagngaacttcgcctacgtacccaacggacggcctacgacggtacctacctccgaacgccgtaccgttacgacggtcggtacgtacggttcgggtcgttacggaacggtacgtaaccctttacgtaaccgttccgtacccaacccgtaacgttacccgagaaccgttaaggtaacgttaacgtacgtaccgttaaaggtaacgtttacgtttaacgtagtttaccgtttaacttacggttctaaccgacgttaccgaaccggctacggacgttcggacggttcccggtccgggttacggtcgggacggtaacggtacgaaacgttacgaacgttaccgaacggtaacgtaccgtggggtctacggtccgtacctacggtactttaccgtctttccgtactccccgtttacccggtacc

SEQ ID NO: 128719 - DNA, 621 bp, Homo sapiens
  misc_feature: GYAE6OF02HMUUI.42.10.A10.1.454.CMB.1.raw
  modified_base (195)..(195): a, c, t, g, unknown or other
  misc_feature (195)..(195): n is a, c, g, or t
  modified_base (293)..(293): a, c, t, g, unknown or other
  misc_feature (293)..(293): n is a, c, g, or t
  modified_base (301)..(301): a, c, t, g, unknown or other
  misc_feature (301)..(301): n is a, c, g, or t
  modified_base (427)..(427): a, c, t, g, unknown or other
  misc_feature (427)..(427): n is a, c, g, or t
tcagtgacgtatgtcacgaccggtgctcgatttagcgtcgatctcagggggaggaactgctcagttaggacccagagggaaccatggaagtcccagctcagcttctcttcctcctgctactctggctcccagatagtaccggagagattgtgttgacacagtatccagccacctgtctttgtctccgaggggaancgcccaccctctccgtggttcgggccagtcagagttattaacaactacttacgccttggaccagcagacgacctggccaggcctcccgaggcctcctntatttagngatgacactccaacgcgggccagtcggccacgtcccagccgtaggttcaggtcgcgtaggttcgggtctgggacagtaccttcacttcaccactatcagcaagtacgtacgacaccgtagaagttntttagacttacgtttacgttattcgtacgacgccgtacgcgacgcgtacgtccgttacgggtcccgtttacggggttccgggacgggtacgggaaccgtaaaggtacgtaacgacgtacgaacggtacggttggacggtcgtacggacctaccgtacgttcgttacgttccttacgtaccttacccgtaccccg

SEQ ID NO: 128720 - DNA, 712 bp, Homo sapiens
  misc_feature: GYAE6OF02JIBES.42.10.A10.1.454.CMB.1.raw
  modified_base (194)..(194): a, c, t, g, unknown or other
  misc_feature (194)..(194): n is a, c, g, or t
  modified_base (237)..(237): a, c, t, g, unknown or other
  misc_feature (237)..(237): n is a, c, g, or t
  modified_base (301)..(301): a, c, t, g, unknown or other
  misc_feature (301)..(301): n is a, c, g, or t
  modified_base (334)..(334): a, c, t, g, unknown or other
  misc_feature (334)..(334): n is a, c, g, or t
  modified_base (428)..(428): a, c, t, g, unknown or other
  misc_feature (428)..(428): n is a, c, g, or t
tcagtgacgtatgtcacgaccggtgctcgatttagcgtcgatctcagggggaggaactgctcagttaggacccagagggaaccatggaagtcccagctcagcttctcttcctcctgctactctggctcccagatagtaccggagagattgtgttgacacagtatccagcccacctgtcttgtctccgagggaancgccaccctctcgtggtcggccagtcagagtataacatactanccgtgtacagcagacgacctggaccaggtcctccccgaggtcctaccccttagtacttttaacngacttcgactactacccaaacggacgggtaccncgtcggactaaccgtccgacgtacgtcggttacgagtacggctagggttcggcgtagggacacgtactttaccgacttaccgtacacccttaanccacgtacgtagtacgttaagaccgtacgttaggtaaacgtttacgtttaccgacgttttaacgtttaacgtttacgttacgttaccgtaacgtacccgaccgttaccaagtccgtaacgtccggtccggtcccgggttacggttccgggacgggtaaccggaacgttaaaggaacggtacgtaaccggttacgtaaacgggaccggtttaagggtaccgtacggttccgaactaaccggttagtttaccgtcggtaaccttccggtaacttcccccgttaacg

SEQ ID NO: 128721 - DNA, 838 bp, Homo sapiens
  misc_feature: GYAE6OF02JWJZC.42.10.A10.1.454.CMB.1.raw
  modified_base (197)..(197): a, c, t, g, unknown or other
  misc_feature (197)..(197): n is a, c, g, or t
tcagtgacgtatgtcacgaccggtgctcgatttagcgtcgatctcagggggaggaactgctcagttaggacccagagggaaccatggaagtcccagctcagcttctcttcctcctgctactctggctcccagatagtaccggagagattgtgttgacacagtatccagccaccctgtctttgtctccgaggggaaanagccacccgtctccttggttcgggccagtcagagttattaacaactacttagcctggtaccagcagacgaccgtggccaggcctccccgaggtcctcccgtacgtaattttacgtacgtacgtacgtctaactacccgaaacgtaaccggggccctaaccgttcggaccctaacgtacccccgaggtacccgtaacgggtttacgacgggttcggaccgtagggttacggggttccggttaacgggggacctaaggtacccgttttacgacccgtttacttaccccaaccggtaacttaccgaacggttccgtaaaaggtaacgtttacggaaacgtacccgtttaaggaaacggttttagttttacggtaaccgtttaagtttttaaccgtaaggttttcgttaaccgacggtacccgtaaccggcgtacggtaccgtacgggtcgttccgggttcccgggtttacgggttccgggaacggggttaaacccggggtaaccgtaaaacggttaacgggtaacgttacgtaaacccggtaaacggttacccggtagggtaccggtaccgttaaggaaccccgtaccgttaacgttccgtacggtttacccttaaccggttaccgtttacccccgttacccgg

SEQ ID NO: 128722 - DNA, 691 bp, Homo sapiens
  misc_feature: GYAE6OF02JA6BT.42.10.A10.1.454.CMB.1.raw
  modified_base (165)..(165): a, c, t, g, unknown or other
  misc_feature (165)..(165): n is a, c, g, or t
  modified_base (195)..(195): a, c, t, g, unknown or other
  misc_feature (195)..(195): n is a, c, g, or t
  modified_base (253)..(253): a, c, t, g, unknown or other
  misc_feature (253)..(253): n is a, c, g, or t
tcagtgacgtatgtcacgaccggtgctcgatttagcgtcgatctcagggggaggaactgctcagttaggacccagagggaaccatggaagtcccagctcagcttctcttcctcctgctactctggctccagatagtaccggagagattgtgttagacacagtacnccagccaccctgtctttgctccgagggaancgccacctctctgtggcagtcagagtataacaactactagctaggaccagcagacgcnggccaggcctcccaggcctacctctagttttacacgtatgacaaccgtacctaaaccggacgggacctacgtaggaccctaactcccgaacggtacccgtaggttaccgaaggtcgggacctagggttacgggtcgtagggacaacgtcttacgacctactcaccgattaccagacctaagtacagacgtaccgtagtaagttagtttagacgttaagtttacgtaagttcgtaacgacgaccgtaaccgacgtacgcgtacgtccgtaccggggtaccggtccgggtttacgggaaccggtaaccggtaaacgtaaacggtaagacgaactaaccggtaaacgtaaccggtacggtaccggtacgtaacggaaccgtaaccgttaaccttccggttaaccgtttacccgttacccgttacccgtcccggttaacccg

SEQ ID NO: 128723 - DNA, 841 bp, Homo sapiens
  misc_feature: GYAE6OF02HWRER.42.10.A10.1.454.CMB.1.raw
  modified_base (195)..(195): a, c, t, g, unknown or other
  misc_feature (195)..(195): n is a, c, g, or t
  modified_base (254)..(254): a, c, t, g, unknown or other
  misc_feature (254)..(254): n is a, c, g, or t
tcagtgacgtatgtcacgaccggtgctcgatttagcgtcgatctcagggggaggaactgctcagttaggacccagagggaaccatggaagtcccagctcagcttctcttcctctgctactctggctcccagatagtaccggagagattgtgttgacacagtactccagcccacctgtctttgtctccgagggaancgcccacctctcctgttcggccagtcagagtaattaacaactacttacgcctggtaccngacagacgacctaggccaacggcctaccccggaggtcccttccccgtataacgtttttagtacggactttcggacctaaccgttacccgaaaaccgggaccgggggtaccctaacccgtttacggggaacccctaacgtccccccggtaacgtaccccgggttaagggtttaaccccgtaaagggttcggggaccttaacggggtttccgggggttaccggttaacggggggaaccttaaccgggtttacccgttttacccgtaccgtttacccgtaaccaacccgttacgttaccgacgtaaccgtaaaggttaacttacggaccgtaccgtaagggtaaagtttacgtttacgacgttaaacgttttaacttacgttcggtaacgtacgtacccgtacggcaacggtccgtaacgtccggttccgggttacccgggttggggtttacccgggaacgggtaaacggtaccggtaaaggtaacggacgttaacgtaacggtaaacgtacggtagggtaccggtacggtaaccgtacccggacgttacgtttccgtacgtttcctacgtacccgttcccgtaccccgg

SEQ ID NO: 128724 - DNA, 798 bp, Homo sapiens
  misc_feature: GYAE6OF02ID8VL.42.10.A10.1.454.CMB.1.raw
  modified_base (198)..(198): a, c, t, g, unknown or other
  misc_feature (198)..(198): n is a, c, g, or t
tcagtgacgtatgtcacgaccggtgctcgatttagcgtcgatctcagggggaggaactgctcagttaggacccagagggaaccatggaagtcccagctcagcttctcttcctctgctactctggcctcccagatagtaccggagagattgtgttgacacagtatccagcccaccctgtctttgtcctccgaggggaanacgcccaccctctcctggtcggccagtcagatattaacaactacttagcctaggtaccagcagacgaccgtcggccaggcctaccccgaggccttccctctatttagtgtactgacctaactaccgaaacgacgggccctacgtcggacctactaccccgaggtaccctaggtttccgagggtcggaccgtagggttcggggttcgtaggggacagggtaccttaccgaccgttacctaccacccgatccgaagtccgtaagtaacgttacggaccgtaccgttaaggtaacgtttacgttttacgaccgttaacgtttttaacttagtttacggttactaccggtacccgtaacccggtaccgtaacggacccgtacggtcccggttacccgggttaccccgggtttcggggtttacccggggaccggggtaaaccggggtaaacccgttaaaccgggtagtaaaccgggtaccttaaccggtaaaaccggtacggtttacggtaaccgggtacgttaccgggtaaccctaacccgttacggttacggtttcccgtttaacccttttaccggtaccccgtttacccccgttacccccgg

SEQ ID NO: 128725 - DNA, 900 bp, Homo sapiens
  misc_feature: GYAE6OF02H60RV.42.10.A10.1.454.CMB.1.raw
tcagtgacgtatgtcacgaccggtgctcgatttagcgtcgatctcagggggaggaactgctcagttaggacccagagggaaccatggaagtcccagctcagcttctcttcctctgctactctggctacccagtataggtaccggagagtattgtgttcgacacagtactccacgccctacccttgttcctttggtcctaccgagggggaaagacgcccctacccttctccgtcgggttcgggacccaagggttcaaggtactttaaacgttaaaccaacgtttaacgttaccggtccttagggttaacccaggcctaaggaacgtacccgtacggaccgtacgggtccctaccccggaccgggtccctacccgtttctaaagttttcgtacggtaacgttcgtacccttaaaccgaacccgtaaaccgggtaacccgggggaccctacccggtttccgggacctaaaccccgtttccccgaacggtaccccggttaagggtttccgaacggggtcgggtaacgtacggggttaccggggttcggtacgggaacttacgggtaacctttaccgtacccgttcctacccgtaacctacgtaccgaagtacgtagttaacgttaacggacggtaccgttaaggtaacgtttagttttacggttaccgttaacggttttagtttacgtttaccggttactacggtacccgtaccgacgtacggacgtaccggtccggtacccgggttcccgggttccggggtttaccgggacggggtaaaccgggtaaccggaaaacggtaacggtaacgtaaccgtaaccggtaaaccggtaacggtcggtacggtccgtacgtacccgtactcgttacttcgttaccgttcttaccccgttcgttacccccg

SEQ ID NO: 128726 - DNA, 591 bp, Homo sapiens
  misc_feature: GYAE6OF02GDPCA.42.10.A10.1.454.CMB.1.raw
  modified_base (194)..(194): a, c, t, g, unknown or other
  misc_feature (194)..(194): n is a, c, g, or t
  modified_base (293)..(293): a, c, t, g, unknown or other
  misc_feature (293)..(293): n is a, c, g, or t
  modified_base (361)..(361): a, c, t, g, unknown or other
  misc_feature (361)..(361): n is a, c, g, or t
  modified_base (377)..(377): a, c, t, g, unknown or other
  misc_feature (377)..(377): n is a, c, g, or t
  modified_base (412)..(412): a, c, t, g, unknown or other
  misc_feature (412)..(412): n is a, c, g, or t
tcagtgacgtatgtcacgaccggtgctcgatttagcgtcgatctcagggggagaactgctcagttaggacccagagggaaccatggaagtcccagctcagcttctcttcctcctgctactctggctcccagatagtaccggagagattgtgttgacacagtatccagcccacctgtctttgtctccaggggaangccacctctcctgttcggccagtcagagtataacactacttagcctggaccagcagacgacctggccaggcctccccaggccttccgtactattttacngaattcgccatcccaaacgcgggcccacgtgaccactcccagccaggttcaggtcgctaggtcggtcngggacagtctcactcncaccatcagcagtacttaggactcctagtaagttnttttagtacgtttatgttgtcagtccaccgtacagtccacggtccgtcggtacccggtttggggttccggacgggtaacggtacctaaaggtcgagtaacgtaccgaacgtacgtggtacggccttaggaccctaacgtcttccgttcgtacccttacacccgtttccctcccgtaccg

SEQ ID NO: 128727 - DNA, 711 bp, Homo sapiens
  misc_feature: GYAE6OF02FXE2H.42.10.A10.1.454.CMB.1.raw
  modified_base (200)..(200): a, c, t, g, unknown or other
  misc_feature (200)..(200): n is a, c, g, or t
  modified_base (311)..(311): a, c, t, g, unknown or other
  misc_feature (311)..(311): n is a, c, g, or t
tcagtgacgtatgtcacgaccggtgctcgatttagcgtcgatctcagggggaggaactgctcagttaggacccagagggaaccatggaagtcccagctcagcttctcttcctcctgctactctggctcccagatagtaccggagagattgtgttgacacagtactccagcccaccctgtctttgtctccgaaggggaaangcccaccctctccgtgttcgggccagtcagtagtaattaacaacttacttgccttaggtaccagaccagacgtacctggaccaggcctcccgaggtcctcctctattttangatgactataccaagcgggaccagtcggacaccgtcccgagtccgtaggttacaggtcggtactagggttcgggtacgtacggggaacacggttactttcccggacttcgtacccaacctacgtacgaacggctaagtagttaacgcgtactacggtaaagttgtttaccgacgtttaacgtttactagtttcgtacacggttacccacggacgtacgaccgaggtccgtacccgggttcccggtttacgggggtttaccggacggggtaaacggtaaacccgtaaaggttaccgagtaacccgtaacggtaaacgtacgttgggtaccggtacgaaccgtaccgtaaccttacggttaccgttacgttaccggttaccctaccggttacccttaccccg

SEQ ID NO: 128728 - DNA, 752 bp, Homo sapiens
  misc_feature: GYAE6OF02I5IEY.42.10.A10.1.454.CMB.1.raw
tcagtgacgtatgtcacgaccggtgctcgatttagcgtcgatctcagggggaggaactgctcagttaggacccagagggaaccatggaagtcccagctcagcttctcttcctcctgctactctggctcccagatagtaccggagagattgtgttgacactagtatccagcccaccctgttcctttgtctaccgaaggggaaacgcgccctaccctctccgtggttcgggcctagtcaagtagttaacttaaacaacttacttacgcctaggtaccagtcagacgacctggccaggcctacccgaggtccttccgtctaattttagcgattcgaccaacttacccgaaaggaccgggtaccctaacgtcggaccaccgttaccccgaacgccgttagggtttaccagggtgggaccctaagggttcggggtccgtaggggacctaaggtactttccgaactttccgtaccaacccgtataccgaggactaagtaagttacgtacgaccgttaaggtaagttacgttttacgacgtttaacggtttacttacgtttacgttacgtacgtacccgtaaccgtacgtacgacgtacgtccgttccggtacccgggtttacgggttcccgggtacgggtaaccggtaacgtaaacggttacgacgttaacgtacgtaaacggtacggttcggttacggacgttacgaccgtacgtacttcgttaccgttaccgtttactacccgttcccttacccgg

SEQ ID NO: 128729 - DNA, 680 bp, Homo sapiens
  misc_feature: GYAE6OF02HN2XJ.42.10.A10.1.454.CMB.1.raw
  modified_base (202)..(202): a, c, t, g, unknown or other
  misc_feature (202)..(202): n is a, c, g, or t
  modified_base (212)..(212): a, c, t, g, unknown or other
  misc_feature (212)..(212): n is a, c, g, or t
tcagtgacgtatgtcacgaccggtgctcgatttagcgtcgatctcagggggaggaactgctcagttaggacccagagggaaccatggaagtcccagctcagcttctcttcctcctgcctactctggctcccagatagtaccggagagattggtgttgacacagtatcccagcccacccttgtctttgtctccgaggggaaangcctaccctntcctggtggccagtcagagtataacactactagcctaggtaccagcagcgacctggccaggcctccgaggcctcctctatttatgatgcactaccaacgacggcccactggacacgtcccagtccaggtttccaaggtcgcgtagtgggtacgtgggacagtacttcacgttctaccgactagtccaacggtctaaggtaagttaacggacgttaccggtaagtaacggttagttttacgacgttaaggttttaacttattacgggttactacgtcccgtaaccgacgtacggacctaggaccggttccgggtacccgggtttcggggtttccgggaccggggtaacggaaccggtaaacggtaacggtaacgtaacgttaccgaaaacggttacgtaggtaccggtctacggtaccaaccgtattaccgttccggttacctacgttacccgttcccgttaaccccgg

SEQ ID NO: 128730 - DNA, 615 bp, Homo sapiens
  misc_feature: GYAE6OF02FYELM.42.10.A10.1.454.CMB.1.raw
  modified_base (193)..(193): a, c, t, g, unknown or other
  misc_feature (193)..(193): n is a, c, g, or t
  modified_base (285)..(285): a, c, t, g, unknown or other
  misc_feature (285)..(285): n is a, c, g, or t
  modified_base (294)..(294): a, c, t, g, unknown or other
  misc_feature (294)..(294): n is a, c, g, or t
  modified_base (441)..(441): a, c, t, g, unknown or other
  misc_feature (441)..(441): n is a, c, g, or t
  modified_base (470)..(470): a, c, t, g, unknown or other
  misc_feature (470)..(470): n is a, c, g, or t
tcagtgacgtatgtcacgaccggtgctcgatttagcgtcgatctcagggggaggaactgctcagttaggacccagagggaaccatggaagtcccagctcagcttctcttcctcctgctactctggctcccagatagtaccggagagattgtgttgacacagtatccagccacctgtctttgctccaggggaancgccacctctcctggttcggccagtcagagtattaacacttactagcctggtaccagcagacgacctggccaggcctcccgaggtcctcctntactttagnggatcgctactccaacgcgggtaccacgtcggctactcccgaagcccgtaggttccaaggtcggcgtaggttgggaccgtgggacacggtacttcacgtctccgaactcgtacgagtcacgtacttagacgtaccgtagtaaagttntttacggactaagtttactacgttggacncggtacaccgctaggcctagtccggtacggtcccggttcggttacgggaccggtacggaactaaggacgacgtataccgaacgacggttcggacgttccgacgtacctacgacttcgtacgttacttacctattcccgttacccg

SEQ ID NO: 128731 - DNA, 794 bp, Homo sapiens
  misc_feature: GYAE6OF02JKAXK.42.10.A10.1.454.CMB.1.raw
  modified_base (216)..(216): a, c, t, g, unknown or other
  misc_feature (216)..(216): n is a, c, g, or t
  modified_base (351)..(351): a, c, t, g, unknown or other
  misc_feature (351)..(351): n is a, c, g, or t
  modified_base (729)..(729): a, c, t, g, unknown or other
  misc_feature (729)..(729): n is a, c, g, or t
tcagtgacgtatgtcacgaccggtgctcgatttagcgtcgatctcagggggaggaactgcgtcagttaggacccagagggaaccatggaagtcccagctcagcttctcttcctctgctactctggctcccagactaggtaccggagagtattggtgttaggacctacgagtatcccacggacctacccttgtctttgtaccgtacgaaggggaaancgcccgaccctcgtccgtgggttcggcctacgtacaggtagttaacttaaccgaacttaacttgccgttaggtaccaagctagacgtacctggtaccacggtcctaccgaacggtcctacctactagtttaacgngtacttacggtacctaaccgtaccgtaaacgggaccggtacccgtaccgtacggacctcgttaaccccggaacgtaccggttaaccgttaccggtaaggttaccgggacgttacgggttgggtacccgtagggggcctaacgttaccctttacccgtacgtacccgttaacaccgtaacgtaccaacggtactaacgtacgttacgacgtacgtacggtaatttcgtagacttaacgtttactacgttcgtaacgactacccgtacgactacgtacgtcgtccggttaccgggttcggtacgggtttaccgggaaccgggttaacgggtaaacggtacgttaaccggaagtaaccgtaccgtaaaggtccggtttagngggtaccttacgaccttaaccggtacgtttaccgttcttaccggttacctccgttacccgtaccg

SEQ ID NO: 128732 - DNA, 826 bp, Homo sapiens
  misc_feature: GYAE6OF02GCSAZ.42.10.A10.1.454.CMB.1.raw
  modified_base (206)..(206): a, c, t, g, unknown or other
  misc_feature (206)..(206): n is a, c, g, or t
tcagtgacgtatgtcacgaccggtgctcgatttagcgtcgatctcagggggaggaactgctcagttaggacccagagggaaccatggaagtcccagctcagcttctcttcctcctgctactctggctccagatagtaccggagagtattgtgttgacacagtactccacgccaccctgttctttcgtcctacggaagggggtaaancgacccacccttctccgttggttcgggccagttcagtacttataaccaacttacgttacgccgttagggtaccagtacagacgtaccgtcgggacccacggtcctaccccggaggttcccttccccgttacttaagttttacacgagtcggtacctaacgtacccgaaacggccggggtacccacggtacggaccctaacgtacccccgaaggtccccgtaagggttaccaacgggttcgggaccgtacgggtttaggggtaccgtaggggtaaccgaacggtttaaccctttaccgtaccgttacccttaaccacccgttaactaacgaccgggtacctaagtaacgtttaacggacccgtacgtaacggtaagttttacgtttcgttaacgtttaacgtttaacttacgtttcggtaccgtacgtacccgaccgaccgtacgtaccgacgtccgggttaccgggtttccgggttaccggggtttaccgggaccggggtaaccggttaaccggtaaacggtacgtaacgttaaccgaacgtaaacgtacggtaggtaccggacgtacgtaccgacgttcgttacgttaccgttccgtacttacccgttcccgttacccg

SEQ ID NO: 128733 - DNA, 733 bp, Homo sapiens
  misc_feature: GYAE6OF02JBE2G.42.10.A10.1.454.CMB.1.raw
  modified_base (150)..(150): a, c, t, g, unknown or other
  misc_feature (150)..(150): n is a, c, g, or t
  modified_base (203)..(203): a, c, t, g, unknown or other
  misc_feature (203)..(203): n is a, c, g, or t
  modified_base (555)..(555): a, c, t, g, unknown or other
  misc_feature (555)..(555): n is a, c, g, or t
tcagtgacgtatgtcacgaccggtgctcgatttagcgtcgatctcagggggaggaactgctcagttaggacccagagggaaccatggaagtcccagctcagcttctcttccctctgctactctggcctcccagatacggtaccggagagnttgtgttgacacagtatccagcccacctgttctttgtctccgaaggggaaacncgccaccctctcctgttcgggcctagtcagagtattaacaacttactacgccttcggtaccagaccagacgacccgtgggacccaggtccctacccgacggccttcccgtactattttacaggtatacgcctaacctaccgtaaacggccgggtacccacgtacggcctactcccccgagaccgttacggttacgaaggtcggactagggtcgggtcgtagggaccgacttaccgtctaccgttcctacacccttagacctacggactaaggtactacggaccttaccggtaaggtagttagtttacgtactttaagttttacttagtttacgcgtaccgtccgaccgtacncgtaccggtcgtcccggtccgggttacccggggtttcggggttaccggggtaccggggaacccgtaaacgggtaaacggtacggtaaacgtacgtaacccggaaaggtttaccggtagggtcggtacctacgtaccctacgcgtttcgttaccgtctttcggtaccttcggtaccccc

SEQ ID NO: 128734 - DNA, 786 bp, Homo sapiens
  misc_feature: GYAE6OF02HW491.42.10.A10.1.454.CMB.1.raw
  modified_base (159)..(159): a, c, t, g, unknown or other
  misc_feature (159)..(159): n is a, c, g, or t
  modified_base (200)..(200): a, c, t, g, unknown or other
  misc_feature (200)..(200): n is a, c, g, or t
  modified_base (292)..(292): a, c, t, g, unknown or other
  misc_feature (292)..(292): n is a, c, g, or t
tcagtgacgtatgtcacgaccggtgctcgatttagcgtcgatctcagggggaggaactgctcagttaggacccagagggaaccatggaagtcccagctcagcttctcttcctctgctactctggctccagatagtaccggagagtattgtgttcgacanagtatccacgcctacctgtctttcgtcctaccgagggaaancgacccaccctctccgtgtcggaccagtcagacgtaattaaacaacttacgttagccgtagtaccagacagacgaccgtcggacacgtaccnccgaggcctcctacttatttagtacgagtcgactactaccgaaccgacggaccaacgtcggacctaccgtacccgacgtacccgtagggttacacggtacggtacgtagggttcggggtacgtaggggtaactaccggaacgtttccgaaccttcgtaacccacccgtaacgttaccaacgtacctaagtaaacgtttacgaccgttaccgttaagtaaacgttagtttacgtacgttaagtttacttaagttcgtacgtacgaccgtaaccggacctaacggtcctaagtcccggttaaccgggttaccccgggtttccgggtttacggggaacccggggtaaaggtaaccccgttaaaaggggtaacgtaaccgtaaccgttaaaccggtaaaacggtaacggttaacgggaaccgtttaccggaccgtaaccgtaactccggttaactttaccccggttactttccgttacccgtttacccgtacccccgg

SEQ ID NO: 128735 - DNA, 846 bp, Homo sapiens
  misc_feature: GYAE6OF02GGEL5.42.10.A10.1.454.CMB.1.raw
  modified_base (116)..(116): a, c, t, g, unknown or other
  misc_feature (116)..(116): n is a, c, g, or t
  modified_base (209)..(209): a, c, t, g, unknown or other
  misc_feature (209)..(209): n is a, c, g, or t
tcagtgacgtatgtcacgaccggtgctcgatttagcgtcgatctcagggggaggaactgctcagttaggacccagagggaaccatggaagtcccagctcagcttctcttcctcctnccttactctcggctcccgagactaggtacccggagagattgtgttcgacacagtatccaagcccaccctgtctttggtctccgtaggggaaangtacccaccgtctcctagttcggcctagtccaagtagtaacttaacgaactacgttacgcttacggtaccagtcaaggtacgaccgttggacctaacggcccgtaaccccgacggggtaccttcctaacggttacttttaaccgtgtaaacggttcgaactacttaacccgaaacggtaaccggggtccctacgtacgggcctaaccgttaccccggaacgttaccgtaacggtttccggaaacgggtttcggaacccgttaaggggtccggggttacccgtaacggggtaacctaacgggttaaccgttaccaaaccgttcctaccgaaaccctacttaccggaacgactaaagtaactttaacgggaactccggtaagttaagtttaccgttaacgtacgttaagttttaacgtacttaggttacaccggtaccttaaaccggctaaaggtccgtacgtaccggttacggttcccggtttacgggttacgggaaccgggaaccggggtaaacaaacgggttacgaacgtaaaccgtacgaaaacccggttacggtcgggttaaccgcgttaaaccgacgttaacccgtacgtaaccgttccgttaacgttaccgttaccctaaccggtttccccg

SEQ ID NO: 128736 - DNA, 810 bp, Homo sapiens
  misc_feature: GYAE6OF02HNFXU.42.10.A10.1.454.CMB.1.raw
  modified_base (430)..(430): a, c, t, g, unknown or other
  misc_feature (430)..(430): n is a, c, g, or t
tcagtgacgtatgtcacgaccggtgctcgatttagcgtcgatctcagggggaggaactgctcagttaggacccagagggaaccatggaagtccagctcagcttctcttcctctgctactctgctcccagactagtaccggagagtattggtgttgaacacgacgtatccagccctaccctgttctttcgtccgtaccgaaggggaaacgcgtaccctacccttctccgtaggttcgggcctagtcgagtaagttaacttaaaccaaacttacgttacgaccgtaggtaccagtccaagtacgaccgtggcctacggcctaccgcgtaccgtcctacttaatttacacgtatcgtactaactaccgtaacgggacgggccctaacggtcggtacctaccttaccccgaacggtacccgttaacgggtaccncgggttaacgggcggtttaacgggtcgggttacgacgggggaacctaagttaccccgttacaccgttacctacccaaccgttacgtacacgtacgtaactaacggttacgacgttactaggtaaacgtttcttcgttaactcgttttaaacttcgttacgtaccggtccgttacggactacgtacgaacgtccgtacggttcccgggttacgggttacccgggtacggggaacgggtaccggtaaaccgtaaacggtaggtaaaccgtcggtaaccgtaaaccgttacggtaaccgggttcgtaacccggtcgttacccgtaaccgtcgtttaccgtttaccgaacccttttacggttacccctttaccccggttacccg

SEQ ID NO: 128737 - DNA, 170 bp, Homo sapiens
  misc_feature: GYAE6OF01CVUYE.45.78.H01.1.454.CMB.1.raw
  modified_base (170)..(170): a, c, t, g, unknown or other
  misc_feature (170)..(170): n is a, c, g, or t
tcagacgcgatcgacacgaccggtgctcgatttagtgtgagtagtttgggtttgggaagaggaagactgacggtccccaggagttcaggtgctgggcacagcggccctgggctgcctggtcaaggactacttcctcgatcgcgtctgagcgggctggcaaggcgcatagn

SEQ ID NO: 128738 - DNA, 165 bp, Homo sapiens
  misc_feature: GYAE6OF01EESKL.45.78.H01.1.454.CMB.1.raw
  modified_base (164)..(165): a, c, t, g, unknown or other
  misc_feature (164)..(165): n is a, c, g, or t
tcagacgcgatcgacacgaccggtgctcgatttagtgtgagtagttggttgggaagaggaagactgacggtcccaggagttcaggtgctggcacagcggccctggctgcctggtcaaggactacttcctcgatcgcgtctgagcgggctggcaaggcgcatagnn

SEQ ID NO: 128739 - DNA, 528 bp, Homo sapiens
  misc_feature: GYAE6OF01BS1B5.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgatttttggagtggttattcggacggtatggacgtcgtggggccaagggaccacggtcaccgtctcctcagcctccaccaagggcccatcggtcttcccctggccaccctcctccaacgacgcacctcgtgggggcacacgcggccctgggctgcctggtcaaggctactcctcgatcgcgtctgcgcgggctcgg

SEQ ID NO: 128740 - DNA, 498 bp, Homo sapiens
  misc_feature: GYAE6OF01CRWUO.45.78.H01.1.454.CMB.1.raw
  modified_base (495)..(495): a, c, t, g, unknown or other
  misc_feature (495)..(495): n is a, c, g, or t
tcagacgcgatcgacacgaccggtgctcgatttagtgtgagtagtttgggtttggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtaactggttggcctggtatcagcagaaaccagggaaagcccctaagctcctgctctataaaggcatctagtttagaaagtggggtcccatcaaggttcagcggcagtggatctgggacagaattcactctcaccatcagcagcctgcagcctgatgatttgcaacttattactgccaacagtatgatagttattcgacgttcggcaagggaccaaaggtggaaatcgaaacgaactagtggctgctaccatctgtcttntac

SEQ ID NO: 128741 - DNA, 173 bp, Homo sapiens
  misc_feature: GYAE6OF01A7R16.45.78.H01.1.454.CMB.1.raw
  modified_base (173)..(173): a, c, t, g, unknown or other
  misc_feature (173)..(173): n is a, c, g, or t
tcagacgcgatcgacacgaccggtgctcgatttagtgtgagtagtttgggtttgggggaagaggaagactgacggtcccccaggagttcaggtgctgggcacagcggccctgggctgcctggtcaaggactacttcctcgatcgcgtctgagcgggctggcaaggcgcatagn

SEQ ID NO: 128742 - DNA, 175 bp, Homo sapiens
  misc_feature: GYAE6OF01AJGA7.45.78.H01.1.454.CMB.1.raw
  modified_base (173)..(175): a, c, t, g, unknown or other
  misc_feature (173)..(175): n is a, c, g, or t
tcagacgcgatcgacacgaccggtgctcgatttagtgtgagtagtttgggtttggggaaagaggaagactgacggtcccccaggagttcaggtgctgggcacagcggccctgggctgcctggtcaaggactacttcctcgatcgcgtctgagcgggctggcaaggcgcatagnnn

SEQ ID NO: 128743 - DNA, 498 bp, Homo sapiens
  misc_feature: GYAE6OF01EOAG5.45.78.H01.1.454.CMB.1.raw
  modified_base (495)..(495): a, c, t, g, unknown or other
  misc_feature (495)..(495): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtaactggttggcctggtatcagcagaaaccagggaaagcccctaagctcctgctctataaggcatctagtttagaaagtggggtcccatcaaggttcagcggcagtggatctgggacagaattcactctcaccatcagcagcctgcagcctgatgattttgctaacttattactgccaacagtatgatagttattcgacgttcggaccaagggaccaaggtggaaatcgaaacgtaatgtggctgacacatctgtctntac

SEQ ID NO: 128744 - DNA, 174 bp, Homo sapiens
  misc_feature: GYAE6OF01EJV82.45.78.H01.1.454.CMB.1.raw
  modified_base (173)..(174): a, c, t, g, unknown or other
  misc_feature (173)..(174): n is a, c, g, or t
tcagacgcgatcgacacgaccggtgctcgatttagtgtgagtagtttgggtttgggggaagaggaagactgacggtcccccaggagttcaggtgctgggcacagcggccctgggctgcctggtcaaggactacttcctcgatcgcgtctgagcgggctggcaaggcgcatagnn

SEQ ID NO: 128745 - DNA, 493 bp, Homo sapiens
  misc_feature: GYAE6OF01EVM8R.45.78.H01.1.454.CMB.1.raw
tcagacgcgatcgacacgaccggtgctcgatttagtgtgagtagtttgggtttggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggcttgagtggatgggatggatcaacctaacaatggtgcacaaactatgcacagaagttcagggcagggtcaccatgacaggacacgtcatcagcacagcctacatggagctgagcgaggctgagatcgtgacgacgacggccgtgtacttatggtgcgagaggacaggaattacgtagtttggtagg

SEQ ID NO: 128746 - DNA, 515 bp, Homo sapiens
  misc_feature: GYAE6OF01DJ3TQ.45.78.H01.1.454.CMB.1.raw
  modified_base (510)..(510): a, c, t, g, unknown or other
  misc_feature (510)..(510): n is a, c, g, or t
tcagacgcgatcgacacgaccggtgctcgatttagtgtgagtagtttgggtttgggtgaagaagcctgggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgattttggagtggtattggacggtatggacgtctggggcaagggaccacggtcacgtctctcagcctcaccaaggcccatcggtcttcccctggcaccctcctccaagacgcacctctggggcacagcggccctgggctgccctggtcaaggactacttcctcgattcgctctgagcggntcggg

SEQ ID NO: 128747 - DNA, 630 bp, Homo sapiens
  misc_feature: GYAE6OF01EDQBA.45.78.H01.1.454.CMB.1.raw
  modified_base (142)..(142): a, c, t, g, unknown or other
  misc_feature (142)..(142): n is a, c, g, or t
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (210)..(210): a, c, t, g, unknown or other
  misc_feature (210)..(210): n is a, c, g, or t
  modified_base (624)..(624): a, c, t, g, unknown or other
  misc_feature (624)..(624): n is a, c, g, or t
tcagacgcgatcgacacgaccggtgctcgatttagtgtgagtagtttggttggggtgaagaagcctcgggcctcaacgtgaaggtctcctgcaaggcttctcggatacaccttcaccggtctactactatacgactgggtcncggacgaggtcccctggtactagggcttgagtggatcggatggatccaacctanatggtgcanaactntgcacagagttcgaggcagggtcacgatcgacggacggtcacggtccaagtccacgtcacagacctactacttgggaatacctaggtacgacgaaggtccttagagtactcgtggtacgacgacggccgtcgtagtaccgtggtcgtcggagtaggctagggaattacggattttcggaacgttaggtagttcgggacgtactcggacgtctgggccaacgggaccacggtcgaccgtcgtcctcgtcgcctcgacgacggccgagtccgtccgtcccctggcacccgtccgtccaacgacgccgaaccttcgtcgggtcctacgacgtccggtaccgtacgggcctcggcccgttgtaccgtacgggtctaccggttccggaccgcgtacggtaccgggtctaggacgtcggngtcggg

SEQ ID NO: 128748 - DNA, 530 bp, Homo sapiens
  misc_feature: GYAE6OF01BV28H.45.78.H01.1.454.CMB.1.raw
tcagacgcgatcgacacgaccggtgctcgattagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgattttggagtggttattcggacggtatggacgtctggggccaagggaccacgggtcaccgtctcctcacgcctccaccaagggcccatcggtcttccccctggccaccctcctccaagacgcacctctcgggggcacgacgcggccctgggctgcctggtcaggactactcctcgatcgcgtctgacgcgggctcggg

SEQ ID NO: 128749 - DNA, 184 bp, Homo sapiens
  misc_feature: GYAE6OF01BEQQ4.45.78.H01.1.454.CMB.1.raw
  modified_base (173)..(184): a, c, t, g, unknown or other
  misc_feature (173)..(184): n is a, c, g, or t
tcagacgcgatcgacacgaccggtgctcgatttagtgtgagtagtttgggtttgggggaagaggaagactgacggtcccccaggagttcaggtgctgggcacagcggccctgggctgcctggtcaaggactacttcctcgatcgcgtctgagcgggctggcaaggcgcatagnnnnnnnnnnnn

SEQ ID NO: 128750 - DNA, 562 bp, Homo sapiens
  misc_feature: GYAE6OF01BQ5KQ.45.78.H01.1.454.CMB.1.raw
  modified_base (557)..(557): a, c, t, g, unknown or other
  misc_feature (557)..(557): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgagcgtgaggatctagacgacacggccgtgtatactgtgcgagaggcaggaattacgagttttggagttggttaattcggacggtatggacgtcgtggggccaaagggtaccaggtccgaccgtctcctcagcctccaccgaacggcccactccggtccttccccgtcgccacccgtccctccaacgacgccaacctcgtacggggcacgacgccggcccgtcgggctcgcctggtccgaacggactacgttccgacgtactcgtcgtctgaggccggngtcgg

SEQ ID NO: 128751 - DNA, 501 bp, Homo sapiens
  misc_feature: GYAE6OF01EN1CC.45.78.H01.1.454.CMB.1.raw
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtaactggttggcctggtatcagcagaaaccagggaaagcccctaagctcctgctctataaggcatctagtttagaaagtggggtcccatcaaggttcagcggcagtggatctgggacagaattcactctcaccatcagcagcctgcagcctgatgattttgctaacttattactgccaacagtatgattagttattcgacgttcggaccaagggaccaaaggtggaaatacgaaacgaatggtggctgcaccatctgtctctac

SEQ ID NO: 128752 - DNA, 551 bp, Homo sapiens
  misc_feature: GYAE6OF01AQNT5.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgatttttggagtggttattcggacggtatggacgtctggggtccaagggaccacggtcaccgtctcctcacgcctccaccaagggcccatccggtccttccccctggccaccctcctccaacgacgccaccctcgtcgggggccacgacgccggccctgggcctgcccgtggtccgaacggactacgttccctcgactcgcgtctgacgcgggctcggg

SEQ ID NO: 128753 - DNA, 173 bp, Homo sapiens; identical to SEQ ID NO: 128741
  misc_feature: GYAE6OF01ACFU7.45.78.H01.1.454.CMB.1.raw
  modified_base (173)..(173): a, c, t, g, unknown or other
  misc_feature (173)..(173): n is a, c, g, or t

SEQ ID NO: 128754 - DNA, 570 bp, Homo sapiens
  misc_feature: GYAE6OF01EDW7D.45.78.H01.1.454.CMB.1.raw
tcagacgcgatcgacacgaccggtgctcgatttagtgtgagtagtttggttttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgatttttggagtggttattcggacggtatggacgtctggggccaagggaccacggtcaccgtctcctcacgcctccaccaacgggcccatccggtcttccccctcggccacccctccctccaacgcgccacctccgtcgggggccaccgaggccggcccgtcggggcctcggccctgggtccgaacgggtacctaccgttccctccgtatccggtcgtctggacggccgggcgtcggg

SEQ ID NO: 128755 - DNA, 525 bp, Homo sapiens
  misc_feature: GYAE6OF01DEC9T.45.78.H01.1.454.CMB.1.raw
  modified_base (369)..(369): a, c, t, g, unknown or other
  misc_feature (369)..(369): n is a, c, g, or t
  modified_base (514)..(514): a, c, t, g, unknown or other
  misc_feature (514)..(514): n is a, c, g, or t
  modified_base (521)..(521): a, c, t, g, unknown or other
  misc_feature (521)..(521): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgatttttggagttggttattcggacggtatggacgtntggggccaagggccacggtcaccgtctcctcagcctccaccaagggcccatcggtcttccccctggcaccctcctccacgacgcacctctgggggcacgagcggcctgggcctgcctggtcaaggctacttcctcgatcgcgtcngagcggntcgg

SEQ ID NO: 128756 - DNA, 514 bp, Homo sapiens
  misc_feature: GYAE6OF01DXVFE.45.78.H01.1.454.CMB.1.raw
  modified_base (365)..(365): a, c, t, g, unknown or other
  misc_feature (365)..(365): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtaactggttggcctggtatcagcagaaaccagggaaagcccctaaagctcctgctctataaggcatctagtttagaaagtgggtcccatcaaggttcagcggcagtggatctgggacagaatcactcncaccatcagcagcctgcagcctgatgattttgctaacttattactgccaacagtaatgaatagttattcgacgttacggccaaagggaccaaagggtggaaaatcgaaaacgaacttagtgggactggacaccaatcctgtcttctaac

SEQ ID NO: 128757 - DNA, 581 bp, Homo sapiens
  misc_feature: GYAE6OF01CZ46Q.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgatttttggagttggttattcgggacggttatggtacgtcgtggggccaagggaccacggtcaccgtctcctcacgcctccaccgaagggcccatccggtccttcccccgtcggccaccctccctccaagacgcaccctcgtcgggggcacgacgccggcccgtgggcctcggccgtcggtccgaaacgggtaccttaccgttcccgttcgacgttcggacggacgggaccgtcgggcgtaacgggccg

SEQ ID NO: 128758 - DNA, 537 bp, Homo sapiens
  misc_feature: GYAE6OF01CADE1.45.78.H01.1.454.CMB.1.raw
  modified_base (275)..(275): a, c, t, g, unknown or other
  misc_feature (275)..(275): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggcagtcagagtattagtaactggttggcctggtatcagcaagaaaccagggaaancccctaagctcctgctctataaggcatctagttagaagtgggtccatcaaggttcagcgcagtggatctgggacagaattcactctcaccatcagcagcctgcagcctgaatgtattttgactaactttattactgactaaacagttaatacgtattacgtttaattccgaacgtttaccggaccgaaagggtaccgaaaggtaggaaaactacgaaaacgtaactggtcggactggaccaccgtatcttcgtcttctaacg

SEQ ID NO: 128759 - DNA, 580 bp, Homo sapiens
  misc_feature: GYAE6OF01B8802.45.78.H01.1.454.CMB.1.raw
tcagacgcgatcgacacgaccggtgctcgatttagtgtgagtagtttgggtttggggctgaggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaaactatgcacagaagtttcagggcagggtcaccatgaccagggacacgtccatcagcacagcctacatggagctgagcgaggcgtgaagatctagacgacacggccgtgtattactgtgcgagaggcgaggaattacgtagttttggagttggttattcggacggtatggacgttcgtggggaccaagggaccacggtcaccgtctcctcacgcctcccaacgaacgggcccacgtccggtcccttcccccgtcggccacccctcctcccaagacgcctacctcgtggggccacgacgccggcccgtgggtccgtcgcccgtggtaccgaacggccttaccgttccctcgactcccggcgttccgtggacggg

SEQ ID NO: 128760 - DNA, 184 bp, Homo sapiens; identical to SEQ ID NO: 128749
  misc_feature: GYAE6OF01B7A9M.45.78.H01.1.454.CMB.1.raw
  modified_base (173)..(184): a, c, t, g, unknown or other
  misc_feature (173)..(184): n is a, c, g, or t

SEQ ID NO: 128761 - DNA, 591 bp, Homo sapiens
  misc_feature: GYAE6OF01CQHMM.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggattacgtattttggagttggttagttcggtacggtatggtacgtcgtgggccgaagggaccgacggtcaccgtctcctcacgcctcccaccgaacggcccacgtccgggtccttcccccgtcgcctacccctcctcccaacgcgccaccctcgtcgggggccaccgacggccggcccgtcgggccgtcgcccgtcgggtaccgaacgggtaccttacccgtcccgtacgacgttccggccgttcgtggacgggcgggtcgtcggg

SEQ ID NO: 128762 - DNA, 593 bp, Homo sapiens
  misc_feature: GYAE6OF01BIX9J.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgaggcgtgagatctgacgacacggccgtgtattactgtgcgagaggcaggaattacgattttggagtggttattcggacggtatggacgtcgtggggccaagggaccacggtcaccgtctcctcagcctccaccaacgggcccatccggtccttcccccgtcggccacccgtcctcccaacgacgccacctcgtcgggggccacgacgccggcccgtcgggcctcggcccgtgggtaccgaaacgggtaccttaccgttcccgtccggtaacgttcccggccggttccgttgggacggtccggggtccgtcgggg

SEQ ID NO: 128763 - DNA, 138 bp, Homo sapiens
  misc_feature: GYAE6OF01DW2JF.45.78.H01.1.454.CMB.1.raw
  modified_base (129)..(138): a, c, t, g, unknown or other
  misc_feature (129)..(138): n is a, c, g, or t
tcagacgcgatcgacacgaccggtgctcgatttagtgtgagtagtttgggttgggcacagcggccctgggctgcctggtcaaggactacttcctcgatcgcgtctgagcgggctggcaaggcgcatagnnnnnnnnnn

SEQ ID NO: 128764 - DNA, 534 bp, Homo sapiens
  misc_feature: GYAE6OF01AYZF0.45.78.H01.1.454.CMB.1.raw
  modified_base (366)..(366): a, c, t, g, unknown or other
  misc_feature (366)..(366): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtaactggttggcctggtatcagcaagaaaccagggaaacgcccctaagctcctgctctataaggcatctagttagaaagtgggtaccatcaaggtcagcggcagtggatcgtgggacagaattcactcncacatcagcagcctgcagcctgatgtattttcgactaactttattactacgaccaatagtatagtattagttacgttcgtacgttacggaccgaagggaccgtaaggtacggaaaactacgaaacgtatggtacgcgtagacctacctattcctcgttccttctaccg

SEQ ID NO: 128765 - DNA, 519 bp, Homo sapiens
  misc_feature: GYAE6OF01CAU37.45.78.H01.1.454.CMB.1.raw
  modified_base (277)..(277): a, c, t, g, unknown or other
  misc_feature (277)..(277): n is a, c, g, or t
  modified_base (422)..(422): a, c, t, g, unknown or other
  misc_feature (422)..(422): n is a, c, g, or t
  modified_base (491)..(491): a, c, t, g, unknown or other
  misc_feature (491)..(491): n is a, c, g, or t
  modified_base (513)..(513): a, c, t, g, unknown or other
  misc_feature (513)..(513): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccattctccctgtctgcatctgtaggagacagagttaccataacttgccgggcaagtcaggatattagaaatgagttaggctggtatcagcagagaccgagggggacnccccccaactcctagtctatggtgcttccaggttacaagtgggtcccatcaaggttcagtggcggtgggtctgggcacagaattcactctcacatcagcagcctgcagcctgattgtattttgactaactttattactgaccaanagtatgattagttattcgtacgttcggaccaagggaccaagagtaggaaactacgaaaacgtacttggnggctgccactatctagtccttnctcccg

SEQ ID NO: 128766 - DNA, 500 bp, Homo sapiens
  misc_feature: GYAE6OF01BWILV.45.78.H01.1.454.CMB.1.raw
  modified_base (442)..(442): a, c, t, g, unknown or other
  misc_feature (442)..(442): n is a, c, g, or t
  modified_base (467)..(467): a, c, t, g, unknown or other
  misc_feature (467)..(467): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggcttgagtggatgggatggatcaacctaacaatggtggcacaaactatgcacagaagtttcagggcagggtcaccatgaccagggacacgtcatcagcacagcctacatggagcgtgacggcgagcgtgaagtcnctagacgacgacgccgtgtacttanggtgcgtagaggcagattacgtagtttggtagg

SEQ ID NO: 128767 - DNA, 542 bp, Homo sapiens
  misc_feature: GYAE6OF01BQ58N.45.78.H01.1.454.CMB.1.raw
tcagacgcgatcgacacgaccggtgctcgatttagtgtgagtagtttgggtttgggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgatttttggagtggttattcggacggtatggacgtcgtggggccaaggggaccacgggtcaccgtctcctcagcctccaccaacgggcccatccggtcttccccctcggccaccctccctccaagacgccacctctgggggccacgacgcggccctgggcctcgcctggtcaaggactacttcctcgactcgcgtctgacgcgggctcggg

SEQ ID NO: 128768 - DNA, 534 bp, Homo sapiens
  misc_feature: GYAE6OF01BSPDB.45.78.H01.1.454.CMB.1.raw
  modified_base (511)..(511): a, c, t, g, unknown or other
  misc_feature (511)..(511): n is a, c, g, or t
  modified_base (521)..(521): a, c, t, g, unknown or other
  misc_feature (521)..(521): n is a, c, g, or t
  modified_base (528)..(528): a, c, t, g, unknown or other
  misc_feature (528)..(528): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgattttggagtgggttattcggacggtagtggacgtcgtggggccaagggaccacggtcaccgtctcctcagcctccaccaacgggcccatcggtcttccccctggccaccctcctccaacgacgccacctcgcggggcacgacgccggccctgggctgcctggtcaggactacttccncgacgcgtcngagcggntggacg

SEQ ID NO: 128769 - DNA, 674 bp, Homo sapiens
  misc_feature: GYAE6OF01COIKW.45.78.H01.1.454.CMB.1.raw
  modified_base (208)..(208): a, c, t, g, unknown or other
  misc_feature (208)..(208): n is a, c, g, or t
tcagacgcgatcgacacgaccggtgctcgatttagtgtgagtagtttgggtttgggggtaggtcagacccacgtcaggacacagcatggacatgagggtccccgcctcagctcctggggctcctgctgctctggctcccaggtgccaaatgtgacatccagatcgacccagtcctccttccaccctgtctgcatctgtaggagacagngtcaccatcacttgccgggccagtcagagtattagtaactggttgccttggtatcagcaagaaaccgagggaaacgaccccgtaaggccgtaccctcgacctactacgtaacggactattacgttaaggttagaaagtcggggtaccctagtcgtaagggttcgaacggtcggacctaggtcggtaacttcggtagggaccgaagtaagtttccactacttcgaacctatcgtaacgtacctaaggtcccctaggacctagcctagacttgtacttttcggaccttaacttacttacgtataacctaaactacgttaattactaacgttaagtttacttaacggtacggtttacggacccgtaaacgggtacccgtaaagggttaccggaaacgttaccgaaaccggtaaagtcgggttacgggaccgtagaccgtaaccctagttccgttacggtcttacgtacc

SEQ ID NO: 128770 - DNA, 498 bp, Homo sapiens
  misc_feature: GYAE6OF01E3QNT.45.78.H01.1.454.CMB.1.raw
tcagacgcgatcgacacgaccggtgctcgatttagtgtgagtagtttgggtttgggggagagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggcttgagtggatgggatggatcaaccctaacaaatggtggcacaaactatgcacagaagtttcagggcagggtcaccatgaccagggacacgtccatcagcacagcctacatggagctgagcaggctgagatctgacgacacggccgtgtattactgtgcgagaggcaaggaattacgtagttttaggg

SEQ ID NO: 128771 - DNA, 536 bp, Homo sapiens
  misc_feature: GYAE6OF01A5AM1.45.78.H01.1.454.CMB.1.raw
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtaactggttgcctggtatcagcagaaaccagggaaagcccctaagctcctgctctataaggcatctagtttagaaagtgggtcccatcaaggttcagcggcagtgatcgtggacagattcactctcacatcagcagcctgcagcctgatgattttgactaactttattactgaccaatacgtatagtactagtttattaccgtacgtttaccgggacctaaaggggaaccaaagggtaggaaaactaccgtaaaacgtaacgtggttaggactaggactaaccgattcctgtcttctac

SEQ ID NO: 128772 - DNA, 546 bp, Homo sapiens
  misc_feature: GYAE6OF01CRQM3.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggattacgatttttggagtggttattcggacggtatggacgtctggggccaaggggaccacgggtcaccgtctcctcagcctccaccagggcccatcggtcttccccctggccaccctccctccaacgacgccaccctcgtcgggggcacgacgccggccctgggcctggccctgggtccaacgggctacgttccctactgctagtctgacgcgggctcggg

SEQ ID NO: 128773 - DNA, 595 bp, Homo sapiens
  misc_feature: GYAE6OF01B4PB9.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgaggctgagatctgacgacacggccgtgtattactgtgcgagaggcaggaattacgatttttggagttggttattcggacggtatggtacgtcgtggggcaagggaccacggtcaccgtctcctcacgcctaccaccacgggcccagtccggtccttcccccgtcggcccacccgttccctaccaacgacgccctacctccgtgggggtccacgacgcccggccgtcgggcctcggccgtggtaccgaacgggtaccttaccgttcccgtccggtacgtcccggtacgttccgtaggacggccggggtcgtacgggg

SEQ ID NO: 128774 - DNA, 555 bp, Homo sapiens
  misc_feature: GYAE6OF01CCX4J.45.78.H01.1.454.CMB.1.raw
  modified_base (523)..(523): a, c, t, g, unknown or other
  misc_feature (523)..(523): n is a, c, g, or t
tcagacgcgatcgacacgaccggtgctcgatttagtgtgagtagtttgggtttggggtgaagaagcctggggcctcaatgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgatttttggagttggttattcggacggtatggacgtctggggccaagggaccacgggtcaccgtctcctcagccctccaccaagggcccatcggtcttcccccgtggccaccctcctccaagcgccacctcgtggggccacgacgccggccctgggccgtgcccgtggccgaacgggaccttacgttcccncgattccggcgtcgtggacggcgggtctcggg

SEQ ID NO: 128775 - DNA, 509 bp, Homo sapiens
  misc_feature: GYAE6OF01ENXX9.45.78.H01.1.454.CMB.1.raw
  modified_base (506)..(506): a, c, t, g, unknown or other
  misc_feature (506)..(506): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtaactggttggcctggtatcagcagaaaccagggaaagcccctaagctcctgctctataaggcatctagtttagaaagtggggtcccatcaaggttcagcggcagtggatctgggacagaattcactctcaccatcagcagcctgcagcctgatgtattttgactaactttattactgacccaacagtatgattagttattcgacgttcggaccaagggaccaaaggtggaaaatcgaaaacgaactggtggctgacaccatctgtctntac

SEQ ID NO: 128776 - DNA, 537 bp, Homo sapiens
  misc_feature: GYAE6OF01B66HB.45.78.H01.1.454.CMB.1.raw
tcagacgcgatcgacacgaccggtgctcgatttagtgtgagtagtttgggtttggggtgaagaagcctgggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgatttttggagtggttattcggacggtatggacgtctggggccaagggaccacggtcaccgtctcctcagcctccaccaacgggcccactcggtccttccccctggccaccctcctccaagacgcacctcgtgggggccacacgccggccctgggcctgccctggtcaacggactacgttcctcgatcgcgtctgcgcgggctcgg

SEQ ID NO: 128777 - DNA, 562 bp, Homo sapiens
  misc_feature: GYAE6OF01CMRC0.45.78.H01.1.454.CMB.1.raw
  modified_base (284)..(284): a, c, t, g, unknown or other
  misc_feature (284)..(284): n is a, c, g, or t
  modified_base (311)..(311): a, c, t, g, unknown or other
  misc_feature (311)..(311): n is a, c, g, or t
  modified_base (317)..(317): a, c, t, g, unknown or other
  misc_feature (317)..(317): n is a, c, g, or t
  modified_base (354)..(354): a, c, t, g, unknown or other
  misc_feature (354)..(354): n is a, c, g, or t
  modified_base (533)..(533): a, c, t, g, unknown or other
  misc_feature (533)..(533): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaaccctaacaatggtggcacaaactatgcacagaagtttcagggcaggtcaccatgaccagggacacgtccatcagcacagcctacatggagctgagcgagcgngagctcagacgacacggctgtatatgngcgagnggcaggattacgagttttggagttgtattcggagtanggacgtcgtggggccaaagggccacgggtcaccgtctcctcgacgcctacccaccgaacgggccctagtccggtcccttcccctcggccctaccctcccgtaccaacgtacgacccaccgtccgtacggggccacgacgccggccgtcggctcgccgtgtacgacggtactaccgtccncgactcgtcgtactggcgtcggcgtcggg

SEQ ID NO: 128778 - DNA, 574 bp, Homo sapiens
  misc_feature: GYAE6OF01BAJTX.45.78.H01.1.454.CMB.1.raw
  modified_base (433)..(433): a, c, t, g, unknown or other
  misc_feature (433)..(433): n is a, c, g, or t
  modified_base (444)..(444): a, c, t, g, unknown or other
  misc_feature (444)..(444): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaacctaacaatggtggcacaaactatgcacagaagttcagggcagggtcaccatgaccagggacacgtccatcagcacagcctacatggagctgagcaggctgagatctgacgacacggccgtgtagttactgtgcgagaggcaggaattacgattttggagtggttattcggacgtatggacgtcgtggggccaagggaccacggtcaccgtctcctcacgccctaccaccgaacggcccatccgtctccccnggccaccctcncaacgcgcacctcgtcggggccacgacgccggacccgtcgggcctcggcccgttgggtaccgaacggtacccttaccgttcccgtaccggtacgtccgtccgttcgtaggaccggtccggggctacgggg

SEQ ID NO: 128779 - DNA, 525 bp, Homo sapiens
  misc_feature: GYAE6OF01EUU94.45.78.H01.1.454.CMB.1.raw
tcagacgcgatcgacacgaccggtgctcgatttagtgtgagtagtttgggtttggggagagcatcacccagcaaccacatctgtcctctagagaatcccctgagagctccgttcctcaccatggactggacctggaggatcctcttcttggtggcagcagccacaggagcccactcccaggtgcagctggtgcagtcttgggctgaggtgaagaagcctgggggcctcagtgaaggtctcctgcaaggcttctggatacaccttcaccggctactatatacactgggtgcgacaggcccctggacaagggcttgagtggatgggatggatcaaaccctaacaatggtggcacaaactatgacacagaagtttcagggcagggtcaccatgaccaggacacgtacatcagcacagcctacatggagctgagcgaggctaggagatcgtgaccgacgacgggccgtagttaattacgtggtacggacggaaggacgggcaagggtaacttacggtagtttttagggg

SEQ ID NO: 128780 - DNA, 627 bp, Homo sapiens
  misc_feature: GYAE6OF01D20LH.45.78.H01.1.454.CMB.1.raw
  modified_base (138)..(138): a, c, t, g, unknown or other
  misc_feature (138)..(138): n is a, c, g, or t
tcagacgcgatcgacacgaccggtgctcgatttagtgtgagtagtttgggtttggggtgaagaagcctggggcctcagtgaaggtctcctgcaaggcttctggatacacccttcaccggctactatatacactgggtncgacaggcccctggacaagggcttgagtggatgggatggatcaaccctaacaatggtggcacaaactatgcacagaagtttcagggcagggtcaccatgaccagggacacgtccatcagcacagcctacatggagctgagcgagcgtgaggatctagacgacacggccgtgtattactgtgcgagaggcaggaattacgattttggagtggttatcggacggtatggacgtcgtggggaccaagggacctacggtcgaccgtcctcctccacgccctaccgaacccaacggggccccacgttaccggtccctttaccccccgtcgggtcccaacccccgttcccgtcccaaacggacgccctaacccgtccgtcggggggccaaccgacgccgggccccgtggggcctcggcccgtcggtaccgaacggtacctaaccgttccccgtacgacttccggtcgtccgtagacggtccggggcgtaccgggg

SEQ ID NO: 128781 - DNA, 600 bp, Homo sapiens
  misc_feature: GYAE6OF01AGOGX.45.78.H01.1.454.CMB.1.raw
  modified_base (288)..(288): a, c, t, g, unknown or other
  misc_feature (288)..(288): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgaggctgagntctgacgacacggccgtgtattactgtagcgaggaggcaggaattacgatttttggagttggttagttcggacggtatggacgtcgtggggaccgaagggaccgacggtcaccgtctcctcacgccctcaccgaacgggcccagtccgtccttccccctggccaccccttcctacacgtcgccaccgtcgtcggggcacgcggccggcccgtgggacctcggccgtacgggtaccgaaacgggtaccttacccgttccgtccggtaacgtcccgggtaccgttccggtaggacggtacggggcgtaccgggg

SEQ ID NO: 128782 - DNA, 533 bp, Homo sapiens
  misc_feature: GYAE6OF01C7C1C.45.78.H01.1.454.CMB.1.raw
tcagacgcgatcgacacgaccggtgctcgatttagtgtgagtagtttgggtttggggctgaggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaaactatgcacagaagtttcagggcagggtcaccatgaccagggacacgtccatcagcacagcctacatggagctgagcaggctgagatctgacgacacggccgtgtattactgtgcgagaggcaggaattacgattttggagtggttattcggacggtatggacgtctggggccaaggggaccacggtcaccgtctcctcagcctccaccaagggcccatcgtcttccccctggccaccctcctccaacgacgcacctctggggcacgacgccggcccgtgggctcgcctggtcaacggactacttcctcgactcgcgtctgacgg

SEQ ID NO: 128783 - DNA, 509 bp, Homo sapiens
  misc_feature: GYAE6OF01ADK6X.45.78.H01.1.454.CMB.1.raw
  modified_base (334)..(334): a, c, t, g, unknown or other
  misc_feature (334)..(334): n is a, c, g, or t
  modified_base (504)..(504): a, c, t, g, unknown or other
  misc_feature (504)..(504): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggcagtcagagtattagtaactggttggcctggtatcagcagaaaccagggaagcccctaagctcctgctctataaggcatctagtttagaaagtgggtccatcaaggtcagcgnagtgatgtggacagaatcactctcaccatcagcagcctgcagcctgatgtattttgactaactttattactcgaccaacagttatacgtattacgttagttcgacgttcggaccaagggaccaagggtagaaactacgaaacgtatggtggctgctaccatactgtcttntaccg

SEQ ID NO: 128784 - DNA, 129 bp, Homo sapiens
  misc_feature: GYAE6OF01A214T.45.78.H01.1.454.CMB.1.raw
tcagacgcgatcgacacgaccggtgctcgatttagtgtgagtagtttgggtttgggcacagcggccctgggctgcctggtcaaggactacttcctcgatcgcgtctgagcgggctggcaaggcgcatag

SEQ ID NO: 128785 - DNA, 550 bp, Homo sapiens
  misc_feature: GYAE6OF01DBM9G.45.78.H01.1.454.CMB.1.raw
  modified_base (536)..(536): a, c, t, g, unknown or other
  misc_feature (536)..(536): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgaacgacacggccgtgtattactgtgcgagaggcaggattacgatttttggagttggttattcggacggtatggacgtcgtggggccaagggaccacggtcaccgtctcctcacgcctccaccgaagggcccatccgggtccttcccccgtggccacccctcctcccaagacgccacctcgtcgggggcaccgacgccggccctgggctcgccgtggcgaaggacctacttcctcgactcgcgtcngacgcggcgtcggg

SEQ ID NO: 128786 - DNA, 517 bp, Homo sapiens
  misc_feature: GYAE6OF01DX4JD.45.78.H01.1.454.CMB.1.raw
  modified_base (483)..(483): a, c, t, g, unknown or other
  misc_feature (483)..(483): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctcctgcaaggcttctggatacaccttcaccggctactatatacactgggtgcgacaggcccctggacaagggcttggagtggatgggatggatcgaaaccctaacaagtggtggcacaaactatgcacagtaagtttcagggcagggtacaccatagaccaagggacacgtccaatcagcacacgcctacagtggagcgtgagcgaggcgtagagactcgagacgacgaccggcgtagtagttacngtgacgagaggcaaggtattacgtgtttggtagg

SEQ ID NO: 128787 - DNA, 501 bp, Homo sapiens
  misc_feature: GYAE6OF01E5KB4.45.78.H01.1.454.CMB.1.raw
  modified_base (418)..(418): a, c, t, g, unknown or other
  misc_feature (418)..(418): n is a, c, g, or t
  modified_base (498)..(498): a, c, t, g, unknown or other
  misc_feature (498)..(498): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtaactggttggcctggtatcagcagaaaccagggaaagcccctaagctcctgctctataaggcatctagtttagaaagtgggtcccatcaaggttcagcggcagtggatctgggacagaattcactctcaccatcagcagcctgcagcctgatgattttgactaacttattactgaccaanagtatgattagttattcgacgttcggaccaagggaccaagggtaggaaatcgaaacgaatgtggctgcacatctgttctntac

SEQ ID NO: 128788 - DNA, 549 bp, Homo sapiens
  misc_feature: GYAE6OF01D0N0Q.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgatttttggagtggttattcggacggtatggacgtctggggccaagggaccacggtcaccgtctcctcagcctccaccaacgggcccagtccgtccttccccctggccacccctcctcccaacgacgccaccctcgtcgggggccacgacgccggccctgggcctgcctggtccgaacggactacttcctcgatccgcgtctgacggcgggctcggg

SEQ ID NO: 128789 - DNA, 536 bp, Homo sapiens
  misc_feature: GYAE6OF01DR74D.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgatttttggagtggttattcggacggtatggacgtctggggccaagggaccacggtcaccgtctcctcagcctccaccaacgggcccatcggtcttccccctggccaccctcctccaagacgcacctcgtcgggggcacgagcggccctgggcctcgcctggtcgaaggactacgttcctcgatcgcgtctgacgcggctcggg

SEQ ID NO: 128790 - DNA, 562 bp, Homo sapiens
  misc_feature: GYAE6OF01BALW6.45.78.H01.1.454.CMB.1.raw
  modified_base (547)..(547): a, c, t, g, unknown or other
  misc_feature (547)..(547): n is a, c, g, or t
  modified_base (557)..(557): a, c, t, g, unknown or other
  misc_feature (557)..(557): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgatttttggagtggttattcggacggtatggacgtcgtggggccaagggaccacgggtcaccgtctcctcagccctccaccaagggccccatccggtccttcccccgtggccaccccgtcctcccaacgtacgccaccctcgtcgggggccacgtaggccggccctgggcctcgcctggtccgaaggtaccctacgttccctcgactccgcgtcnggacgcgggntcggg

SEQ ID NO: 128791 - DNA, 513 bp, Homo sapiens
  misc_feature: GYAE6OF01C7L7Y.45.78.H01.1.454.CMB.1.raw
  modified_base (474)..(474): a, c, t, g, unknown or other
  misc_feature (474)..(474): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggaccaagggcttgagtggagtgggatggatcaaaccctaacaagtggtggcaacaaactatgcacagaagtttcagggcagggtcaccatcgacagggacacgtaccatcagcacacgcctacatggagctacgagcgaggctgagatcgtagacgacgacggtcgtgtattanggtgcgtagaggtacgaaggtattacgtgttttggtagg

SEQ ID NO: 128792 - DNA, 577 bp, Homo sapiens
  misc_feature: GYAE6OF01C4YM9.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgatttttggagtggttattcggacggtatggacgtcgtgggccaagggaccacggtcaccgtctcctcacgcctccaccgaacgggcccacgtccggtccttcccccgtcggccctaccctccctccaagacgccacccgtcgtcgggggcacgacgccggcccgtcgggcctcgcccgtggtccgaacggtaccttaccgttcccgtcgtacttcggtccgttcgtggacggcgggcgtcgggg

SEQ ID NO: 128793 - DNA, 629 bp, Homo sapiens
  misc_feature: GYAE6OF01BERKA.45.78.H01.1.454.CMB.1.raw
  modified_base (189)..(189): a, c, t, g, unknown or other
  misc_feature (189)..(189): n is a, c, g, or t
  modified_base (269)..(269): a, c, t, g, unknown or other
  misc_feature (269)..(269): n is a, c, g, or t
  modified_base (287)..(287): a, c, t, g, unknown or other
  misc_feature (287)..(287): n is a, c, g, or t
tcagacgcgatcgacacgaccggtgctcgattagtgtgagtagtttgggtttggggtggaagaagcctggggcctcacgtgaaggtctcctgcaaggcttctggatacaccttcaccggctactatatacactgggtgcgacaggcccctggacaagggcttgagtggatgggatggatcaaccctaanaatggtggcacaaactatgcacagaagtttcaggcagggtcacatgacaggacacgtccatcagcacagcctacatgganctgagcaggctgagatcngacgacgacggccgtagtacttacgtgtgcgagaggcaaggtaattacgtatttttgggagtttggttagttacgggtacggtagtggacggttcgtggggaccgaagggaccgacgggtctaccggttctccgtacgacgtaccctacccgaaccgaacgggtccctaagtcccggttccttcccccgtcgccctacccctccctcaacgacgcctacccgtcgtcgggggccacgacggtcccgggcccgtgggccttacggcccgttacgggtaccgaacggttacccttaccgtccctacgacgtccggtaccgtctacggcggtccggggctacggg

SEQ ID NO: 128794 - DNA, 515 bp, Homo sapiens
  misc_feature: GYAE6OF01D04DM.45.78.H01.1.454.CMB.1.raw
  modified_base (345)..(345): a, c, t, g, unknown or other
  misc_feature (345)..(345): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtaactggttggcctggtatcagcagaaaccagggaaagcccctaagctcctgctctataaggcatctagttagaaagtgggtccatcaaggtcagcggcagtgatcgngggacagaatcactctcacatcagcagcctgcagcctgatgtattttgactaactttattactgaccaatagtatagtattagtttattcggtacgttcggaccaaagggaccaaagggtaggaaatacgaaaacgtaagtggtcggctgaccactatctcgtcttctac

SEQ ID NO: 128795 - DNA, 653 bp, Homo sapiens
  misc_feature: GYAE6OF01COVAR.45.78.H01.1.454.CMB.1.raw
  modified_base (320)..(320): a, c, t, g, unknown or other
  misc_feature (320)..(320): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggccccctggacaagggcttgagtggatgggatggatcaaaccctaacaatggtggcaacaaactatgcacagaagtttcagggcagggtcacatgaccgagggacacgtccatcagcacagcctacagtggagctgagcgaggctgagatcgtagacgacaccggccgtgtattacngtgcgagaggcaggtattacgtatttttggagttggttattcgggacgtagtggacgtcgtgggaccgaaggccacggtcaccgtcgtcctcgacgccctaccaaccgaacgggaccctagtcccggttcccttccccgtcggacccctaccccttccctaccgtaacgaccgtaccacccgttcggtaccgggggccaaccgacggcccgggtcccgtcgggtcctacggtcccggttagggttaaaccggtaccttacccgtttacccggtcggtaaccgttcccggtccgttaccggtacgggaccggtccggggtcgtcggggaaccgg

SEQ ID NO: 128796 - DNA, 601 bp, Homo sapiens
  misc_feature: GYAE6OF01DZH3C.45.78.H01.1.454.CMB.1.raw
  modified_base (272)..(272): a, c, t, g, unknown or other
  misc_feature (272)..(272): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatgganctgagcaggctgagatctgacgacacggccgtgtattactgtgcgagaggcaggaattacgattttggagttggttattcggacggttatggtacgtcgtggggccaagggaccacggtcaccgtctcctcagcctccaccgaacgggccctacgtccggtccctttcccccgtcgtcccacccctcccttacccgaacgacgccaacccgttccgtagggggccaccgacgcccggcccgtcggggcctcggcccgttcgggtccgaacgggtactaccgttcccgtccgtacgtccggtaccgtcgtaggacggtcgggcgtacggg

SEQ ID NO: 128797 - DNA, 541 bp, Homo sapiens
  misc_feature: GYAE6OF01BRZCR.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgattttggagtggttattcggacggtatggacgtcgtggggccaagggaccacggtcaccgtctcctcagcctccaccaagggcccatcgtctcccctgccaccctcctccaagcgccacctcgtcggggcacgtacgccggaccctgggcctcgccgtggtccgaacggcttaccgttccctcgactcgcgtctagcgcgggctcggg

SEQ ID NO: 128798 - DNA, 537 bp, Homo sapiens
  misc_feature: GYAE6OF01BZ5EA.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtatactgtgcgagaggcaggattacgattttggagtggttattcggacggtatggacgtctggggccaagggaccacggtcaccgtctcctcagcctccaccacggcccagtccggtcttcccctggccaccctccctccaacgacgccacctcgtgggggccacgacgcggccctgggcctgcccgtggtcgaggactacgttcctcgatcgcgtctgacgcgggcgtcgg

SEQ ID NO: 128799 - DNA, 518 bp, Homo sapiens
  misc_feature: GYAE6OF01AR9WC.45.78.H01.1.454.CMB.1.raw
  modified_base (269)..(269): a, c, t, g, unknown or other
  misc_feature (269)..(269): n is a, c, g, or t
  modified_base (337)..(337): a, c, t, g, unknown or other
  misc_feature (337)..(337): n is a, c, g, or t
  modified_base (421)..(421): a, c, t, g, unknown or other
  misc_feature (421)..(421): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggngactatctccactgggtgcgacaggccctggacaagggcttgagtggatgggatggatcaaccctaanaatggtggcacaaactatgcacagaagtttcagggcagggtcacatgaccagggacacgtccatcagcacacgcctacatggancgtgagcagactgacatctagacgacaccggcctatttactactggtgcggaaggtattacggtttaccgggtggtcgttgggtttccttttacggg

SEQ ID NO: 128800 - DNA, 510 bp, Homo sapiens
  misc_feature: GYAE6OF01A4ET9.45.78.H01.1.454.CMB.1.raw
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagatcaccatcacttgccggccagtcagagtattagtaactggttggcctggtatcagcagaaaccagggaaagcccctaagctacctgctctataaggcatctagtttagaaagtgggtacccatcaaggttcagcggcaggtgatctgggacagaattcactctacacatcagcagcctgcagcctgatgattttgactaacttattactgcctaacagtaatgatagttatcgtacgttcggaccgaaggaccaaggtacggaaatacgaaacgaatggtcgcttagactaccatactgtcttctacg

SEQ ID NO: 128801 - DNA, 579 bp, Homo sapiens
  misc_feature: GYAE6OF01B94GC.45.78.H01.1.454.CMB.1.raw
  modified_base (272)..(272): a, c, t, g, unknown or other
  misc_feature (272)..(272): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatgganctgagcaggctgagatctgacgacacggccgtgtattactgtgcgagaggcaggaattacgtattttggagttggttattcgggacggtagtcggtacggtcgtggggaccgaagggaccgacggtcaccgtctcctcacgcctcccaaccgaacggcccacgtccgtccttcccccgtgcctaccctcctccaacgcgccacctccgtcggggccacgacggccggcccgtgggcctcgcccgtggtcgaacggtacctaccttccgtccgtactcccggtcgtcgtgacggtccgggcgtcgggg

SEQ ID NO: 128802 - DNA, 587 bp, Homo sapiens
  misc_feature: GYAE6OF01BFITS.45.78.H01.1.454.CMB.1.raw
tcagacgcgatcgacacgaccggtgctcgatttagtgtgagtagtttgggtttggggggacgtcagacccacgtcaggacacacgcatggacatgagggtcccccgctcagctcctgggggctcctgctgctctggctcccaggtgaccaaagtgtcgacactccgagatacgacccagtcctaccttccacccgtgtctgcaatctgtagggacacagagtcaccatcacgttgccgggcagtcagtagtattagtactggttgcctggtatcgagcagaaccacgggaagcccctaaggcctcctgctctagtaggcatctagttacgaagtcgggtccatacgaaggttcacggcggctagtggagtcgtgggactagtaattcactctcaccatcagcagcctagcagcctgattgtattttggacctaactttacttacgtcgaccaaacgtagtactagtacttagtttactttcggtacgttcggaccgtaagggaccgtaaggtaggaaactcgaaacggtacgttggtcggtaccgtagggacccgtacctacgttaccgtcggttccgtcgtacccg

SEQ ID NO: 128803 - DNA, 623 bp, Homo sapiens
  misc_feature: GYAE6OF01BKKEF.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagagcaggaattacgtatttttggagttggttagttcgggacgtagtggacgtcgtggggtaccaaagggccacggtcaccgtctcctcacgcctcccgaaccgaacggggccccaagtccggtaccctttcccccgtgggtccctaccccgtcccttacccgaacgacgccgaacccttccgtcgggggaccaccgacggccggaccccgtggggcctcggtcccgtggtaccgaacggtaccgttaccgttcccgtaccgtacttcccggtacgttccgtaggacggtccggggtcgtaccggg

SEQ ID NO: 128804 - DNA, 567 bp, Homo sapiens
  misc_feature: GYAE6OF01BG9UH.45.78.H01.1.454.CMB.1.raw
  modified_base (551)..(551): a, c, t, g, unknown or other
  misc_feature (551)..(551): n is a, c, g, or t
tcagacgcgatcgacacgaccggtgctcgatttagtgtgagtagtttgggtttgggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgattttgggagttggttattcggacggtatggacgtcgtggggccaagggccacgggtcaccgtctcctcacgcctccaccaacgggcccactccggtccttcccccgtcggccctacccctccctcccaacgacgccacccttcgtcgggggccaccgacgccggcccgtgggcctcgccgtggtcgaacggtactacttccctcgatccggtcgtcgnggcgccgggcgtcggg

SEQ ID NO: 128805 - DNA, 572 bp, Homo sapiens
  misc_feature: GYAE6OF01ESG2G.45.78.H01.1.454.CMB.1.raw
  modified_base (344)..(344): a, c, t, g, unknown or other
  misc_feature (344)..(344): n is a, c, g, or t
tcagacgcgatcgacacgaccggtgctcgatttagtgtgagtagtttgggtttgggggaggcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcgagtgaaggtctcctgcaaggcttctggatacaccttcaccggctactatatacactgggtgcgacgaggcccctggacaaggggcttggagtggatgggatgggatcaacctaanaatggtggcacaaactatgcacagtaagttcgagggcagggtcactatgacagggacacgtcatcagcacagacctacagtggacgctaggacgtcgaggcgtagacgactccgtaggaccggtaaccgaccgggtaccgttaggttaacgttacgtaggttcggaccggtaagggacgggtacgtaagggtaaagtttaaccgggttaagtttttggggtaaacggg

SEQ ID NO: 128806 - DNA, 579 bp, Homo sapiens
  misc_feature: GYAE6OF01B8E4F.45.78.H01.1.454.CMB.1.raw
  modified_base (276)..(276): a, c, t, g, unknown or other
  misc_feature (276)..(276): n is a, c, g, or t
tcagacgcgatcgacacgaccggtgctcgatttagtgtgagtagtttgggtttgggggagtcaggacccagtcaggacacagcatggacatgacgggtccccgctcagctcctggggctcctgctgctctggctcccaggtgccaaatgtgacatccagatgacccagtcctccttccaccctgtctgcagtctgtaggagacagagtcaccatcacttgccgggcagtcagagtattagtaactggttgcctggtatcagcacgaaccaggaacnccctaagctcctgctctataaggcatctagttagaagtgggtccatcaaggttcagcggcaggtggatcgtgggacagtaacttcactctacacctatcagcacgccgtgactacgtccttagtattagtattttacgacttaactttacttactcgacctaagtagttatagtacttacgtttacgtcggtacgttaccgggaccgaaagggtaccaaagggtacgaaaacgtaccgaaaacggttacgtagggtcgtacgtacgaccgttaaccagtttccttcgttcccttccgtacccg

SEQ ID NO: 128807 - DNA, 554 bp, Homo sapiens
  misc_feature: GYAE6OF01CJMV2.45.78.H01.1.454.CMB.1.raw
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtatagtaactggttggcctggtatcagcaagaaaccagggaaaacgcccctaagctcctgctctataaggcatctagtttagaaagtgggtaccatcaaggttcaggcggacagtggatcgtgggacagaacttcactctcacatcagcagcctgcagcctgatgtatttagcttaaattacttactgaccaaacgtagttataggtaattaggttacttacggtaacggttcggaccgtaaagggacccgtaaagggtacgaaaatacgaaacgaagttaggtcggctacggacctaacgtacttacgtcgttcttctaccg

SEQ ID NO: 128808 - DNA, 521 bp, Homo sapiens
  misc_feature: GYAE6OF01BYQ9B.45.78.H01.1.454.CMB.1.raw
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtaactggttggcctggtatcagcagaaaccagggaaacgcccctaagctcctgctctataagcatctagttagaagtgggtccatcaaggtcagcggcagtgatcgtggacagaattcactctcacatcagcagcctgcagcctgatgtatttgactaactttattactcgaccaactgtatagtattagtttacttcggtacgttcggacgaagggaccgtaagggtagaaactacgaaacgtacgtggtcggactcggacctacgtattctgttcttctacc

SEQ ID NO: 128809 - DNA, 695 bp, Homo sapiens
  misc_feature: GYAE6OF01DH651.45.78.H01.1.454.CMB.1.raw
  modified_base (303)..(303): a, c, t, g, unknown or other
  misc_feature (303)..(303): n is a, c, g, or t
  modified_base (392)..(392): a, c, t, g, unknown or other
  misc_feature (392)..(392): n is a, c, g, or t
  modified_base (687)..(687): a, c, t, g, unknown or other
  misc_feature (687)..(687): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggagtggagtggataccaaaccctaacaagtgggtcgacaactaaactatgacacaagtaagtttcggagggcgagggtaccaccgagtacgaccgaagggaccacgtaccatacgacgaccaacgacgacccttaanaggtgggaacgtccgtaggaacggcggtaacggtcgaggaaggtactcgtaggaaccgacgaccggtcgtagtaacttcgtgcgagagngacgaagtaacgttagttagtttgagtttggttagtcgggaagtgtcggtacgttcggcggggtaaccgaaacgggtaccgaacgggttccgacccgttcctaccgtacgtaaccgtcccgtacccgaaccggtaaccgggtcctaacggttcccgttccctttccccgcggaccctacccgtccctacgaacgccgcctaccgtcggtcgggaccacgcggcccgccggtcggtctccggcgtacgaccgtacgtacctaccttcgacgtacctcgtcgttcgaggcggtcggngtaccggg

SEQ ID NO: 128810 - DNA, 625 bp, Homo sapiens
  misc_feature: GYAE6OF01BI5W9.45.78.H01.1.454.CMB.1.raw
  modified_base (195)..(195): a, c, t, g, unknown or other
  misc_feature (195)..(195): n is a, c, g, or t
tcagacgcgatcgacacgaccggtgctcgatttagtgtgagtagtttgggtttggggtgaagaagcctggggcctcagtgaacggtctcctgcaaggcttctggatacaccttcaccggctacctatatacactgggtgcgacaggcccctggacaaggcttgacgtggatcgggactggagtcgaacccgtaanaagtggtggcacaaacgtatggcacgagaagttcagggcagggtcaccatgaccgagggacaccgtccatcagcgacgacgcctacagtcggagctgagcgagctcgagactcgtaggacgacgaccggccgtagtattacgtggtcgcgtaggaggccaaggtacttacggtagttttggagttggttatcgggacgtagtcggacgtgcgggaccgtaagggctacggtccgaccgtcctccgtcacgcctaccgaaccgaggaccctagtccgtccttccccgtcgtcctacccgtcctaccgacgacgccaccgtcggtcggggtcaccggacggccggaccgtacgggccgtaccggccgtcggtacgtacggacttacccgttccgacgtaccgtccgtcgtccgtgcggtccggtcgtaccgg

SEQ ID NO: 128811 - DNA, 572 bp, Homo sapiens
  misc_feature: GYAE6OF01AZIYK.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgattttggagtggttattcggacggtatggacgtctggggccaagggaccacggtcaccgtctcctcacgcctccaccgacgggcccagtccgtccttccccgtggccaccctcctccaacgacgccacctcgcggggccaccgagccggcccgtcgggcctcgccgtgggtccaacgggtacctaccgtttccgtccggacttccggtccgttacgtggacggtcggggccgtacgggg

SEQ ID NO: 128812 - DNA, 611 bp, Homo sapiens
  misc_feature: GYAE6OF01D0P5L.45.78.H01.1.454.CMB.1.raw
  modified_base (284)..(284): a, c, t, g, unknown or other
  misc_feature (284)..(284): n is a, c, g, or t
  modified_base (458)..(458): a, c, t, g, unknown or other
  misc_feature (458)..(458): n is a, c, g, or t
  modified_base (480)..(480): a, c, t, g, unknown or other
  misc_feature (480)..(480): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaacctaacaatggtggcacaaactatgcacagaagtttcaggcagggtcacatgaccagggcacgtccatcagcacagccctacatggagctgagcaggctgagntctgacgacgacggcgtgtattactgtgcgagaggcaggtaattacggtatttttggagttggttacgttcggacggttaagtcggacggtcgtgggggaccaagggaccacgggtcaccggttctcctcgacgccctaccaccgaacgggccctacgtcggtcccttccccgngccctaccctcctaccacgacncctaaccctcggtcggggacctacgacggccggacccgtcggccttcggaccgttcgggtacgtaacggtaccttaaccgtttcccgacgtacgtccggtccttcgtacgggccggtcgggtcgtacgggg

SEQ ID NO: 128813 - DNA, 662 bp, Homo sapiens
  misc_feature: GYAE6OF01EY84A.45.78.H01.1.454.CMB.1.raw
tcagacgcgatcgacacgaccggtgctcgattttagtgtgagtagtttgggtttggggtcgtgaggtgaagaagcctgggcctcagtgaaggtctcctgcaaggcttctggatacaccttcaccggtctactatatacactgggtgcgacaggccctggacaagggcttgagtggatggggatggatcaacctaacaagtggtggcacaaactatgcacagaagtttcagggcagggtcaccatgaccaggacacgtccatcagcacagcctacagtggagcgtgagcaggctgagagtctgacggacgacggccgtagtattacgtgtgcgagaggacgaaggattacgattttggagtggttatcggacgtagtggaacgtcgtagggaccgaagggtaccgtacggtccaccgtactccgttacacgtcccgtaccaaccgaacgggcccgaacgtccggtacccgttcccccgtacggtccctacccgtcctaccgtaacgacgaccgtaccgttcggtacgggggcctacgcggaccggtaccccggtcggggtcccgttcggtaccccgtttagggtaccggtaaaccgggaacccgtttacccgttacccggttaccggtacgttacccggtccgttccgtcgggtaacccgggg

SEQ ID NO: 128814 - DNA, 560 bp, Homo sapiens
  misc_feature: GYAE6OF01EHGWS.45.78.H01.1.454.CMB.1.raw
  modified_base (290)..(290): a, c, t, g, unknown or other
  misc_feature (290)..(290): n is a, c, g, or t
  modified_base (367)..(367): a, c, t, g, unknown or other
  misc_feature (367)..(367): n is a, c, g, or t
  modified_base (501)..(501): a, c, t, g, unknown or other
  misc_feature (501)..(501): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcgagtgaggtctctgcaggcttctggatacctaccttcgaccggtctatatatacacgtgggtncgacgacggccctggactacgggcttggagtggatgggatggatccgaaacctaagaagtggtaggacaacaaactntgacaagagtaagttcgagggcagggcacgagcgacgaggactacgcatcagctacacgacctagagtggagtcgtcgagcgagggtctagagctacgtacggaaccgacgtacggtccgttagtacgttacgnggtacggaggaaggacgggtacgtaaggttaagtttaacggttagttttagggtacggg

SEQ ID NO: 128815 - DNA, 607 bp, Homo sapiens
  misc_feature: GYAE6OF01B2TAE.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcaacaaactatgcacagaagtttcagggcagggtcaccatgaccagggacacgtccatcagcacagcctacatggagctgagcagactgacatctgacgacacgccatttatactgtgcgagtattgtttaccggtggtcttggtttccttttagacgtacgtcggggccacgggaaccctggtacaccactctcctcacgccctaccaccgaacgggccccacgttccggtacccttcccccgtcggccctacccctccctaccgaaacgacgccacccgttcggtacgggggaccaccgacggcccggaccccgtcgggacctcggtcccgtcggtaccgaacggtaccttaccgttcccgtacgtacgtccgcgtcgtggacggccggtcgtcggacaacggcgctag

SEQ ID NO: 128816 - DNA, 519 bp, Homo sapiens
  misc_feature: GYAE6OF01A3OVH.45.78.H01.1.454.CMB.1.raw
tcagacgcgatcgacacgaccggtgctcgatttagtgtgagtagtttgggtttggggagagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggcttgagtggatgggatggatcaaaccctaacaatggtggcacaaactatgcacagtaagtttcagggcagggtcaccatgaccgaggacacgtacatcagcacacgcctacatgggagctgacgcgaggcgtgagatcgtagacgacgaccggccgtgtattacgtgtggccggaggacggacgaaggtaattacggtagtttttagggg

SEQ ID NO: 128817 - DNA, 557 bp, Homo sapiens
  misc_feature: GYAE6OF01EFWGV.45.78.H01.1.454.CMB.1.raw
  modified_base (277)..(277): a, c, t, g, unknown or other
  misc_feature (277)..(277): n is a, c, g, or t
  modified_base (329)..(329): a, c, t, g, unknown or other
  misc_feature (329)..(329): n is a, c, g, or t
  modified_base (422)..(422): a, c, t, g, unknown or other
  misc_feature (422)..(422): n is a, c, g, or t
  modified_base (430)..(430): a, c, t, g, unknown or other
  misc_feature (430)..(430): n is a, c, g, or t
  modified_base (491)..(491): a, c, t, g, unknown or other
  misc_feature (491)..(491): n is a, c, g, or t
tcagacgcgatcgacacgaccggtgctcgatttagtgtgagtagtttgggtttggggacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagcctggggcctcagtgaggtctcctgcaggcttctggatacaccttcaccggctactatatacactgggtncgacacggccctggacgaaggcttgagtggatgggatggatacaaccctaanaagtggtaggacaacaaactatacgcaacaagtaagtttcaagggcgtaggtcaccagtcgaccgaggacacgtcatcagacacacgacctanagtcggancgtagagcgaggtacgtaggaagtactcgagtaacgacgaccgtcgtacgttactacgtgnggtacgaggacgggactaagggtaattacggtagttttagggagtttaggttagttcggtaacggg

SEQ ID NO: 128818 - DNA, 577 bp, Homo sapiens
  misc_feature: GYAE6OF01BXJPL.45.78.H01.1.454.CMB.1.raw
tcagacgcgatcgacacgaccggtgctcgattagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaaggaattacgtattttggagttggttagttcggacggtatggacgtcgtggggtaccgaagggaccacggtcaccgtctcctcgacgcctccaccgaacgggacccacgtcgtccttccccgtcggcctacccctccctaccgaacgacgccaacctccgtcgggggccacgacggccggacccgtgggcgtcgcccgtcgggtacacggtactaccttccgcgtactccgtcgtctaggcgcgggtcgtcggg

SEQ ID NO: 128819 - DNA, 197 bp, Homo sapiens
  misc_feature: GYAE6OF01BA48Z.45.78.H01.1.454.CMB.1.raw
  modified_base (173)..(176): a, c, t, g, unknown or other
  misc_feature (173)..(176): n is a, c, g, or t
  modified_base (178)..(197): a, c, t, g, unknown or other
  misc_feature (178)..(197): n is a, c, g, or t
tcagacgcgatcgacacgaccggtgctcgatttagtgtgagtagtttgggtttgggggaagaggaagactgacggtcccccaggagttcaggtgctgggcacagcggccctgggctgcctggtcaaggactacttcctcgatcgcgtctgagcgggctggcaaggcgcatagnnnngnnnnnnnnnnnnnnnnnnnn

SEQ ID NO: 128820 - DNA, 632 bp, Homo sapiens
  misc_feature: GYAE6OF01CMQ53.45.78.H01.1.454.CMB.1.raw
  modified_base (258)..(258): a, c, t, g, unknown or other
  misc_feature (258)..(258): n is a, c, g, or t
  modified_base (289)..(289): a, c, t, g, unknown or other
  misc_feature (289)..(289): n is a, c, g, or t
  modified_base (334)..(334): a, c, t, g, unknown or other
  misc_feature (334)..(334): n is a, c, g, or t
  modified_base (626)..(626): a, c, t, g, unknown or other
  misc_feature (626)..(626): n is a, c, g, or t
tcagacgcgatcgacacgaccggtgctcgattagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaaccctaacaatggtggcaacaaactatgcacagaagtttcagggcagggtcaccatgaccaggacacgtcatcagcanagcctacatggagctgagcagactgacatcngacgacacggacctatttattactgtgacgagattgtttaccggngtcttggtttcctttaggacgacgtgggaccgaacgggtacccgtggtccaccgtactctaccctgacgccctaccaaccgaacgggccctacgtcggttccttacccccgtcggccaccccgtcctaccgaacgacgcctaccgtcggtacgggcaaccgacggccggtacccgtcgggaccttcggacccgtacgggtaacgtaacgggtacttacccgttccgtaccggtactccgggtccgttcgttacgagggccgggacgttaccggggaactaaacggggcccgngtaacg

SEQ ID NO: 128821 - DNA, 570 bp, Homo sapiens
  misc_feature: GYAE6OF01A3JKM.45.78.H01.1.454.CMB.1.raw
tcagacgcgatcgacacgaccggtgctcgatttagtgtgagtagtttgggtttggggtgaagaagccttgggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgattttggagtggttattcggacggtatggacgtcgtggggccaagggccacgggtcaccgtctcctcagcctccaccaggcccagtcgtccttccccgtgccaccctcctccaacgacgccacctccgtcgggggccacgacgccggcccgtgggcctcggccgtcgggtccgaacgggtacttaccgttcccgtccgacgtcgtccgttccgtaggacggtccgggcggtaccggg

SEQ ID NO: 128822 - DNA, 529 bp, Homo sapiens
  misc_feature: GYAE6OF01BEYK4.45.78.H01.1.454.CMB.1.raw
  modified_base (372)..(372): a, c, t, g, unknown or other
  misc_feature (372)..(372): n is a, c, g, or t
  modified_base (420)..(420): a, c, t, g, unknown or other
  misc_feature (420)..(420): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtaactggttggcctggtatcagcaagaaaccagggaaagcccctaagctcctgctctataagcatctagttagaaagtgggtccatcaaggttcagcgcagtggatcgtgggacagaattcactctacacatcancagcctgcagcctagatgtatttcgactaaactttctactgacctaanagtatagtaattagttattacgtacgttcggaccgaagggaccaaagggtacgaaaatacgaaacgtatggtcgactaggacctaccgtaattccgtcttcgtctaccg

SEQ ID NO: 128823 - DNA, 519 bp, Homo sapiens
  misc_feature: GYAE6OF01C5CCZ.45.78.H01.1.454.CMB.1.raw
  modified_base (361)..(361): a, c, t, g, unknown or other
  misc_feature (361)..(361): n is a, c, g, or t
  modified_base (448)..(448): a, c, t, g, unknown or other
  misc_feature (448)..(448): n is a, c, g, or t
  modified_base (452)..(452): a, c, t, g, unknown or other
  misc_feature (452)..(452): n is a, c, g, or t
tcagacgcgatcgacacgaccggtgctcgatttagtgtgagtagtttgggtttgggggagagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggcttggagtggatgggatgggatccaacctaacaagtggtggacacaaactntgcaacagaagtttcgagggcagggtcaccatgaccagggacacgtcactcagcacagcctacatggagctgagcgaggctagacgntcgngacgacgacgggcgttgtattacgtgtgacggaggtacggacgaggtaaacttggtagttttacggg

SEQ ID NO: 128824 - DNA, 550 bp, Homo sapiens
  misc_feature: GYAE6OF01E2GOS.45.78.H01.1.454.CMB.1.raw
  modified_base (406)..(406): a, c, t, g, unknown or other
  misc_feature (406)..(406): n is a, c, g, or t
  modified_base (414)..(414): a, c, t, g, unknown or other
  misc_feature (414)..(414): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtaactggttggcctggtatcagcagaaaccagggaaaacccctaagctcctgctctataaggcatctagtttagaagtgggtccatcaagttcagcggcagtggatcgtgggacagaattcactctcaccatcagcagctgcagctgatgtatttgactaacttatacngacctaanagtatgtaatagtttattacggtacgttcgggaacctaaagggaccctaaagggtacgaaaataccgaaaaacggtacgtggtacggacctacggacccaccgttattcgttaccgttctttacctcgttcccccg

SEQ ID NO: 128825 - DNA, 565 bp, Homo sapiens
  misc_feature: GYAE6OF01D5DYV.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgtatttttggagttggttagttcgggacggtagtggacgtcgtggggccaagggaccacggtcaccgtctcctcacgccctcaccgacggcctacgtccgtccctcccgcgcccaccctccacacgcgccaccgtcggtcgggccacgacgccggtccgtcggcgtcgtccgtgtacgaacgtaccttaccttccgcgtacgtccgtccgtcgtggcgggcggtcggtacggg

SEQ ID NO: 128826 - DNA, 764 bp, Homo sapiens
  misc_feature: GYAE6OF01DJKMT.45.78.H01.1.454.CMB.1.raw
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgaccaaatgtgacatccagagtccgaacctcgtccttcctaccctaccgttgtcgtcgactactcgtaggtaaggacgaacgagacgtaccaacctactaccgtcgttccgggcccgacgtacggtacgaagtagttttaagttaacgtaacggttcggttcggtaccggttacgtacgtaacgacggaaccgaaacggtaaaacggaaccgggtaaaccgtccccgtaacgtccgttaccgtcggtacctacgttaaaacgtacggtaaacttacgtttaacgttaacggttaaagtaccggtcggtaacctagtacgtagtacgaggacgagtaggtacgtagtacggtagacgtaactacgtaccacttccaaccgtactagtcccagtacctacggtccctggtacctgtaacttggactttttagacctttaatacgttaacctttagtacctaacgtacttaagtagttaaagtagtttaaccggtttagttaaccggttaaccgggttacgaaccgggaaccggtaaacggtaacggtaaaagttacgaaaaccgtaacgtacgtaacggtcgtacgacgttacactaccgtatttacctccgttactcccttacccg

SEQ ID NO: 128827 - DNA, 593 bp, Homo sapiens
  misc_feature: GYAE6OF01D37UO.45.78.H01.1.454.CMB.1.raw
  modified_base (320)..(320): a, c, t, g, unknown or other
  misc_feature (320)..(320): n is a, c, g, or t
  modified_base (341)..(341): a, c, t, g, unknown or other
  misc_feature (341)..(341): n is a, c, g, or t
  modified_base (577)..(577): a, c, t, g, unknown or other
  misc_feature (577)..(577): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagcctgagcgaggctcgagactcgtagacgacgacggccgtgtatttacngtcgcgagagcagattacgtnttttggagttggttatcggacgtagtcggagtcgtggggacctaaggaccgtacggtccaccgtctccgtcacgccctacccgaacgaccggtcccactaccggtcccttccccgtcggacctacccctcccgtacctacgacgaccgacccttccggtcgggggaccacgaccgtccggacccgtcggcgtcgccgtcggtacgacggtaccttcgtccgtcgatccgcgtacgnggcggcggtcgtcggg

SEQ ID NO: 128828 - DNA, 598 bp, Homo sapiens
  misc_feature: GYAE6OF01DSQED.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaaccctaacaatggtggcacaaactatgcacagaagtttcagggcagggtcaccatgaccatggacacgtccatcagcacagcctacatggagctgagcgaggctgagatctgacgacgacggccgtgtattactgtgcgagaggcaggaattacgtagttttggagtggttagtcggaggtagtgggtacgtcgtcgggaccaagggacccacggtccacccgtctccgtacacgccctccaaccgaacgggcccagtcccggttccttcccccgtgccctaccctccctaccaacgcgaccaccctcgggtcgggccacgcggccgcccgtcgggcctccggccgtacggtccgaaggtaccttaccgttcccgacgacgttccggtccgttacgtcggacgggtccgggtaccgg

SEQ ID NO: 128829 - DNA, 633 bp, Homo sapiens
  misc_feature: GYAE6OF01DCE5Q.45.78.H01.1.454.CMB.1.raw
  modified_base (315)..(315): a, c, t, g, unknown or other
  misc_feature (315)..(315): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacacgtggtgcgacacggcccctggacaagggcttggngtggagtgggatgggactacaaacctaacaagtgggtaggacaacaaactatgacacagtaaggtttcgaacgggcaggggtcaaccgagtacgaaccgaagggaaccacggtaccaatacgagaccaacgacgaccctaacgtaacgtgggaacgcgtaggacggtaccggaagggtccgtaggaagtacgtacgtacggaaccggtaccggaccgggtccggttagttaaacgttaccgttagggtcggtaacggaagggacgggacggtaaagggtaacgttttaacggttaaggttttttgggttaaacggggg

SEQ ID NO: 128830 - DNA, 601 bp, Homo sapiens
  misc_feature: GYAE6OF01BGHWU.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgattttggagtggttattcggacggtatggacgtcgtgggccaagggaccacggtcaccgtctcctcagcctccaccgaacggcccactccggtccttcccccgtggccctaccctcctccaacgacgccacccgtcgtcgggggtaccaccgacggccggtacccgtcgggccgtcggtcccgtacgggttaccgaaacgggtaccttaacccgttcccgtacgaacgttccgtccggttcgtaggacggtccggggtcgtaccgggg

SEQ ID NO: 128831 - DNA, 574 bp, Homo sapiens
  misc_feature: GYAE6OF01C8BQC.45.78.H01.1.454.CMB.1.raw
  modified_base (348)..(348): a, c, t, g, unknown or other
  misc_feature (348)..(348): n is a, c, g, or t
  modified_base (371)..(371): a, c, t, g, unknown or other
  misc_feature (371)..(371): n is a, c, g, or t
  modified_base (491)..(491): a, c, t, g, unknown or other
  misc_feature (491)..(491): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtggggcctcgagtgaaggtctcctgcaaggcttctggatacaccttcaccggctactatatacacgtggtgcgacacggcccctggacaagggcttggagtggagtgggatggactaccaaaccctaanaagtgggtaggacaacaaaactntcgacactaagtaacgtttacgagggcagggtaccaccagtacgaaccgaacgggaccacggtaccagtcacgcaacacggaccctagacgtggacgcgtgacggacgaggcgtgaagtntcgtacgaccgacgaccggtcgtagtacttgtaggtcgacgaggacggtactaaggtaagtttacgttaggttttggtaaggg

SEQ ID NO: 128832 - DNA, 177 bp, Homo sapiens
  misc_feature: GYAE6OF01DJVNQ.45.78.H01.1.454.CMB.1.raw
  modified_base (173)..(177): a, c, t, g, unknown or other
  misc_feature (173)..(177): n is a, c, g, or t
tcagacgcgatcgacacgaccggtgctcgatttagtgtgagtagtttgggtttgggggaagaggaagactgacggtcccccaggagttcaggtgctgggcacagcggccctgggctgcctggtcaaggactacttcctcgatcgcgtctgagcgggctggcaaggcgcatagnnnnn

SEQ ID NO: 128833 - DNA, 567 bp, Homo sapiens
  misc_feature: GYAE6OF01B0EA9.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgattttggagtggttattcggacggtatggacgtcgtggggccaagggaccacggtcaccgtctcctcacgcctccaccaacgggcccatcggtccttccccctggcccaccctccctccaacgacgccacctcgtcgggggccacgacgaccggcccgtgggcctcggcccgtggtacgaacgggtaccttacgttcccgtcgaactcggtcgtctaggacggcgggcgtcggg

SEQ ID NO: 128834 - DNA, 548 bp, Homo sapiens
  misc_feature: GYAE6OF01A03TH.45.78.H01.1.454.CMB.1.raw
  modified_base (523)..(523): a, c, t, g, unknown or other
  misc_feature (523)..(523): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtaactggttggcctggtatcagcaagaaaccagggaaagcccctaagctcctgctctataaggcatctagttagaaagtgggtccatcaaggttcagcggcagtggatcgtggacagaattcactctacacatcggcagcctgcagcctgatgtattttgactaactttattactgacctaactagtactgtaattagttagttcgtacgttacggaccgtaacgggaccgaagggtacgaaacgtacgaaaacggtacgtaggtcggtactacggacctaacctnttaccttagttcttctacttccccg

SEQ ID NO: 128835 - DNA, 524 bp, Homo sapiens
  misc_feature: GYAE6OF01D5AX2.45.78.H01.1.454.CMB.1.raw
  modified_base (419)..(419): a, c, t, g, unknown or other
  misc_feature (419)..(419): n is a, c, g, or t
  modified_base (519)..(519): a, c, t, g, unknown or other
  misc_feature (519)..(519): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtaactggttggcctggtatcagcagaaaccagggaaagcccctaagctcctgctctataggcatctagttagaagtgggtccatacaaggttcagcgcagtggatcgtgggacagaattcactctcactatcagcagcctgcacgcctgattgtattttgactaatttacttactgaccaanagtatagtatagttattcgtacgttcggaccaagggaccgtaaggtacggaaataccgaaacgtacgtggtacgcgtagacctactattctcgttccttntaccg

SEQ ID NO: 128836 - DNA, 556 bp, Homo sapiens
  misc_feature: GYAE6OF01CYJ9K.45.78.H01.1.454.CMB.1.raw
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtaactggttggcctggtatcagcaagaaaccagggaaacgccctaagcctctgctctataagcatctagttagaaagtgggtccatcaaggttcagcggcaggtggatcgtggacagtaatcactctacaccatcagcagcctgcagcctagatgtatttgactaacttattactcgacctaactagtatagtaattacgttagttacgtacgtttccggaccgaaacgggaccgtaaagggtacggtaaactaccgaaaacggtacgttagggtcggtaccgtacgcctaacccgtattcttcgttccgttctaaccg

SEQ ID NO: 128837 - DNA, 525 bp, Homo sapiens
  misc_feature: GYAE6OF01EV3F9.45.78.H01.1.454.CMB.1.raw
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtaactggttggcctggtatcagcagaaaccagggaaagcccctaagctcctgctctataaggcatctagtttagaagtgggtccatcaaggttcagcggcagtggatcgtggacagattcactctcaccatcagcagcctgcagcctgatgtattttgctaacttattactgaccaacagtatagtattagtttattcgtacgttacggaccaaagggaccaaggtaggaaattaccgaaaacgtaacgtggtcggacgtagacctacctatactcgttcttcgtacc

SEQ ID NO: 128838 - DNA, 174 bp, Homo sapiens
  misc_feature: GYAE6OF01DM4RB.45.78.H01.1.454.CMB.1.raw
  modified_base (173)..(174): a, c, t, g, unknown or other
  misc_feature (173)..(174): n is a, c, g, or t
tcagacgcgatcgacacgaccggtgctcgatttagtgtgagtagtttgggtttgggggaagaggaagactgacggtcccccaggagttcaggtgctgggcacagcggccctgggctgcctggtcaaggactacttcctactgctagtctgagcgggctggcaaggcgcatagnn

SEQ ID NO: 128839 - DNA, 686 bp, Homo sapiens
  misc_feature: GYAE6OF01BLVOS.45.78.H01.1.454.CMB.1.raw
  modified_base (455)..(455): a, c, t, g, unknown or other
  misc_feature (455)..(455): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactagtgcgagaggcaggaattacgtagttttggagttggttattcggacggttagtggacgtcgtggggccgaacgggacgacggtcaccgtctcctcacgtcctccaaccgaacgggcccacgttccggtaccctttcccccgnggtaccctacccccgtccctacccgaacgacgcccaacccgttccgggtacgggggtaccccaacgtaccgggtccccgggaccccgttcggggacccgttccggtcccgttacggggttacccgaaacgggttaccccgttaccggtttacccccggtaccggttaaccgttcccgggtaccggttacccgttagggtaacccgggtccgggggtacccgttaccggggg

SEQ ID NO: 128840 - DNA, 578 bp, Homo sapiens
  misc_feature: GYAE6OF01AMP0Y.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgattttggagtggttattcggacggtatggacgtcgtggggccgaagggaccacgggtcaccgtctccgtcacgcctccaccgaacgggcccacgtccgggtcccttcccccgtcggcccacccctcctcccaacgacgccacccgtcgtgggggccacgacgccggccctgggcctcgcccgtgggtccgaacgggacctacccgttcctcgacgttccgcgttctggacggccgggcgtcgggg

SEQ ID NO: 128841 - DNA, 604 bp, Homo sapiens
  misc_feature: GYAE6OF01AEJRR.45.78.H01.1.454.CMB.1.raw
  modified_base (355)..(355): a, c, t, g, unknown or other
  misc_feature (355)..(355): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtctggggctgaggtgaagaagcctggggcctcaggtgaaggtctcctgcaaggtcttctggatacaccttcaccggctactatatacacgtgggtgccgacgacggcccctggaccgaaggggtcttggagtgggatggggtatggataccaaccctaanagtggtggacaacaaactatcggtacactaagtaacgtttcgaggggcgaggggtccaccgagtacgaccgaggggacaccggtcgaatacgaacgaccaacgacgacctacgagtggacgcgtagagcgagggtcgtggacgtacgtacgtacggacgaccgtaccggtccgttaggttactttacgtacggttcgacggaaggacgggtacgtaagggtaatttacggtaagtttttcgggtaaggg

SEQ ID NO: 128842 - DNA, 549 bp, Homo sapiens
  misc_feature: GYAE6OF01CJVJW.45.78.H01.1.454.CMB.1.raw
  modified_base (407)..(407): a, c, t, g, unknown or other
  misc_feature (407)..(407): n is a, c, g, or t
  modified_base (412)..(412): a, c, t, g, unknown or other
  misc_feature (412)..(412): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtcctccttccaccctgtctgcatctgtaggagacagagtcaccatcacttggccggcagtcagagtattagtactggttggcctggtatcagacaagaaaccagggaaacgcccctaagctcctgctactataagcatctagttagaaaggtgggtaccagtcgaagtcaggcgcagtggatcgtggacagtaatcactctcacatcagcagcctgacagctgatgttatttgactaattnttacnacctaatgtatagtattaagttattcggtacgttcgggacgtaaacgggaccgtaaagggtacgaaaattacgaaaacggtaagttggtacggacttaggaccctaaccgtattaccggttactccgtttctacccg

SEQ ID NO: 128843 - DNA, 502 bp, Homo sapiens
  misc_feature: GYAE6OF01ENBC7.45.78.H01.1.454.CMB.1.raw
  modified_base (417)..(417): a, c, t, g, unknown or other
  misc_feature (417)..(417): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtaactggttgcctggtatcagcagaaaccaggaaagcccctaagctcctgctctataaggcatctagtttagaaagtgggtccatcaagttcagcggcagtggatcgtgggacagaattcactctcaccatcagcagcctgcagcctgatgtattttgactaactttattactgaccaanagtatagatagttattcgacgttcggacgaaggaccaaggtagaaatacgaaacgtaataggtggctgcaccatctcgtctctac

SEQ ID NO: 128844 - DNA, 593 bp, Homo sapiens
  misc_feature: GYAE6OF01AE0A4.45.78.H01.1.454.CMB.1.raw
  modified_base (500)..(500): a, c, t, g, unknown or other
  misc_feature (500)..(500): n is a, c, g, or t
tcagacgcgatcgacacgaccggtgctcgattagtgtgagtagtttgggttgggtggaagaagcctgggccgtcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgaggctcgagatctgacgacacggcgtgtatactgtgcgagaggcgaggattacgattttggagtggtattcggacggtatggacgtcgtggggtccaagggaccacggtcaccgtctcctcacgcctccaccgaacgggcccagtcggtccttcccccgcgccacccctcctcccaagtcgccaccctgtcgggggcaccgtagcccggtcccgtgggtccgngcccgtgggtacccgaacgggtacccttacctttcccggtaccgtaacttcccggtaccggttccgtagggacgggtccggggtcgtacgggg

SEQ ID NO: 128845 - DNA, 611 bp, Homo sapiens
  misc_feature: GYAE6OF01DIRRS.45.78.H01.1.454.CMB.1.raw
  modified_base (287)..(287): a, c, t, g, unknown or other
  misc_feature (287)..(287): n is a, c, g, or t
  modified_base (604)..(604): a, c, t, g, unknown or other
  misc_feature (604)..(604): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaaactatgcacagaagtttcagggcagggtcaccatgaccagggacacgtccatcagcacagcctacatggagctgagcagctgagntctgacgacacggccgtgtattactgtgcgagaggcagggaattacgatttttggaggttggttattcggtacggtagtggtacgtcgtggggtccaaagggaccacgggtcaaccgtctccctcacgcctcccaccgaacgggcccacgtccggtcctttcccccccgtgggccctaccccctcctacccaacgtacgcctaccgtacgtcgggggccctacgacggaccgggccccgtggggaccctcggcccgtgggtaccgaacgggtacctaccgtttccaccgtagtccgccgttactggtacggccgggntacgggg

SEQ ID NO: 128846 - DNA, 615 bp, Homo sapiens
  misc_feature: GYAE6OF01D2JHO.45.78.H01.1.454.CMB.1.raw
  modified_base (281)..(281): a, c, t, g, unknown or other
  misc_feature (281)..(281): n is a, c, g, or t
  modified_base (298)..(298): a, c, t, g, unknown or other
  misc_feature (298)..(298): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaaccctaacaatggtggcaacaaactatgcacagaagttcaggcaggtcacatgaccaggacacgtccatcagcacacgccacagtggagctgagcaggcngagatctacgacgaacncggccgtggtaacttacgtgtggccgaagaggtcgaaggtattagtaagttttggagttaggttacgttcgggtaggtagtacggtacgtaccggtgggaccgtaacgggaccgtaccgggtactcccggtccttccgacgtacgtcccctacgaaccgaacgggcccctaagtcccggtccttccccgtacggccctaccctacccgtacaacgaccgccaaccgtccggtacgggtcccaacgtccgggaccgccgtggccttcgacgcgtacgagtcctaccgtcacgtcgcgtcgtcgtgccgtggctacggg

SEQ ID NO: 128847 - DNA, 547 bp, Homo sapiens
  misc_feature: GYAE6OF01EKBNZ.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaaactatgcacagaagtttcagggcagggtcaccatgaccagggacacgtccatcagcacagcctacatggagctgagcaggctgagatctgacgacacggccgtgtattactgtgcgagaggcaggaattacgattttggagtggttattcggacggtagtggacgtcgtggggccaagggaccacgggtcaccgtctcctcacgcctccaccaacgggcccactcggtccttccccctcggccaccctcctccaacgacgcacctcgtcgggggccacgcgccggcccgtggctcgcctggtcgacggtctacgttcctcgatcgtcgtcgtgcgcggcgtcggg

SEQ ID NO: 128848 - DNA, 522 bp, Homo sapiens
  misc_feature: GYAE6OF01EMSCW.45.78.H01.1.454.CMB.1.raw
  modified_base (445)..(445): a, c, t, g, unknown or other
  misc_feature (445)..(445): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacgaggcccctggacaagggcttggagtggagtgggatggatcaacctaacaatggtggacacgaaactatgcacagaagtttcgagggcagggtcacatgaccagggacacggtccatcagcacagcctacatggagcgtgagcgaggctggagntcgtgacgacgaccgggccgtgtacttacgtggtcgcggagacggcgaaggtaagttacgttagttttgggtaaggg

SEQ ID NO: 128849 - DNA, 573 bp, Homo sapiens
  misc_feature: GYAE6OF01BT15I.45.78.H01.1.454.CMB.1.raw
  modified_base (441)..(441): a, c, t, g, unknown or other
  misc_feature (441)..(441): n is a, c, g, or t
  modified_base (447)..(447): a, c, t, g, unknown or other
  misc_feature (447)..(447): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccaggacacgtccatcagcacagcctacatggagctgagcaggctgagatctgacgacacggccgtgtattactgtgcgagaggcaggaattacgatttttggagtggttattcgggacgttatgggacgtcgtggggccaagggaccacgggtcaccgtctcctcagtccctcaccaagggccccatccggtccttcccccgnggcccncccctcctaccaagacgccaccgtcgtcgggggcaccgacggccggacccgtgggcctgcccgtagggtaccgaacggtacttaccgttcccgcgactcggtccgtgtcgacgcggggctacgggg

SEQ ID NO: 128850 - DNA, 548 bp, Homo sapiens
  misc_feature: GYAE6OF01CT70Q.45.78.H01.1.454.CMB.1.raw
  modified_base (272)..(272): a, c, t, g, unknown or other
  misc_feature (272)..(272): n is a, c, g, or t
  modified_base (290)..(290): a, c, t, g, unknown or other
  misc_feature (290)..(290): n is a, c, g, or t
  modified_base (489)..(489): a, c, t, g, unknown or other
  misc_feature (489)..(489): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatgganctgagcaggctgagatcngacgacacggccgtgtattactgtgcgagaggcaggatttacgtattttggagttggttattcgggacggtatggacgttcgtggggaccaagggaccacggtcaccgtactccgcacgcctcaccgacgggccccagtccgtccttccccgcggccctacccgtctacccaacgacgccaccgtcgtcggggcaccgngccgccgtggctcgctcggcgaacgtcactcctcgactcgtcgtctgacgcggcgtcgg

SEQ ID NO: 128851 - DNA, 866 bp, Homo sapiens
  misc_feature: GYAE6OF01ERZYJ.45.78.H01.1.454.CMB.1.raw
  modified_base (296)..(296): a, c, t, g, unknown or other
  misc_feature (296)..(296): n is a, c, g, or t
tcagacgcgatcgacacgaccggtgctcgatttagtgtgagtagtttggtttgggtgagagcctgggcctcagtgaaggtctcctgcaaggcttctggatacaccttcaccggctactatatacactgggtgcgacaggcccctggacaagggcttgagtggatggggatggatcaaccctacaatggtggcacaaactatgcacaagaagtttcagggcagggtcaccatgaccagggacacgtccatcagcacagcctacactgagcgtgaggcaggctgacgtacgtccgtancccggacgtaccggtccgttagtattaccgtggtgacggaaggagggtacgtaacgggttaatttacggtaagttttttggggaggtttacggggtttaacgttaccggggtaacgggttacgttacggggtaccgggttccgggtacggggggtacccgaaacgggggtacccgtaacccgggttccgaacccgtttccccgtacccgttaccgtaacccggtacccccgttaaccccggaaaccccggtaaaccggggtccccgttaacggttccccggggttcccgtttacccgggacccccccgttacccgggtacccccttaacccccgttaccccgtaaccccggaacggtacccggtacccgtacccgggttaccgggtaccggggggacccaaccgggtacccgggtccccgggtacccggttccggggtccgttccgggtacccggttacgggtaacccgtaaaccggggttacccttcccggtttacccgtaccggtacccgttcccggggttacccggttacgggtacggggtaccggggtcccggggttaacccgggg

SEQ ID NO: 128852 - DNA, 763 bp, Homo sapiens
  misc_feature: GYAE6OF01DX2TX.45.78.H01.1.454.CMB.1.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctcgagtgaaggtctccgtgcgaaggtcttcgtggactaccgaccttcaccggtctaactatactacacgtgggtcgcgacgacggcccctgggacgaaggggtcttaggaggtgggtagtggggatagggactaccgaaaccctaaacgaagttcgggtaggaccaaacgtaaaactagtacgactaacgaaggttaaacggtttcggaacggggtacgaacggggttaccaaccgtaagttaaccggaaccccgtaacgggggtaaaccccgtaaaccggttacccgaaacgttaccgaacggtacccgtaaaccgacccggtaacccgttaacgtacgtaacggggtaccgtacgtaacggacgaccggacgggtacgtaaggtacgtacgtacggaccggtaaccggtaaccggaccgggttaccgtacggtttaacgttaccggttagggtacggtacgggtaaacggtacggtaacgggtaaacgggtttaaacgggtttacgggttttaaacggttttggggtaacgggg

SEQ ID NO: 128853 - DNA, 569 bp, Homo sapiens
  misc_feature: GYAE6OF01DJNH4.45.78.H01.1.454.CMB.1.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggcttggagtggagtgggatgggatccgaaaccctaacaacgtggtaggacaacaaaacttagtgacacgagtaagtttcgagggtacaggggtcaaccatacgaccgagggaacacgtaccatccagaccaacacgacctacagtacggagtcgtaggacgacgaggtcgtgaagatcgtacgacgaccgacggtccgtagttaacttacgtggtcgacggaggacggtacaaggtaatttacggtagttttgggtaacggg

SEQ ID NO: 128854 - DNA, 532 bp, Homo sapiens
  misc_feature: GYAE6OF01DMSFM.45.78.H01.1.454.CMB.1.raw
  modified_base (307)..(307): a, c, t, g, unknown or other
  misc_feature (307)..(307): n is a, c, g, or t
  modified_base (337)..(337): a, c, t, g, unknown or other
  misc_feature (337)..(337): n is a, c, g, or t
  modified_base (347)..(347): a, c, t, g, unknown or other
  misc_feature (347)..(347): n is a, c, g, or t
  modified_base (404)..(404): a, c, t, g, unknown or other
  misc_feature (404)..(404): n is a, c, g, or t
  modified_base (410)..(410): a, c, t, g, unknown or other
  misc_feature (410)..(410): n is a, c, g, or t
  modified_base (432)..(432): a, c, t, g, unknown or other
  misc_feature (432)..(432): n is a, c, g, or t
tcagacgcgatcgacacgaccggtgctcgatttagtgtgagtagtttgggtttggggacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagcctggggcctcagtgaaggtctcctgcaaggcttctggatacacctttcaccggctactatatacactgggtgcgacaggcccctggacaagggcttagngtggatgggatggatcaacctaacagtggngcacaaactngcacgagagttcagggcaggtcacagtgacgaggacacgtcatcagcacacgcctanagtgancgtgagcgaggctagagatcgngacgacgacggtcgtagtactacgtgtacgcggagtacggcgtaaggtaacgtttacggttaggtttttaggggtaggttttacgtcgggtaggttacgg

SEQ ID NO: 128855 - DNA, 577 bp, Homo sapiens
  misc_feature: GYAE6OF01DSK1N.45.78.H01.1.454.CMB.1.raw
  modified_base (559)..(559): a, c, t, g, unknown or other
  misc_feature (559)..(559): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaaactatgcacagaagtttcagggcagggtcaccatgaccagggacacgtccatcagcacagcctacatggagctgagcaggctgagatctgacgacacggccgtgtattactgtgcgagaggacaggaattacgtatttttggagtaggttattcgggacggtagtggacgtcgtggggccgaagggaccacggtcaccgtctcctcacgcctcccaccgaacgggcccacgtccggtccttcccccgtggccaccctccaccactacgccaccgtcgtcggggccacgagcccggccgtgggcctcggcctggtaccgaacggtacccttacttcccgtaccgagtcggtccgttcnggacgcgggtcgtacggg

SEQ ID NO: 128856 - DNA, 619 bp, Homo sapiens
  misc_feature: GYAE6OF01CGAI0.45.78.H01.1.454.CMB.1.raw
  modified_base (295)..(295): a, c, t, g, unknown or other
  misc_feature (295)..(295): n is a, c, g, or t
tcagacgcgatcgacacgaccggtgctcgatttagtgtgagtagtttgggtttgggggagagcatcacccagcaaccacatctgtcctctagagaatcccctgagagctccgttcctcaccatggactggacctggaggatcctcttcttggtggcagcagccacaggagcccactcccaggtgcagcgtggtgcagtcgtggggctgaggtgaaagagcgtggggcctgagtgaaggtctcctgcaaggcttcgtggatacaccttcgaccggctactatatacacgtgggtcncgacacggccccgtggaacgaagggtcttaggagtggagtgggatggataccaaacctaacaagtgggtacggacaacaaaactatacgacacgaagtaacgtttcgaagggtcgaagggtcacagtacgaaccgagggacaacgtcatcagcacgacacctagagtgggacgcgtagacggacgtacggcttaggaacgtagtaccgtaggaaccggaccgtaccgggaccggttacggttaacgtttacggttcggtacggtacggtaagggacggtaccgtaaagggtaaacgtttacgggtttaggtttttaaacggggg

SEQ ID NO: 128857 - DNA, 539 bp, Homo sapiens
  misc_feature: GYAE6OF01AS7VI.45.78.H01.1.454.CMB.1.raw
  modified_base (485)..(485): a, c, t, g, unknown or other
  misc_feature (485)..(485): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggcttgagtggatgggatggatcaacctaacatggtggacaacaaactatgacacagtaagtttcgagggcaggggtcaccgatcgacgagggacacgtcatcacgcaacacgcctacgatggagctagacgcagggctgagatacgtaggaccgacgaccggccgttagtacgttacnggttcgacgtaaggacggtcgaagggtaacttaacggttggttttgggtaaggg

SEQ ID NO: 128858 - DNA, 565 bp, Homo sapiens
  misc_feature: GYAE6OF01EKRQF.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgattttggagtggttattcggacggtatggacgtcgtggggccaagggaccacggtcaccgtctcctcagcctccaccaacgggcccatccggtccttcccccgtgccaccctcctccaagacgcacctcgtcgggggcacgacgccggcccgtgggcctcgcccgtgggtaccgaacgggtaccttacgttccctcgacttccggtccgttctaggacggtcgggcgtcggg

SEQ ID NO: 128859 - DNA, 577 bp, Homo sapiens
  misc_feature: GYAE6OF01AFE43.45.78.H01.1.454.CMB.1.raw
tcagacgcgatcgacacgaccggtgctcgatttagtgtgagtagtttgggtttggggacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctcctgcaaggcttctggataccaccttcaccggctactatatacactgggtgcgacaggcccctggacgaagggcttgagtggagtgggatggatcaaaccctaacaatggtgcaacaaactatgcacagtaacgtttcgagggcgaggtcaccagtcgacgaggacacgtcatcagcacgacgcctacagtggagcgtgagacgagggtctaggagtacgtcgtagaccgaaccgaccgggtccgttagtactttacgtaggtcggacggtaggacggcgtaagggttaacgtttacggttaggtttttagggaaggtttcgggtttagttcggggttaaacgggg

SEQ ID NO: 128860 - DNA, 597 bp, Homo sapiens
  misc_feature: GYAE6OF01C6BXG.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacacccccttcaccggctactatatacactgggtgcgacaggcccctggacaagggcttgagtggatgggatggatcaaccctaacaatggtggcacaaactatgcacagaagttcagggcagggtcaccatgacagggacacgtccatcagcacagcctacatgagctgagcaggctgagatctgacgacacggccgtgtattactgtgcgagaggcaggaattacgtagttttggagttggttagttcggacgtatggtacgtcgtcggggaccaagggaccacggtacaccgtctcctcacgcctcccgaccaacggccctagtccgtcctaccccgtcgccacccctcctaccaacgacaccgacctccgcggggtaccacgacgccgccgtcgggccgtcgccgtcggtaccgaaggtaccttaccgttcccgtaccggtacgttccggtccggttaccgtagggacggtccgggtccgtaccgggg

SEQ ID NO: 128861 - DNA, 556 bp, Homo sapiens
  misc_feature: GYAE6OF01B3WY2.45.78.H01.1.454.CMB.1.raw
  modified_base (287)..(287): a, c, t, g, unknown or other
  misc_feature (287)..(287): n is a, c, g, or t
  modified_base (318)..(318): a, c, t, g, unknown or other
  misc_feature (318)..(318): n is a, c, g, or t
  modified_base (362)..(362): a, c, t, g, unknown or other
  misc_feature (362)..(362): n is a, c, g, or t
  modified_base (450)..(450): a, c, t, g, unknown or other
  misc_feature (450)..(450): n is a, c, g, or t
  modified_base (484)..(484): a, c, t, g, unknown or other
  misc_feature (484)..(484): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgagctgagntctgacgacacggccgtgtatctgtgcgagngcagatacgtatttggagtggtagttcggagtatcggacgtcgngggacaagggacacggtcaccgtctacctcgacgtcctacccacgacggccacgtccgtccttccccgtgcctacctccgacaacgcncctaccgtcggtcgggaccacgacgccggaccgngggcctcggcccgtggtacgacggtacctccttcccgacgtacgtccgacggttcaggcggcgggtcgtcgg

SEQ ID NO: 128862 - DNA, 506 bp, Homo sapiens
  misc_feature: GYAE6OF01BNXNO.45.78.H01.1.454.CMB.1.raw
  modified_base (273)..(273): a, c, t, g, unknown or other
  misc_feature (273)..(273): n is a, c, g, or t
  modified_base (422)..(422): a, c, t, g, unknown or other
  misc_feature (422)..(422): n is a, c, g, or t
  modified_base (429)..(429): a, c, t, g, unknown or other
  misc_feature (429)..(429): n is a, c, g, or t
  modified_base (497)..(497): a, c, t, g, unknown or other
  misc_feature (497)..(497): n is a, c, g, or t
tcagacgcgatcgacacgaccggtgctcgatttagtgtgagtagtttgggtttggggggagagcatcacccagcaaccacatctgtcctctagagaatcccctgagagctccgttcctcaccatggactggacctggaggatcctcttcttggtggcagcagccacaggagcccactcccaggtgcagctggtgcagtctgggggctgaggtgaagaagcctggggcctcagtgaaggtctcctgcaaggcttctggatacaccttcaccggntactatatacactgggtgcgacaggcccctggacaagggcttgagtggatgggatggatcaacctaacaatggtggcaacaaaactatagcaacagaagtttcagggcagggtcaccatgacaggacacgtccatcagcacagccctanactgganctgacgcgaggctagagatctagacgacgacggccgtgtatactgcgagagacggacaggaattaggnttttacggg

SEQ ID NO: 128863 - DNA, 563 bp, Homo sapiens
  misc_feature: GYAE6OF01DET4P.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcagctgagatctgacgacacggccgtgtattactgtgcgagaggcaaggtaattacgtagttttggagttggttattcgggacggtagtggacgtcgtggggaccgaagggaccacggtcaccgtctcctcgacgcctccaaccgaacggcccatccggtcctcccccgtcgccaccctcctccaacgacgccgacctcgtacggggccacgcgccggccgtcgggctcgccgtggtcgaacgtactacgttcctcgactcgtacgtctggacgcgggcgtacggg

SEQ ID NO: 128864 - DNA, 650 bp, Homo sapiens
  misc_feature: GYAE6OF01A1GHY.45.78.H01.1.454.CMB.1.raw
  modified_base (336)..(336): a, c, t, g, unknown or other
  misc_feature (336)..(336): n is a, c, g, or t
  modified_base (354)..(354): a, c, t, g, unknown or other
  misc_feature (354)..(354): n is a, c, g, or t
tcagacgcgatcgacacgaccggtgctcgatttagtgtgagtagtttgggtttggggacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctcgagtgaaggtctcctgcaaggcttcgtggatacaccttcaccggctactatatacactgggtgcgacagcccctggacaagggcttgagtggagtgggatggatcaaccctaanaagtggtgacacaaactntcgcacagtaagttcgagggcagggtcacgatacgaccgaagggaccacgtaccagtacacggcaacgacgaccctacgagtacggacgtacgtacggagccggaacggtcgtacggaacggtacgttacgtacgggtaaccggacggtaaccgggcccgtttaaggtaaccgtttaacggtcggtacgggtacgggtaaggacgggtacggtaaacgggttaaagtttaaccgggttaaggttttttacggggaaggttttacggggtttaacgtttacgggggttaaaccgggg

SEQ ID NO: 128865 - DNA, 553 bp, Homo sapiens
  misc_feature: GYAE6OF01AGRFY.45.78.H01.1.454.CMB.1.raw
  modified_base (253)..(253): a, c, t, g, unknown or other
  misc_feature (253)..(253): n is a, c, g, or t
  modified_base (344)..(344): a, c, t, g, unknown or other
  misc_feature (344)..(344): n is a, c, g, or t
  modified_base (369)..(369): a, c, t, g, unknown or other
  misc_feature (369)..(369): n is a, c, g, or t
  modified_base (452)..(452): a, c, t, g, unknown or other
  misc_feature (452)..(452): n is a, c, g, or t
  modified_base (462)..(462): a, c, t, g, unknown or other
  misc_feature (462)..(462): n is a, c, g, or t
  modified_base (521)..(521): a, c, t, g, unknown or other
  misc_feature (521)..(521): n is a, c, g, or t
tcagacgcgatcgacacgaccggtgctcgatttagtgtgagtagtttgggtttgggggagagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttcnggatacaccttcaccggctactatatacactgggtgcgacacggcccctggacgaagggcttgagtggagtgggatggatacaaccctaanaatgggtgacaacaaactatgcaanaggtaagtttcgagggacagggtccaccgatacggaacccgagggaaccacgtccaatacagacacacgacctacagtggganctagacgcgnggcgtgaaggactcgtacgacgacgtaccggacgtggtattaccgtgacggtacgaggnggaactagggtaacgttcgttaggttttaggg

SEQ ID NO: 128866 - DNA, 548 bp, Homo sapiens
  misc_feature: GYAE6OF01C24HM.45.78.H01.1.454.CMB.1.raw
  modified_base (271)..(271): a, c, t, g, unknown or other
  misc_feature (271)..(271): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccagggtgccaaatgtgacatccagatgacccagtctccttccacctgtctgcatctgtaggagacagagtcaccatcacttgccggcagtcagagtattagtactggttggcctggtatcagcagaaacaggaaacnccctaagctctgctcatagcatctagttagaagtgggtaccatcgaagttcagcggcaggtgatcgtaggacagaattcactctacacatcagcacgcctagcagcctgattgtatttcgactaacttattactcgtacctaaacgtagttaactagtaatttaaggtttacttacgggtaccgtttaccgggaccgaaaggggtaaccctaaagggtacggaaatacgaaaacgtagtaggtagccgtgacctaacctatctacgttcttcgtacc

SEQ ID NO: 128867 - DNA, 532 bp, Homo sapiens
  misc_feature: GYAE6OF01AVN85.45.78.H01.1.454.CMB.1.raw
  modified_base (457)..(457): a, c, t, g, unknown or other
  misc_feature (457)..(457): n is a, c, g, or t
  modified_base (467)..(467): a, c, t, g, unknown or other
  misc_feature (467)..(467): n is a, c, g, or t
  modified_base (509)..(509): a, c, t, g, unknown or other
  misc_feature (509)..(509): n is a, c, g, or t
  modified_base (527)..(527): a, c, t, g, unknown or other
  misc_feature (527)..(527): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatcgtagacgacacggccgtgtacttactgtgcgagaggacaggaattacgtagttttggagtggttattcggacggtatggacgtcgtggggaccaagggaccacggtcaccgtctcctcacgcctccaccgacggcccagtccgtctccccgtgccaccctcctcacgngccacgtcgngggcacgagcggcctggctcgccgtgcgaacggcctactccncgatcgcgtcagcgcggngtcgg

SEQ ID NO: 128868 - DNA, 575 bp, Homo sapiens
  misc_feature: GYAE6OF01DYBXN.45.78.H01.1.454.CMB.1.raw
  modified_base (136)..(136): a, c, t, g, unknown or other
  misc_feature (136)..(136): n is a, c, g, or t
  modified_base (184)..(184): a, c, t, g, unknown or other
  misc_feature (184)..(184): n is a, c, g, or t
  modified_base (245)..(245): a, c, t, g, unknown or other
  misc_feature (245)..(245): n is a, c, g, or t
  modified_base (447)..(447): a, c, t, g, unknown or other
  misc_feature (447)..(447): n is a, c, g, or t
tcagacgcgatcgacacgaccggtgctcgatttagtgtgagtagtttgggtttggggacccagcaaccacatctgtcctctagagaatcccctgagagctccgttcctcaccatggactggacctggaggatcctnttcttggtggcagcagccacaggagcccactcccaggtgcagctggtncagtctggggctgaggtgaagaagcctggggcctcgagtgaaggtctcctgcaaggcttcnggatacaccttcaccggctactatactacacgtggtgcgacaggccctggacaagggcttgagtggatggatggatacaacctaacaactggtagcaacaaactatagacacaacggtaagtttcgagggacgtagggtacaccgtagttacgaaccgagggaaccacgtaccacgtacagtaccaacgacgaccctaacgngtacggagcgtacgagccgaggctaggagactcgacgacgaccgacggtcgtacgttagtacgtgttggacgtaggaggtcgaaggtattacggttagtttcgggattagggtttatgggttaacggg

SEQ ID NO: 128869 - DNA, 813 bp, Homo sapiens
  misc_feature: GYAE6OF01D3YO6.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatacaaccctaacaatggtgcacaaactatgacacagtaagtttcgagggtcagggtcaaccatcgaccgagggacacgtccatcagcacagacctaacagtggagctagacgacgaggctaggagtatcgtaggaaccgaccgaccgggtccgttagttaacttacgtggtacggacgtaaggacggacgtaaggtaacgttaacggttaggtttttagggaggtttaggttaacggtttacggggtacgggttaacggttacgggtacggtttaccgggtacgggggtaaaccggtaacggggtacccgtaaccgggttacccgtaacccggttccctacccgttaccggtaaccccggtaccccgttaccccgaaacccggtaacccggggtccccttaacccggttccccgggttacccccgtttcccccgtaccgggtaccccccttaaccccgttaccccgtaaccggaaacgtccgaacccgtacccggttcggggacccggggtaccacccggtaccggtccccggtcccggtagggccctcggtcccgtacggtaaccgtaaccggtaccttacccgttcccgacgtaccgttaccgtccgtaacgtgggtaccgtgggccgtacggg

SEQ ID NO: 128870 - DNA, 697 bp, Homo sapiens
  misc_feature: GYAE6OF01DVM4P.45.78.H01.1.454.CMB.1.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagcgtggtgcagtcgtggggctggaggtgaagaagccgtggggcctcagtgaaggtctcctgcaaggtcttcgtggactacctaccttcgaccggtctactatactacacgtgggtgcgacgacggccccgtaggacgaagggtcttaggagtggagtgggagtacggactaccgaaacctaaacgaacgtgggtacggacaacgtaaactagtacgacaactaaggttaacgtttcgaacgggacgtacggggtaccaaccgtagtaccggaaccggaagggtaccctaaccggtaccaacgtaccgaacgaccgaaccgtaaccgacctaacgagtacgggagtcgtaggacgaccggaagggcgtaacggacgtacgtaccgtaacgggaaccggaccgaacccgggtccggttaggtttaccgttaccggtaggtcggaaccggaagggtaacgggtaacggttaaaggtttaaccggtttacggtttaaggtttttggggttaacgggg

SEQ ID NO: 128871 - DNA, 718 bp, Homo sapiens
  misc_feature: GYAE6OF01CI8T2.45.78.H01.1.454.CMB.1.raw
  modified_base (287)..(287): a, c, t, g, unknown or other
  misc_feature (287)..(287): n is a, c, g, or t
tcagacgcgatcgacacgaccggtgctcgattagtgtgagtagtttgggtttggggtgaagaagcctggggcctcagtgaaggtctcctgcaaggcttctggatacacccttcaccggctactatatacactgggtgcgacaggcccctggacaagggcttgagtggatgggatggatcaaccctaacaatggtggcacaaactatgcacagaagtttcagggcagggtcacatgaccaggacacgtccatcagcacacgcctacatggagctgagcgagcgtgagntcgtagacgacgacggtccgtgtattactgtgacgagaggacgaaggtagttacgttagttttgggagttggttagtacgggtacggtagtcggtacgttcggtacgggaccgaacgggaccctacgggtaccgtaccgttccgtcccgtaccgtacgtaccctaccccgaaccgaaccggtacccgacgttcccggttcccttacccccgtcggtcccctaccccgtcctaccgaacgccgtacctacccggtcgggtaccggggactacccggacggccccgggtacccgtacggggtccgtccggttacccggtacgggaacccggttaaccggtacccgttttaacccgttccccggtaccggtaaccgttccccgggtaccgttaccggttacgggaccggggtcccgggtaccgtaacccggggg

SEQ ID NO: 128872 - DNA, 585 bp, Homo sapiens
  misc_feature: GYAE6OF01C9RNS.45.78.H01.1.454.CMB.1.raw
  modified_base (275)..(275): a, c, t, g, unknown or other
  misc_feature (275)..(275): n is a, c, g, or t
  modified_base (529)..(529): a, c, t, g, unknown or other
  misc_feature (529)..(529): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccggccagtcagagtattagtaacgtggttgcctggtatcagcaagaaaccaggaaacnccctaagctcctgctactagtaagctatcttaagttagaaaggtcgggtaccagtacgaaggttcaggcggtcaggtggattcgtagggaacagtaacttccactctacacatacagcacgcctgacacgtcctagattgtatttcgacttaacgtttattacctcaacctaagtagttataggttaagtttaacgttacgttaccggtaacgttaccggaaccggtaaaggaaccgtaagggtaaccgtaaanaaccgtaaacgtacgtggtcggactaccgactacttactacttcgtcttctacccg

SEQ ID NO: 128873 - DNA, 705 bp, Homo sapiens
  misc_feature: GYAE6OF01AOZBR.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccagtcagcacagcctacatggagctgagcaggctgagatcgtgacgacgacggccgtgtattacgtgtgcgagaggcaggtaattacgtagttttgggagttggttagttcgggacggttgtggtacgtcgtggggaccgaagggaccgacggtccacccgttcctccgtacgacgccctacccgaacgaccgggtccctaggttcccgttcccttcccccgtcggacccctaccccgttcccgtaccgaaacgtccgtcccgtaacccgttccgggtacgggggaccctaaccggccgggtaccccggggtcccggtaccggggtaccgttccgggaccccggtttacgggtaaccggtaaaccgggtttcccttaacccgtttccccgttaaaccgtcgttaacccgtttcggttacggtaccggacggggtcccggggtcggtacccggggg

SEQ ID NO: 128874 - DNA, 660 bp, Homo sapiens
  misc_feature: GYAE6OF01DAA6S.45.78.H01.1.454.CMB.1.raw
  modified_base (256)..(256): a, c, t, g, unknown or other
  misc_feature (256)..(256): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctggaggtgaagacgccgtggggcctcgagtgaaggtctcgtgcaggcttcgnggatacaccttcaccgtctactatatacacgtgggtcgcggacacggccccgtaggacgaagggtcttggaggtggagtgggagtggactaccaaaccgtaagaagttgggtacgacaactaaactgtacgactacgtaagttaacggtttcgaaggggctagggtacctaaccgagtacggaaccgaacggggacctacgtaccaatccgacgtaccgaacaccgtaccctaacgaggtacggacgtacgtacggacggaccgaagggtcgtaggaacgtacgttaccgtacgaaccggtacccggaccgggttacccggtagtttaacgttacggttggtacggacggaggtaacgggacgtaacggttaagttttacgggttaggtttttgggtaaacggg

SEQ ID NO: 128875 - DNA, 662 bp, Homo sapiens
  misc_feature: GYAE6OF01A265W.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagtaagtttcaggcagggtcaccatgaccaggacacgtcatcagcacacgcctacagtggagctgagcgagcgtgagatcgtgacgacgaccggccgtgtattctgtgcgagaggcagtaatacgtagttttggagttggttacgtcggtacggtatcggtacgttcggtacgggaccgtaacgggaccgtacggtcgtaccgtcctccgtcaccgtccctacccgaaccgaacggacccgtacgtcccggttcccttccccgtccggccctaccccgttccgtacccaacggacgtaccctacccgtcgggtacggggacctaccgacggcccggtacccgtcgggtccgtccggcccgttacgggtaccgtaaaccggtacccttacccgttcccgtacggtacgtcccgtaccggttcgtaccgggacgggtcccgggtggtacccggg

SEQ ID NO: 128876 - DNA, 660 bp, Homo sapiens
  misc_feature: GYAE6OF01CBY7Q.45.78.H01.1.454.CMB.1.raw
tcagacgcgatcgacacgaccggtgctcgatttagtgtgagtagtttgggtttgggggagagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagagccgtgggcctcagtgaaggtctcctgcaaggtcttcgtggatacaccttcaccggctactatatacacgtgggtgcgacgacggccctggacgaggctggagtggagtgggataggactaccgaaaccctaacgaagtgggtaggacaaacgaaactatacgacaaacgtaaggtaaaggtttcgaaggggtaccgtaacgggttacccgaacccgtaagtaccggaacccggaacgggtaaccctaaccgggtaccctaacgtaccgaacgaccgaaccgacgtaccctaacgaagtacgggacgtcggtacgggacgtacgggtcgtaggacgtacgtcgtacggaaccgtaccggtaccggtaccgttagttacgttagtaggtcggacggaaggacggacgtaaggtaagtttaacggtttaggttttagggtaaggg

SEQ ID NO: 128877 - DNA, 525 bp, Homo sapiens
  misc_feature: GYAE6OF01EIQ1K.45.78.H01.1.454.CMB.1.raw
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaatgtgacatccagatgacccagtctccttccaccctgtctgcatctgtaggagacagagtcaccatcacttgccgggccagtcagagtattagtaactggttggcctggtatcagcagaaaccaggaaagcccctaagctcctgctctataaggcatctagtttagaaagtgggtccatcaaggttcagcgcagtgatctgggacagaattcactctcaccatcagcagcctgcagtcctgactggtattttacgctaaactttattactcgaccaactagttatgattagtttaactttcgacgtttcggacgtaagggaccaaggtaggaaaattcgaaaacgagttgtggctagcctaacctatacttcgttctctacg

SEQ ID NO: 128878 - DNA, 732 bp, Homo sapiens
  misc_feature: GYAE6OF01CV1Z3.45.78.H01.1.454.CMB.1.raw
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatcgacccagtcctcccttccaccctgtctgcatcgtggtaggagacgagagtccacactctacgttcggccggacagtacagtagtattagtacgtggttcggcctaggtactacgagacgaacggaaacgaacgggaaaccgaccctaagtcctccgtcgtacttacgtaagtaacgctattacgttaagtttaaggaacggttcgggtacctagtacgtaaggtcgacggcggacgtaggtcgacgtacggaggactaagtacttacaccgtactaccactacgtacacgacctacgtcctgaaccgcgtcgttagtactttaggttacttttagacctttaaactactttacgtaccgaactaacggtagtttaacgtacggttatttaacggtttaccggttaacggttaccgggtttaacccgggaaaccgggtaaacggggtaaccgtaaaacgggttaaacggtaaaccgtaaaccggtaaaaccgggttacgttacggggtaccgtacgtaccgtaaaccctaccgttacgtttaccgtttactttcccgttaaccgtttaccccg

SEQ ID NO: 128879 - DNA, 668 bp, Homo sapiens
  misc_feature: GYAE6OF01BZX52.45.78.H01.1.454.CMB.1.raw
  modified_base (311)..(311): a, c, t, g, unknown or other
  misc_feature (311)..(311): n is a, c, g, or t
  modified_base (315)..(315): a, c, t, g, unknown or other
  misc_feature (315)..(315): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcaggcaggtcacatgacaggacacgtccatcagcacagcctacactggagctgagcaggctgagatctgacgacacggcgtgtactactgtgngagngcagtatacgtagtttggagttggttagttcggtacggtagtggtacgtgtcgggaccgaagggaccgtacgggtcctaccggttcctccctacgaccgcccgtacccgaaccggaaccgggtcccctaagttccccggttccctttaccccccgtagggtccccctaccccgttacccctaccccgaaagcccgtccgtaaccccgttcggtccggggaccaacccggtaggccccgggtccccgttaggggcccttcggccccgttagggtaccctaaccgggtacctttaccccgttccgaccgtacgtcccggtccgttcggtcgggacggtccgggtcggtaccgggg

SEQ ID NO: 128880 - DNA, 769 bp, Homo sapiens
  misc_feature: GYAE6OF01BO1GE.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcaacaaactatgcacagaagtttcagggcagggtcaccatgaccgagggacacgtccatcagcacacgcctacagtggagctgagcgaggctgagatctagacgacgacggcgtgtacttacgtgtgcgagaggcgaggtaattacgtagttttggtagttggttagtacggacggttagtcggtacgttcggtacggggaccgtaaacggggaccgtacgggtcctacccggttcgtcccgtaccgtaccggaccccttacccgaacccggtaaccgggtaccccagttaccccgggttcccttacccccggtacggtaccccctaccccgtacccgttacccgaacgtaccgtacccgtaacccgttccgggtacccgggggtaccctaaccggaccggggtccccgggtaccccggtcggggtcccgttcccgggcccggtttacgggtacccggtaaaccggttacccgtttaaaccccgtttccccgggtacggttcccgttaccccgggttacggttaccccgttacgggggacccgggtccgggggtacccgggttaacccggggg

SEQ ID NO: 128881 - DNA, 639 bp, Homo sapiens
  misc_feature: GYAE6OF01ADBCH.45.78.H01.1.454.CMB.1.raw
  modified_base (261)..(261): a, c, t, g, unknown or other
  misc_feature (261)..(261): n is a, c, g, or t
tcagacgcgatcgacacgaccggtgctcgatttagtgtgagtagtttgggtttgggggagagcatcacccagcaaccacatctgtcctctagagaatcccctgagagctccgttcctcaccatggactggacctggaggatcctcttcttggtggcagcagccacaggagcccactcccaggtgcagcgtggtgcagtcgtggggctggaggtgaagagccgtggggcctcgagtgaggtcctccgtgacgaaggcttcgnggataccaccttcgaccggctactatactacacgtgggtcgcgacacggcccctggacgaagggcttggaggttggagtggggatgggactccgaaacccctaagaaggtcgggtacggacaaaccgtaaaactagtacgaccaaccgtaaggtaacggttttcggaacgggtacgacgggtaccaccgtagtcggaaccgagggacctaccgtaccatccgacgaccacgacgaccctaacgagtagggacgtcgtaggacggcggtacggacgttaggaacgtactcgtacggacgaccggacggtcgttagtacgttcgtggccggaggacgggtacggacgtaaggttaacgtttaggttaggttttaacgggg

SEQ ID NO: 128882 - DNA, 576 bp, Homo sapiens
  misc_feature: GYAE6OF01AW3R8.45.78.H01.1.454.CMB.1.raw
  modified_base (456)..(456): a, c, t, g, unknown or other
  misc_feature (456)..(456): n is a, c, g, or t
  modified_base (541)..(541): a, c, t, g, unknown or other
  misc_feature (541)..(541): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgatttttggagttggttattcggacggtagtggacgtcgtggggccaagggaccacggtcaccgtctcctcacgcctccaccgaacggcccagtccgtccttccccctcggcccacccctcccnccacgacgccacccgtcgtcggggccacgacggccggcccgtgggcctcggtccctgggtccgaacgggtaccttaccgttcccncgtactcggtcgtcgtggacggtcgggcgtcgggg

SEQ ID NO: 128883 - DNA, 523 bp, Homo sapiens
  misc_feature: GYAE6OF01EY12T.45.78.H01.1.454.CMB.1.raw
  modified_base (362)..(362): a, c, t, g, unknown or other
  misc_feature (362)..(362): n is a, c, g, or t
  modified_base (418)..(418): a, c, t, g, unknown or other
  misc_feature (418)..(418): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggcttggagtggatgggatggatccaacctaacaagtggtgacacaaactatgcanagtaagttcgagggcagggtcaccatgacgaggacacgtcatcagcacagcctacngtgagctagagcaggctgagatcgtgacgaccgaccggccgttaggtacttacgtggtggacgaggaggaccgaagggtaatttacggttagttttgggtaacgg

SEQ ID NO: 128884 - DNA, 544 bp, Homo sapiens
  misc_feature: GYAE6OF01B65H5.45.78.H01.1.454.CMB.1.raw
  modified_base (251)..(251): a, c, t, g, unknown or other
  misc_feature (251)..(251): n is a, c, g, or t
  modified_base (287)..(287): a, c, t, g, unknown or other
  misc_feature (287)..(287): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttcnggatacaccttcaccggctactatatacactgggtncgacaggccctggacaagggcttgagtgatgggatggatcaacctaacaatggtggcaacgaaactatgacacaagaagtttcgagggtacaggggtacacctaagtgaccaggggacacgtccagtcagcaacagcctacagtaggagcgtgagcgagtcgtagagtacgtcgtagacgacgacggtccgtagtacttaacgtggtcgacgtaggacggactaacgggtaatttacggtagttttcgggtaaaggg

SEQ ID NO: 128885 - DNA, 605 bp, Homo sapiens
  misc_feature: GYAE6OF01EB44Z.45.78.H01.1.454.CMB.1.raw
  modified_base (459)..(459): a, c, t, g, unknown or other
  misc_feature (459)..(459): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgagctgagatctgacgacacggccgtgtattactgtgcgagaggacaggaattacgtagttttgggagttggttattcggaacggtagtggacgtcgtggggacctaagggacctacgggtccaccggtcctccgtacacgccctcccaccgacggccctactccgggtcccttcccccgnggacccctaccctcctaccgaagcgcctaacccgtccggtggggccaaccgcggcccggacccgtcgggactcgcccgttggtaccgaacgggttaccttacttcccgtcgaacgtccgtccgtcgttaggcggcggtcgtacggg

SEQ ID NO: 128886 - DNA, 1100 bp, Homo sapiens
  misc_feature: GYAE6OF01DZKRN.45.78.H01.1.454.CMB.1.raw
  modified_base (230)..(230): a, c, t, g, unknown or other
  misc_feature (230)..(230): n is a, c, g, or t
tcagacgcgatcgacacgaccggtgctcgatttagtgtgagtagtttgggtttggggtgaagaagcctggggcctcagtgaaggtctcctgcaaggcttctgggatactaccttcgaccgtctactatatacacgtgggtgcgacacggccccgtggaacgaagggtcttgaggtggagtgggataggactaccaaaccctaaacaagttgggtacgacaaactaaactntcgacaacgaagtaacgttcgaggcgtacggtaccacctagtacgaaccggaacgggacctaccgtacctataccgaacgaccaacgaacggtaccccttaaacgtaaggttacgggaacgtaccgtttagggaaccggtacggaaccggtacgttaacggaacggttaacccgtttaccggtaccggaaaacccgggtaaccggtaaccccgggggttcccgtttaaggttttaaccgttttaccggtaggggtttacgggaaccgggaagggtaaccggggtaacccggttaaaaggggtttaaaccgtttttaaccggggttttaacggttttttagggggaacggttttttaacggggtttaaccgggttaccggggggtttaaacggttaacggggttaccggggttaacccgggtttaccgggggtaccgggggttaaaacccgggaaaccgggttaaccccggttaccggggttaaccccgttaccccggttaccccgttacccggttaaccggaccccggttacccccgttaaaccccggaaaccccgggtaaccccgggggttaccccttaacccgggtttccccccgggttttacccccgtttacccccggtaccgggtaaccccccttaccccccgtttaacccgtaaacccggtaaaccggtacccgtacccggttaaccccggttcggggtaacccggggtaaccctaaccgggtcccggtacccccgggttccgggtccgggtccgttacccgggtacccggtaaccggtaccggtaaaccggttacccgtttacccgttccggacgtaccgtcccggtacgttacggacgggtaccgggtcggtcgtaaccgggg

SEQ ID NO: 128887 - DNA, 728 bp, Homo sapiens
  misc_feature: GYAE6OF01AHGW7.45.78.H01.1.454.CMB.1.raw
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacgttcggccgggcagtcagtagttagttagtaacgttgggttggcctggtatcagacgaagaaaccgaagggaaaccgccccgtaagccttcccgtgtcctactaagtaacgctaacttacgttaaggtttaacggaaacgggttcggggtaccctataccggtaacggttacgaggtccggacgtaagggtacgggtacgttacgggtacgggtaacctaaggtaactttaccgtaccgttacctaccgaaaccctacttacgacgtacgtaaccggtcccgtaggaccgacgtcccttaggtacgtttacgttactttttacgaacctttaaacttttacttaccgtacgtacctaacgtagttaacttagtaacgtttagtttaccgttacggttaccggttaccggaaccggtaacggtaaccggtaagggttaaccggtaaacgtaaccgtaaacgtacgtggtcggtaccgtagacccgtaacttagtccgttacgttccgttactaccg

SEQ ID NO: 128888 - DNA, 601 bp, Homo sapiens
  misc_feature: GYAE6OF01EG2TY.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggccccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgtattttggagttgggttattcgggacggttagtgggtacgtcgtggggaccgaagggaccacggtcaccgtctcctcacgccctaccaccgaacgggcccagtccgtccttcccccgtcggcccaccctccctaccgaacgacgccaccgtcgtcgggggcctaccgacggccggccccgtgggccctggcccgtagggtaccgtaaacgggtaccttaccttcccgtacgtcggaccgttacgtctaggcggtcgggtcgtacggg

SEQ ID NO: 128889 - DNA, 515 bp, Homo sapiens
  misc_feature: GYAE6OF01BUYZG.45.78.H01.1.454.CMB.1.raw
  modified_base (197)..(197): a, c, t, g, unknown or other
  misc_feature (197)..(197): n is a, c, g, or t
  modified_base (298)..(298): a, c, t, g, unknown or other
  misc_feature (298)..(298): n is a, c, g, or t
  modified_base (497)..(497): a, c, t, g, unknown or other
  misc_feature (497)..(497): n is a, c, g, or t
  modified_base (508)..(508): a, c, t, g, unknown or other
  misc_feature (508)..(508): n is a, c, g, or t
  modified_base (510)..(510): a, c, t, g, unknown or other
  misc_feature (510)..(510): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtagganacagagtcaccatcacttgccgggccagtcagagtattagtaactggttggcctggtatcagcagaaaccagggaaacgccctaagctcctgctctatagnatctagttagaagtgggtccatcaggtcagcgcagtgatcgtgggacagtaacttcactctacaccatcagtcagcctgcacgcccgatgtatttcgactaacttattactgaccaactagtatgtaattagttatcggtacgttcggacgaacgggacaagggtagaaactacgaaacgacgtaggtgctagccactntctagtccttntntcccg

SEQ ID NO: 128890 - DNA, 731 bp, Homo sapiens
  misc_feature: GYAE6OF01B0GB4.45.78.H01.1.454.CMB.1.raw
tcagacgcgatcgacacgaccggtgctcgatttagtgtgagtagtttgggttgggggagtcagacccagtcaggacacagcatggacatgagggtccccgctcagctcctggggctcctgctgctctggctcccaggtgccaaatgtgacatccagatgacccagtcctccttccaccctgtctgcatctgtaggagacagagtccacctatcacttggccggtccagtcagagtatagtaacgtggtgcctgatcagacagaaacgacggaaacgtcctaagcctcgtcgctacctaataacggcattacgtaagttagaaaggtcgggtacccagtacgtaaggttcaggcgagtaggtgacgtcggtaggaactaacggtattacaccttcgtaccaaacctataccgtacgaccgtaaccgccgttacggacctacggtacctaggtaaacttggtttacttttaacggaactttaaaccgtttagttaaaccccggtactaaaccgtaaaccgttaagtttaactaaaccgggttttagttaaaccgttttacggttaacccggtttaaccggttacccgggtaaaaccggaaaccgggtaaacccggtaaaggggttaaaccgaaaacgttaaacccgtaaaccgggttaacgtagggttcccggaaccttacgaaccccgttaaacgttacgttacctttacggttaccgttcccttaacccgg

SEQ ID NO: 128891 - DNA, 777 bp, Homo sapiens
  misc_feature: GYAE6OF01ADZ6D.45.78.H01.1.454.CMB.1.raw
tcagacgcgatcgacacgaccggtgctcgattagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctggagatctgacgacacggccgtgtattactgtgcgagaggcaggaattacgtagtttttaggacggttagggttacgttacgggtaaccgggttagttacggggtacggttaccggttacggggggacccgtaaacgggggaccccgtaaccgggttccgaaccccggttccgtacccccgttaccgacggtcccccgtaccccgaaacccgaacgggaccccgtaacggttccccgggttcccgtttacccccccgtcgggtaccccgtacccccgtaccccgttaccaaaccgggaccgtcccgtaacccgtcccggtacggggggtaccccaaccggtaaccgggtccccgggtaccccggtcgggggtaccctcgggtacccccgttcgggtaccgtaaaccgggtacccttaacccggtttccccgtaccggtaaccgttcccgggtacccggttcccgtagggtaccggcccggggtcggttaccgggg

SEQ ID NO: 128892 - DNA, 176 bp, Homo sapiens
  misc_feature: GYAE6OF01C766J.45.78.H01.1.454.CMB.1.raw
  modified_base (175)..(176): a, c, t, g, unknown or other
  misc_feature (175)..(176): n is a, c, g, or t
tcagacgcgatcgacacgaccggtgctcgatttagtgtgagtagtttgggtttggggggaagaggaagactgacggtccccccaggagttcaggtgctgggcacagcggccctgggctgcctggtcaaggactacttcctcgatcgcgtctgagcgggctggcaaggcgcatagnn

SEQ ID NO: 128893 - DNA, 782 bp, Homo sapiens
  misc_feature: GYAE6OF01DC1FU.45.78.H01.1.454.CMB.1.raw
  modified_base (771)..(771): a, c, t, g, unknown or other
  misc_feature (771)..(771): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatgagctgagcagactgacatcgtcgacgacacggcctatttacttactgtgcgaggtagttcggtttacccggtggtaccgttcggttttccgtttttagggaaccggtaccggttcggggggaccctaacgggggtaaaccccttcggggtaccctaaccgtacttccgttccccttccgaaccggtccccttacccgaaccccgtaaacggggtccccctaacggttccccgggtttacccctttccccccggtacgggacccctaccccccgtttcccgtacccctaaacgggtaccgacccgtaaccccgttccgggtacggggggaccctaaccgaccgggtcccggggtcccccgttaggggtcccttcgggtccccgttagggttaacccggaaacgggttaacccttacccggtttacccgccggtaccgttaccgggccggtttcccgttacgggacccgggtccggggtaccttacggggacccaacggggccnccggtaaacgg

SEQ ID NO: 128894 - DNA, 617 bp, Homo sapiens
  misc_feature: GYAE6OF01ELAU7.45.78.H01.1.454.CMB.1.raw
  modified_base (357)..(357): a, c, t, g, unknown or other
  misc_feature (357)..(357): n is a, c, g, or t
  modified_base (386)..(386): a, c, t, g, unknown or other
  misc_feature (386)..(386): n is a, c, g, or t
tcagacgcgatcgacacgaccggtgctcgattttagtgtgagtagtttgggtttggggggtaggcatcacccagcaaccacatctgtcctctagagaatcccctgagagctccgttcctcaccatggactggacctgggaggatcctcttcttggtggcagcagccacaggagcccactcccaggtgcagctggtcgcagtcgtggggctgaggtgaagagccgtggggcctcgagtgaaggtctccgtgcaaggtcttcgtggatacctaccttcgaccggtctactatatacacgtgggtgcgacgacggcccgtggacgagggcttggagtggatgggatggactcaacctaanaagtggtagacaacaaactagtcgacaanagtaagtttcgagggcgagggtcaacgagtacgaccgagggaccaccgtcagtaccgagaccaacgacgacccgttaacagtacgggagtcgtagggacgtacggacgggacgttaggaacgtactcggtacggaaccgaccggtaccggtaccggttagtacgttaggtaggtcggacggaggaacgggtccgaaaggttaagttaacggtttaggtttgggttaacggg

SEQ ID NO: 128895 - DNA, 603 bp, Homo sapiens
  misc_feature: GYAE6OF01AU64W.45.78.H01.1.454.CMB.1.raw
  modified_base (182)..(182): a, c, t, g, unknown or other
  misc_feature (182)..(182): n is a, c, g, or t
  modified_base (543)..(543): a, c, t, g, unknown or other
  misc_feature (543)..(543): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtncagctggtgcagtctgggctgaggtgaagagccgtgggcctcgagtgaggtcctcctgcaaggcttctggataccaccttcaccggctacgtatatacacgtggtcgcgacgacggcccgtggacgagggtcttggagtggagtgggatggactacgaacctaagaagtggtcgacaactaaactagtacgacaacgagtaacgttacgagggacgacgggtacacgatcgacgacggacacgtacactcgacgacacgacgacctacgagtacggagtacgtaggacggtacggaggtccggacgtaacgtacgtaccgtacggaacggtaccggccggtaccggtacgttacgttacgnggtaccggacggaggacgtacggtaaggttaacgttacggttaaggtttgggttaacggg

SEQ ID NO: 128896 - DNA, 609 bp, Homo sapiens
  misc_feature: GYAE6OF01AXA7H.45.78.H01.1.454.CMB.1.raw
  modified_base (365)..(365): a, c, t, g, unknown or other
  misc_feature (365)..(365): n is a, c, g, or t
  modified_base (386)..(386): a, c, t, g, unknown or other
  misc_feature (386)..(386): n is a, c, g, or t
tcagacgcgatcgacacgaccggtgctcgatttagtgtgagtagtttgggtttgggggagagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctggaggtagaagaagccgtgggcctcgagtgaggtctctgcgaaggtcttcgtggactaccaccttcgaccggtctactatactacacgtgggtgacgacgacggccccgtaggacgaagggcttaggaggtggagtgggatggactaccaaacctaanaagtggtacgacaacaaactntcgacaacgaagtaacgttcggacgggcgtacgggtacacgtagtacggaccgaggaccaccgtaccataccagccacgacgaccctagagtacggagacgtaggacgcgaggtcaggaacgtcgtacgtacgaccgacggtaaccggtcgttacgttagttcggtcgtacggacggaggaacggtacgtaagggttaacgtttaggtttaggttttaacggg

SEQ ID NO: 128897 - DNA, 639 bp, Homo sapiens
  misc_feature: GYAE6OF01A4QRV.45.78.H01.1.454.CMB.1.raw
tcagacgcgatcgacacgaccggtgctcgatttagtgtgagtagtttgggtttggggctgaggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcgaggaattacgtattttggagttggtttagttcggtacggtagtgggtacgtcggtggggccgaaggggacccgacgggtccacccgttcctccctcgacgtccctcccaacccgaacgggccccacgttccgtcccttcccccgtcggccctacccctcccgtacccaacgtacgccgtacccgtccggtcgggggaccaccgacgggcccgggtcccgtaccgggccgttccggcccgttcgggtacgaaacgggttaccttacccgtttcccgtccggtaacgttccgccggttcgtggtcccgggg

SEQ ID NO: 128898 - DNA, 663 bp, Homo sapiens
  misc_feature: GYAE6OF01DSPJX.45.78.H01.1.454.CMB.1.raw
  modified_base (430)..(430): a, c, t, g, unknown or other
  misc_feature (430)..(430): n is a, c, g, or t
  modified_base (495)..(495): a, c, t, g, unknown or other
  misc_feature (495)..(495): n is a, c, g, or t
tcagacgcgatcgacacgaccggtgctcgatttagtgtgagtagtttgggtttgggggagagcatcacccagcaaccacatctgtcctctagagaatcccctgagagctccgttcctcaccatggactggacctggaggatcctcttcgttggtggcagcacgccacgaggacgcccacctcccaggtgcagcgtggtgcagtcgtggggctggaggtaggaagaacggccgtggggcctcgaggtagaacggtctccgtgacgaaggtcttcgtaggactacctaccgttcgaccggtacttaactaattactacgtacgttgggtacgacgaacgacggccccgtaggaaccgtaagggtctaggaggtggagtgggatggactaaccaaaccgtaacgaaggttcgggacgaacaaacgtaaacgtntacgacaacgtaaaggttacgtttacggagggacgtagggtaccaacgagtacggacgaggaacncgaccgtagacagacacgactaccgtaagacgtaggacgtcgtacggacgaccgaggtacgagacgtacgtcgacggtaaccgaccgtaccggtcgttagttacgtacggtcggacggtacgaaggtacggacgtaaacggtagtttaacggttaggttttaacgggg

SEQ ID NO: 128899 - DNA, 787 bp, Homo sapiens
  misc_feature: GYAE6OF01AI15H.45.78.H01.1.454.CMB.1.raw
tcagacgcgatcgacacgaccggtgctcgatttagtgtgagtagtttgggtttgggggtcagacccagtcaggacacagcatggacatggacgggtccccgctcagctccgtggggctcctgctgctctggctcccaggtgccaaatgtgacatcccagatcgacccagttcctcccttcccaccctgtcctgctatcgtaggtaggagacagactccaccatcacgttcggccggcagtcagtagttagttagtacgtggttggctggtactacgagaccgaacggaaaccgacgggaaccgccccgtaagcctccgtgtctacgtaagacgctagttacgtttaagttaacggaacggttcgggtaccctaagttacggtaagggttccgacgggtcggtacgtagggtacggtacgttaccgggtaaggggtaacctaaggttaaccttacctacccttacccgaccctaactacgtaccgacgtccgacgtccgtacgaccgtacgtcttaggtaacgtttgttaacgttttaccgtaacctttaaaccgtttaaccttacgtaccgaaacccgttaagtaacggtttagtaacggtttaacggtttaacggtttacccgggtttaaccgggtacccggttaaccggggaacccggtaacgggtaaaccggtaagggtaaaccgtaaaaccgaacggtaaacggtaccgttggtaccggtccgttaccgacccgttaccgttacgttccgtttaccgttcccttaaccgtcctttacccccgg

SEQ ID NO: 128900 - DNA, 599 bp, Homo sapiens
  misc_feature: GYAE6OF01C0IEB.45.78.H01.1.454.CMB.1.raw
  modified_base (360)..(360): a, c, t, g, unknown or other
  misc_feature (360)..(360): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggcagtcagagtattagtaactggttggcctggtatcagcaagaaaccgagggaaacgcccctaagcctcctgcctactataaggcaatcttaagttagaaaggtcgggtacccatcgaaggttcagcggcagtggatcgngggacagtaatcactctcacatcagcagcctgcagcctgatgtatttgactaacttcttactcacctaaactagtaatagtaatttaggttattaccggtacgtttaccggacgtaaacgggggtaacctaaaggggtacggtaaaagtaaccgtaaaaaccggtacgttaacgggtacggaccgttacggaccctaacccgtaaagtttccctacggttaccctttccgttaaccccg

SEQ ID NO: 128901 - DNA, 658 bp, Homo sapiens
  misc_feature: GYAE6OF01D0UZ2.45.78.H01.1.454.CMB.1.raw
  modified_base (257)..(257): a, c, t, g, unknown or other
  misc_feature (257)..(257): n is a, c, g, or t
  modified_base (295)..(295): a, c, t, g, unknown or other
  misc_feature (295)..(295): n is a, c, g, or t
  modified_base (300)..(300): a, c, t, g, unknown or other
  misc_feature (300)..(300): n is a, c, g, or t
  modified_base (521)..(521): a, c, t, g, unknown or other
  misc_feature (521)..(521): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtagaaggaagccgtgggcctcagtgaaggtctcctgcaaggtcttcgnggatacaccttcaccggtctactatatacacgtgggtncgacncggcccgtaggacgaaggcttggagtggagtgggatggataccgaaacctaacgaagttcgggtaggaccaaactaaacgttatcgacaacgaagtaaggtttacgaagggtacgtaaggggtaccaaccgagtacggaccgaagggaaccgaccggtaccaatcccgagtaccaaccacgtaccctaacgaggttcggactcggagaacggtacgagggngttacgaggtactaccggtacggaaccggaccggtaccgggtacccgttaggtaacgtttaaccggtggttaccggaggtaggaacgggtaccgtaaagggttaacgtttaagggttaggtttttggggtaaacggg

SEQ ID NO: 128902 - DNA, 606 bp, Homo sapiens
  misc_feature: GYAE6OF01C8GG6.45.78.H01.1.454.CMB.1.raw
  modified_base (196)..(196): a, c, t, g, unknown or other
  misc_feature (196)..(196): n is a, c, g, or t
  modified_base (412)..(412): a, c, t, g, unknown or other
  misc_feature (412)..(412): n is a, c, g, or t
tcagacgcgatcgacacgaccggtgctcgatttagtgtgagtagtttgggtttgggggtcagacccagtcaggacacagcatggacatgagggtccccgctcagctcctggggctcctgctgctctggctcccaggtgccaaatgtgacatccagatgacccagtctccttccaccctgtctgcatcgtgtagganacagagtcaccatcacgttcggccggcagtcagtagttattagtaacgttggtgcctggtatcgagacaagaaaccgaggaaacacccgtaagctccgtgctacgtaatacggctatacgttagttaaggaagtcgggtacccagtacgtaaggtcagtcggctaggtgatcgtaggacagtaactcactcacactatcagcacgtccgtagtacncgtagtattagttaactttacggtacttaaactttacttaccgacgtaacctaaactagtactagtaatttaagttacgttaccggtacggttacgaccgtaaagggaccgtaagggtaacaaagtaaccgtaaacgacgttcggcgtacgtcaccgtactacgtccgttcttaccttctcgttccctaccccg

SEQ ID NO: 128903 - DNA, 628 bp, Homo sapiens
  misc_feature: GYAE6OF01CPPNI.45.78.H01.1.454.CMB.1.raw
  modified_base (198)..(198): a, c, t, g, unknown or other
  misc_feature (198)..(198): n is a, c, g, or t
  modified_base (201)..(201): a, c, t, g, unknown or other
  misc_feature (201)..(201): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctcccttccaccctgtctgcatctgtagganacngagtccaccatctacgttggccgggcagtcagagtattagtaacgtggttggccgtgtatcagcaacgaaaccgagggaaaccacccctaagcctctgctatagtaaggcagttcttaagttaagaacggtcgggtccagtacgaaggttcacggtcggacgtaggtggaactcgtaggactaagtaactctactctacaccatcagcacgccgtgctacgcgtagaagttgtaactttacggaaccttaaacgtttataccgtacgaacctaacgtaagttactagtaaacgtttacgtttacttaccgggtaaccggttaccgggacgaaaccgggtacgtaaagggtaaacgaaatacccggtaaaacgtacgttggcggtcaacgtacccaacggttcttacgtttcgtccttacggttaccc

SEQ ID NO: 128904 - DNA, 510 bp, Homo sapiens
  misc_feature: GYAE6OF01C86S2.45.78.H01.1.454.CMB.1.raw
  modified_base (340)..(340): a, c, t, g, unknown or other
  misc_feature (340)..(340): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggcttgagtggatgggatggatcgaaaccctaanaatggtaggacacaaactatgacacagaagtttcgagggcaggggtacaccatcgaccagggacacgtcatcagcacacgcctacatggagctgagcgagtcgtagagacgtctagacgacgaccgtcgtgtactatgtcgcgagagcgagtagttacgtgtttggtagg

SEQ ID NO: 128905 - DNA, 599 bp, Homo sapiens
  misc_feature: GYAE6OF01BSKSO.45.78.H01.1.454.CMB.1.raw
  modified_base (343)..(343): a, c, t, g, unknown or other
  misc_feature (343)..(343): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacgttgccgggcagtcagagtattagtaacgtggttcggcctggtatcagcaaggaaaccagggaaacgcccctaagctcctgctctataaggcatctagttagaaagtcgggtccatcaaggttcaggcgngaagtggatcgtgggaacagaatcactctcacatcagcagctgaccagcctgtactgttacttttggacttaaccgtttaatttactcggacctaaacgtagtaattagtatttagttaacttccggtacggttaccgggaccgaaacggggtaaccctaaagggttaacggtaaaacttaccgaaaacggtaacgttcgggtcgaaccgttacgaaccctaccgtaattcccgttacggttccttccgttaaccc

SEQ ID NO: 128906 - DNA, 590 bp, Homo sapiens
  misc_feature: GYAE6OF01CVFQD.45.78.H01.1.454.CMB.1.raw
  modified_base (290)..(290): a, c, t, g, unknown or other
  misc_feature (290)..(290): n is a, c, g, or t
  modified_base (319)..(319): a, c, t, g, unknown or other
  misc_feature (319)..(319): n is a, c, g, or t
  modified_base (365)..(365): a, c, t, g, unknown or other
  misc_feature (365)..(365): n is a, c, g, or t
  modified_base (374)..(374): a, c, t, g, unknown or other
  misc_feature (374)..(374): n is a, c, g, or t
  modified_base (389)..(389): a, c, t, g, unknown or other
  misc_feature (389)..(389): n is a, c, g, or t
  modified_base (441)..(441): a, c, t, g, unknown or other
  misc_feature (441)..(441): n is a, c, g, or t
tcagacgcgatcgacacgaccggtgctcgatttagtgtgagtagtttgggtttggggtgaagaagcctgggcctcagtgaaggtctcctgcaaggcttctggatacaccttcaccggctactatatacactgggtgcgacaggcccctggacaaggcttgagtggatgggatggatcaaccctaacaatcggtggcacaaactatgcacagaagtttcagggcagggtcaccatgaccagggacacgtaccatcaggcacagctacatggagctgagcaggctgagatcngacgacacggccgtgtattactgtgacgngaggcaggaattacgatttttggagttggtaagttcgggacgtagnggacgtcgngggtacaagggaccncggtcaccgtcctcctcagtcctccaccgacggccactccggtccttacccncggaccaccctcctaccaacgtacgccaacccgtcgtaccgggggccacgacgacccggcccgtggcctcgcccgtacggtaccgaacgggtacctaccgttcccgtccggacttaccggccgttacctagggaccgcgggtcgtcggg

SEQ ID NO: 128907 - DNA, 587 bp, Homo sapiens
  misc_feature: GYAE6OF01AQ7NF.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtatactgtgcgagaggcaggaattacgatttttggagttggttattcggacggtatggacgtcgtggggccaagggaccacgggtcaccgtctcctcacgcctccaccaacgggcccacgtccggtccttcccccgtcggcctaccctccctccaacgacgccacctccgtgggggccacgacggccggccctcgggcctcgcccgtcgggtaccgaacgggtaccttaccgttcccgtccgacgttccggccgttcgtcggacggccggggtcgtacgggg

SEQ ID NO: 128908 - DNA, 558 bp, Homo sapiens
  misc_feature: GYAE6OF01BEP4D.45.78.H01.1.454.CMB.1.raw
  modified_base (278)..(278): a, c, t, g, unknown or other
  misc_feature (278)..(278): n is a, c, g, or t
  modified_base (388)..(388): a, c, t, g, unknown or other
  misc_feature (388)..(388): n is a, c, g, or t
  modified_base (406)..(406): a, c, t, g, unknown or other
  misc_feature (406)..(406): n is a, c, g, or t
  modified_base (431)..(431): a, c, t, g, unknown or other
  misc_feature (431)..(431): n is a, c, g, or t
  modified_base (443)..(443): a, c, t, g, unknown or other
  misc_feature (443)..(443): n is a, c, g, or t
  modified_base (542)..(542): a, c, t, g, unknown or other
  misc_feature (542)..(542): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttcgccgggccagtcagagtattagtacgtggttggcctggtatcagcaagaaaccagggaaacncccctaagctcctgctctagtaaggcatacgtagtttaaggaaaggtcggggtaccctagtacgtaaggttcaggcggctaggtggagtcgtagggacagtattcactcncacatcagcacgcctgcngctgatgtatttgacttattatacncgactaacagtntagtattagttacttccggtacgttcggaccgaacggacgtaaggtagaaaactaccgtaaaacgacgttaggtcggactaccgacctacctactcttnttcccttacttacccg

SEQ ID NO: 128909 - DNA, 617 bp, Homo sapiens
  misc_feature: GYAE6OF01ACBMZ.45.78.H01.1.454.CMB.1.raw
  modified_base (191)..(191): a, c, t, g, unknown or other
  misc_feature (191)..(191): n is a, c, g, or t
  modified_base (262)..(262): a, c, t, g, unknown or other
  misc_feature (262)..(262): n is a, c, g, or t
  modified_base (558)..(558): a, c, t, g, unknown or other
  misc_feature (558)..(558): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtncagtcgtggggctggaggtgaagagccgtggggcctcagtgaaggtctcctgcaggtcttcgtggactacnccttcgaccggtctactatatacacgtggtcgcgacacggccccgtaggacgaagggtcttggagtggagtgggatggataccgaaacctaagaagtcgggtcgacaactaaactagtacgacacgtaaggtaacgtttcggagggtaccgagggtaccaccgagtacgaccggagggaaccaccgtacactaccgacgaccacgacgacctaacgaggtcggacgtcgtaggacgcggacggtactaggacgtacgtcgacggaccgacggtacccggtgttacgtacttacggnggttacggacggaggacggtacgtaaggttaactttcggttaagttttgggtaaacggg

SEQ ID NO: 128910 - DNA, 596 bp, Homo sapiens
  misc_feature: GYAE6OF01DJPYF.45.78.H01.1.454.CMB.1.raw
  modified_base (245)..(245): a, c, t, g, unknown or other
  misc_feature (245)..(245): n is a, c, g, or t
  modified_base (340)..(340): a, c, t, g, unknown or other
  misc_feature (340)..(340): n is a, c, g, or t
  modified_base (443)..(443): a, c, t, g, unknown or other
  misc_feature (443)..(443): n is a, c, g, or t
  modified_base (450)..(450): a, c, t, g, unknown or other
  misc_feature (450)..(450): n is a, c, g, or t
tcagacgcgatcgacacgaccggtgctcgatttagtgtgagtagtttgggtttgggacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctcctgcaaggcttcgnggatacaccttcaccggctactatatacactgggtgcgacgcggccctggacgaagggcttggagtggagtgggatggaataccaaaccctaaanaagttgggtagacaaacgaaactatgacaacaagtaagtttcgagggtcgaggtacacgagtcgaaccgagggaccacgtccaatcagacaacacgaccctanagtggancgtgaagcgagcgtaggagattcgaggaacgaccgacggtccgttagttaacgtcgtggtggacggaggtaacgggacgtaaaggttaacgtttaacggttaggtttttagggtaggttttaagggttacggttcggggtaacggg

SEQ ID NO: 128911 - DNA, 605 bp, Homo sapiens
  misc_feature: GYAE6OF01C75W4.45.78.H01.1.454.CMB.1.raw
  modified_base (229)..(229): a, c, t, g, unknown or other
  misc_feature (229)..(229): n is a, c, g, or t
  modified_base (240)..(240): a, c, t, g, unknown or other
  misc_feature (240)..(240): n is a, c, g, or t
  modified_base (294)..(294): a, c, t, g, unknown or other
  misc_feature (294)..(294): n is a, c, g, or t
  modified_base (384)..(384): a, c, t, g, unknown or other
  misc_feature (384)..(384): n is a, c, g, or t
  modified_base (488)..(488): a, c, t, g, unknown or other
  misc_feature (488)..(488): n is a, c, g, or t
  modified_base (572)..(572): a, c, t, g, unknown or other
  misc_feature (572)..(572): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtctggggctggaggtgaagaagccgtggggcctnagtgaaggtcncctgcaaggtcttctggactacaccttcacggctaactatatacacgtgggtcncgacgacggtcccctggaacaacgggtcttagagtggagtgggagttggactaccgaaaccctaaagaagtcggtgactaacaaacgtanacggactaacgaagttaacgttcgaagggacgacgggtaccacgagtacgacgaagggtacgactaccgatacgacgacgacacgtaccaacgagtagggaacncgtacggagtccggaacggtctaacggtagactacgacgaacgacgtaccggacgtacggttactagtcgtaggcgagacgggnaaacgggttaattaacggtttgttaggtaaggg

SEQ ID NO: 128912 - DNA, 650 bp, Homo sapiens
  misc_feature: GYAE6OF01D7LVW.45.78.H01.1.454.CMB.1.raw
  modified_base (188)..(188): a, c, t, g, unknown or other
  misc_feature (188)..(188): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaanaatggtgcacaaactatgcacagaagtttcagggcagggtcaccatgaccagggacacgtccatcagcacagcctacatggagctgagcaggctgagatcgtgacgacgacggccgtgtattactgtgcgagaggcaggaattacgtagttttgggagttggttagttaggacggttagtggtacggtcgtggggaccgaagggaccacgggtcctaccgtcctcccgtccgacgccctacccaccgaacgggccccacgtccggttccttcccccgtcggtcccaccccgttcccttacccgaacgtacgccgtacccgttccggtcgggggacctaccgaccggcccgggtccccggtacgggtccgtcggtcccggtacgggttaccgtaaacgggtacccttacccgtttcccgtccgtacgtccggtccgttcgtcggacggtccgggcgtaccggg

SEQ ID NO: 128913 - DNA, 559 bp, Homo sapiens
  misc_feature: GYAE6OF01C74YZ.45.78.H01.1.454.CMB.1.raw
  modified_base (280)..(280): a, c, t, g, unknown or other
  misc_feature (280)..(280): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgcccgggcagtcagtagtattagtaactggttggcctggtatcagcaacgaaaccgagggaaacncccctaagcctcctgctatataaggcatctagttagaaagtcgggtaccatacaaggttcagcggcagtgatcgtggacagaatcactctcacatcaagcacgctgcatcctagaatgtatttgacttaacgttattacgtcgaccaagtagtatagtaattagtttagtacgtacgttcggactaacgggaacctaaaggtaggtaaactacggtaaaaccgtaagttaggtacggtcctaggacctacctacttacgttacgtcgtttaccgtaccg

SEQ ID NO: 128914 - DNA, 663 bp, Homo sapiens
  misc_feature: GYAE6OF01AF6O2.45.78.H01.1.454.CMB.1.raw
  modified_base (201)..(201): a, c, t, g, unknown or other
  misc_feature (201)..(201): n is a, c, g, or t
  modified_base (286)..(286): a, c, t, g, unknown or other
  misc_feature (286)..(286): n is a, c, g, or t
tcagacgcgatcgacacgaccggtgctcgatttagtgtgagtagtttgggtttgggggtaggtcgagacccagtcaggacacagcatggacatgagggtccccgctcagctcctggggctcctgctgctctggctcccaggtgccaaatgtgacatccagatgaccccagtcctccttccaccctgtctgcatctgagganacagagtccacctatctacttggcccggcagtcagagtattagaactggtgctgtatcagcagaacgaggaacgccctagcctcngctactatagcatactagttagaagtgggtcccagtacgtagtcagcggacgagtgactcgtcgggtacagtaacgtccgtacgtacctcgaaccgtactacgacgcgtacgccgttcgacgaccgtactacggtaacgttagtacgttttaccgtactaaccgttttaagtaccgttacgtaccgtaaacgtaaggttacttaagggtactttaacggtttacgttaaccgggttaccgtttaccgggtaacccgggtaaacgggtaaccggtaacgggttaacggtaaaacttacccggtaaaacgtaacccggttggtaccggtacccgtaagtaccgtaccctaaggtacccttggttaccttcccgtaaccg

SEQ ID NO: 128915 - DNA, 566 bp, Homo sapiens
  misc_feature: GYAE6OF01E1X39.45.78.H01.1.454.CMB.1.raw
  modified_base (198)..(198): a, c, t, g, unknown or other
  misc_feature (198)..(198): n is a, c, g, or t
  modified_base (293)..(293): a, c, t, g, unknown or other
  misc_feature (293)..(293): n is a, c, g, or t
  modified_base (324)..(324): a, c, t, g, unknown or other
  misc_feature (324)..(324): n is a, c, g, or t
  modified_base (555)..(555): a, c, t, g, unknown or other
  misc_feature (555)..(555): n is a, c, g, or t
tcagacgcgatcgacacgaccggtgctcgatttagtgtgagtagtttgggtttgggggtcagacccagtcaggacacagcatggacatgagggtccccgctcagctcctggggctcctgctgctctggctcccaggtgccaaatgtgacatccagatgacccagtcctaaccttccaccctgtctgcatctgtagganacagagtcaccatcacttggccggccagtcagagtattagtactggttgctggtatcagacagaaaccgaggaacgcccctaagctctgctatanagcatctagttagaagtggtaccatcgagtnagcgcagtgatgaggacagtactcactctaccactatcagcacgcctagctagtcctagattggttactttgacttaaacgtttattacctcgaaccctaagtagtaactagtaagttagtttacgttccggttaacgggttaccggaaccgtaaccggggaaccgtaagggtacggtaaaactacgaaaacgtacggtggtcggctccgacaaccgtactcgtattcctntccgttccccg

SEQ ID NO: 128916 - DNA, 620 bp, Homo sapiens
  misc_feature: GYAE6OF01E4Z0N.45.78.H01.1.454.CMB.1.raw
  modified_base (188)..(188): a, c, t, g, unknown or other
  misc_feature (188)..(188): n is a, c, g, or t
  modified_base (287)..(287): a, c, t, g, unknown or other
  misc_feature (287)..(287): n is a, c, g, or t
  modified_base (315)..(315): a, c, t, g, unknown or other
  misc_feature (315)..(315): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaanaatggtggcacaaactatgcacagaagtttcagggcagggtcaccatgaccagggacacgtccatcagcacacgcctacatggagctgagcggagtcgngaagcgctagacgcacgcgtgtagtacngtgacgagtagcaggtattacgtatttggagtgtacgtggacgtgtacgcggtacgtgggacaacgggaccacggttcaccgtcactcgagtccacacgacggtcctatccgtcctacccctgaccctaccgtcctacccgaagccgtacctaccgtaggacggtagtacccgaacgaccggtccggacccggttaggccgtaccggtaccgttacggtaaccgtaaccggttaccttccgttaccccgtaaggtacgggttcccgtacgggttaaccggtcccgggttaggggcccggttacgg

SEQ ID NO: 128917 - DNA, 535 bp, Homo sapiens
  misc_feature: GYAE6OF01D9MHL.45.78.H01.1.454.CMB.1.raw
  modified_base (238)..(238): a, c, t, g, unknown or other
  misc_feature (238)..(238): n is a, c, g, or t
  modified_base (444)..(444): a, c, t, g, unknown or other
  misc_feature (444)..(444): n is a, c, g, or t
  modified_base (449)..(449): a, c, t, g, unknown or other
  misc_feature (449)..(449): n is a, c, g, or t
  modified_base (469)..(469): a, c, t, g, unknown or other
  misc_feature (469)..(469): n is a, c, g, or t
tcagacgcgatcgacacgaccggtgctcgatttagtgtgagtagtttgggtttggggagagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtcncctgcaaggcttctggatacaccttcaaccggctactatatacactagggtgcgacagggcccctggacaagggcttcgagtggagtgggatcgggatcgaaaccctaacaaagtggtgggcaacaaactatgacacaggaaatttcaagggtcagggtacaccgatgaccaagggacaacggtccatcaagccaacagcctacgntaggngctgagcgaggctgagatcncgtacgacgacggccgtgttattacctggttcgagaggcgacgaggaattccgtaagttttacggg

SEQ ID NO: 128918 - DNA, 607 bp, Homo sapiens
  misc_feature: GYAE6OF01AQHH0.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcgaaggtaattacgttagtttttgggagttaggttacgttcgggacggttagtaggtacggtcgtggggaccgaacgggaccacgggtacctaccgtcctcccgtcacgccctcccaccgaacgggcccacgtccggtcccttccccgtcgcctacccctcctaccacgcgccaccgtcgcgggccaccgcgccggccgtgggcctcggccgtcggtaccgtaacggtaccttaccgttcccgtacgtacgtccggtccgtcgtaggcgggccgggtcgtcgggg

SEQ ID NO: 128919 - DNA, 590 bp, Homo sapiens
  misc_feature: GYAE6OF01B4TYV.45.78.H01.1.454.CMB.1.raw
  modified_base (585)..(585): a, c, t, g, unknown or other
  misc_feature (585)..(585): n is a, c, g, or t
tcagacgcgatcgacacgaccggtgctcgattagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcaggtcacatgaccagggacacgtccatcagcacacgcctacatggagctgagcgaggctgagatctgacgacacggccgtgtattactgtgcgagagcgaggaattacgtagttttggagtggttattcggacggtagtggacgtcgtgggaccgaacgggaccgacggtcaccgtctcctcacgccctccaaccgaacgggcccctaagtcccggtccttcccccgtcggcctaccccttccgtacaacgacgtaccctacccgtcggtcggggaccaccgtacgcccggccgcgggtcctcgcccgtggtaccgtaacggtacttaccgttcctccgtatcgtcgtcgtaggacgcgggntcggg

SEQ ID NO: 128920 - DNA, 630 bp, Homo sapiens
  misc_feature: GYAE6OF01BC9TB.45.78.H01.1.454.CMB.1.raw
  modified_base (456)..(456): a, c, t, g, unknown or other
  misc_feature (456)..(456): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctgggaggatcctcttcttggtggcagcagccacaggagcccactcccaggtgcagctggtgcagtcgtggggctgaggtgaagaagccgtggggcctgagtgaaggtctccgtgcaaggcttctggactacaccttcaccggctactatatacacgtgggtgcgacacggccctggacaagggcttgagtgagtgggatggaatacaacctaacaagtagggtgacgaacaaactatcggacaacgagtaagttcgagggcgagggtcacgagtcgaccgaggacacgtcactacgacgcacgacgacctacgagtggacgtacnggtaacggacgtacggtcgtacggaaggtaccgtaccgtaacggtaacccgaacggtacccggttaggtacggtttaacgttaacggttacgggttacgggacccgggaaagggtaacggtacgaaacgggtttaaaggtttaaccgggtttgggttttaacggggttaaaggg

SEQ ID NO: 128921 - DNA, 607 bp, Homo sapiens
  misc_feature: GYAE6OF01EOZOM.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcacatgaccagggacacgtccatcagcacagcctacatggagctgagcgaggctgagatctgacgacgacggccgtgtattactgtgcgagaggcaggaattacgtattttggaggttggttagttcggacggtagtggtacgttcgtcggggccgaaaggggaccacgggtcctaccgtcctccgtccacgccctacccgaaccgaaccgggccctacgtcccggttcccttcccccgtcggccctacccctccctacccgaagacgccaccgtccgtggggccacgacgccggcccgtcgggcctcgtccgtcggtacgacggtaccttacgttccctacgacgtccgtcgtacgtaggacggcggggctacgggg

SEQ ID NO: 128922 - DNA, 578 bp, Homo sapiens
  misc_feature: GYAE6OF01B07NR.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggtaattacgagtttttggagttggttattcgggacggtagtggacgtcgtggggacaagggaccacgggtcaccgtctccgtcacgcctcccgaccaacgggcccaagtccggtccttcccccgtgcccaccctccctaccaagaccgcaccctcgtcggggcacgacggccggcccgtgggcctggccctgggtacgaacgggtactacttcccgacgactccggtacgtctagacggtcgggtcgtacggg

SEQ ID NO: 128923 - DNA, 699 bp, Homo sapiens
  misc_feature: GYAE6OF01AV7JP.45.78.H01.1.454.CMB.1.raw
  modified_base (680)..(680): a, c, t, g, unknown or other
  misc_feature (680)..(680): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatcgtagaccgacgaccggccgtagtacttacgtggtgacggaggacggacgaaggtaacgttacggtagttttaggaggtttaggttaagttcgggtaacggttaggtaggtacggtcggtacggggaaccgaacgggtacccgtacggtaccgtacccgtcgtaccctaccgacgtccccgtacccgaacccggaacgggacccctacggttcccggtaccccttcccccgtacggacccctaccccgttcccgtacccgaacggtaccgtaccctaacccggttccggtacgggggaccaccgacggcccggtcccgtcgggtcctcggtcccgtacgggtaccgaacggttaccctaccgttcccgtacgtccgttaccggtcgttacgnggacggcgggtcgtacggg

SEQ ID NO: 128924 - DNA, 687 bp, Homo sapiens
  misc_feature: GYAE6OF01CZA9X.45.78.H01.1.454.CMB.1.raw
  modified_base (135)..(135): a, c, t, g, unknown or other
  misc_feature (135)..(135): n is a, c, g, or t
tcagacgcgatcgacacgaccggtgctcgatttagtgtgagtagtttgggtttgggtgaagaagcctgggcctcagtgaaggtctcctgcaaggcttctggatacaccttcaccggctactatatacactgggtncgacaggcccctggacaagggcttgagtggatgggatggatcaaccctaacaatggtggcacaaactatgcacagaagtttcagggcagggtcacagtgacagggacacgtccatcagcacagcctacagtgagctgagcaggctagagtatcgtagacgacgacggtccgtagtaacttacgtgtagacgagaggacaggtaattacggtagtttttgggagttaggttacgttcgggaacggttagtcggaacggttcgtacgggggaccgaaagggtaccgaccgggtacacccggttctaccctcgacgtccctaccgaacccgtacggccccgtagttcccggttaccttccccgtacgtccggtaccctaaccccttcgacccgtaacggtcgaccgtacccggtacgggtccggggaaccacgtaccggccggtcccgttaggggtcccttcgggtaccgttacgggtaccgtaaacgggtcccttaacccggttccgtacccgtacgtcccgaccgttacggtcggtaccggtccgggtaaccg

SEQ ID NO: 128925 - DNA, 570 bp, Homo sapiens
  misc_feature: GYAE6OF01B4NBX.45.78.H01.1.454.CMB.1.raw
  modified_base (333)..(333): a, c, t, g, unknown or other
  misc_feature (333)..(333): n is a, c, g, or t
tcagacgcgatcgacacgaccggtgctcgatttagtgtgagtagtttgggtttggggacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctcctgcaaggcttctggatacaccttcaccggctactatatacactgggtgcgacacggcccctggacaagggcttggagtggatgggatggatcaacctaanaagtggtggcacaaactatgacaacagtaagtttcgagggacagggtacaccagtagaccgagggacacgtaccatcgagcaacacgacctaacagtggagctgacgacgaggcgtaggaggtactacgacgaaccgacgaccggtccggttagtacgttaccgtggtacggccggaaggacggagtaagggtaatttacggtagttttagggaagttcggtttaagtcgggtaggg

SEQ ID NO: 128926 - DNA, 695 bp, Homo sapiens
  misc_feature: GYAE6OF01DWU58.45.78.H01.1.454.CMB.1.raw
  modified_base (235)..(235): a, c, t, g, unknown or other
  misc_feature (235)..(235): n is a, c, g, or t
  modified_base (248)..(248): a, c, t, g, unknown or other
  misc_feature (248)..(248): n is a, c, g, or t
  modified_base (348)..(348): a, c, t, g, unknown or other
  misc_feature (348)..(348): n is a, c, g, or t
tcagacgcgatcgacacgaccggtgctcgatttagtgtgagtagtttgggtttggggacccagcaaccacatctgtcctctagagaatcccctgagagctccgttcctcaccatggactggacctggaggatcctcttcttggtggcagcagccacaggacgccccactcccaggtgcagctggtgcagtcgtgggctgaggtagaagagccgtgggcctcgagtgaagtctccngacaagtcttcgngatactaccttcgaccgctacgtaatactactacgtggtgcgacgacggccctaggacgagggtctggacgtggatgggatggaactaccaaaccctaanaagtggtacgacaaacaaacttagacgacaacgaagtaaggtttacgagggtaccgtaaggtttaccagtacggaaccggaggaacctaccggtaccaagtcccgaaagtccaaacaccgtacccgtaacgtaagtacgggtacgcgttaggacgtacggacggcgtagaacgtactaccgggtacgaacccggtaccggaccggttacccggttagttaacgtttacggtacgtagggtaaccggaagggtagggaaaccggttagggttaaaccgtttagggtttaacgtttttaagggggacgttttaagggtttaaccggtttcggggaagggtttaaccggg

SEQ ID NO: 128927 - DNA, 725 bp, Homo sapiens
  misc_feature: GYAE6OF01B6LT4.45.78.H01.1.454.CMB.1.raw
  modified_base (200)..(200): a, c, t, g, unknown or other
  misc_feature (200)..(200): n is a, c, g, or t
  modified_base (287)..(287): a, c, t, g, unknown or other
  misc_feature (287)..(287): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatcgacccagtcctccttccaccctgtctgcatctggtagganacagacgtcaccatcacttggccggcagtcagtagtattagtaacgtggttcggcctggtactcagacaagaaaccgaagggaaacnccctaagctaccgtgctctataagctatacttaaggttagtaaaggtcgggtacctagtacgtaaggttcgaacggtcggcgtaaggtacggacgtacggtagggaactaaggtaacttacgaccttactacctaaacctagttaccacggacctaacggtccccgttaggaccgtaaccggtacccgttaagtaacgtttacggtttaacgtttttacggaaacctttaaaaccgttttacttaaccgtaaccggtaacccgtaaagtaacgttagttaacggtaagtttaacgggtttaacgttaccgggtaccggtttaaccgggaaccggtaaaccgggtaaccggtaaacgggttaaacgaaaacgttaaccgaaacggttaacgtggtacgtacgtagaccgtaccttacgtactttactccgttctacccg

SEQ ID NO: 128928 - DNA, 564 bp, Homo sapiens
  misc_feature: GYAE6OF01BTA10.45.78.H01.1.454.CMB.1.raw
tcagacgcgatcgacacgaccggtgctcgatttagtgtgagtagtttgggtttgggggagcatcacccagtaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactggtgcgacaggcccctggacaagggcttggagtggagtgggatggatcaaccctaacaatggtggcacaaactatgcacagaagtttcgagggcagggtcacatcgaccgagggacacgtccatacagcacgagccctacagtcggagcgtgacgcgaggcgtaggacgtatcgtacgacgtaccgaccgggtccgttagttaacgttacgtaggttcggacggtaggacggacgtaaagggtaactttaacgggttagtttttaggggaggttttacgggg

SEQ ID NO: 128929 - DNA, 855 bp, Homo sapiens
  misc_feature: GYAE6OF01EY5R1.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgaggcgtgagactcgtagacggacgaccggccgtgtattacgtgtgcgtaggaggacaggtaattacgtagttttggagtggttagttcggaacggtagtcggtacggttacggtcggggaccgtaacggggaccctacgggttaccgaaccgttccctcccgtcgaccgtaccccgttaccccgaaaccgtaaaccggggccccctaacggttacccccggggttcccccttttcccccccggtcgggtaccccccgttaccccccgtttacccccgttaaccccgaaacggtcccgggacccctaaccccggttccccgggttacggggggggtaaccccctaacccggggtaaccgggacccccggggtaccccccgggttaccggggggtacccggttcccccggggtttaacccgggtaccccggggtttaaacccgggaaaccccggggttaaccccgttttaaacccccgggtttcccccggtttacccggtaaacccggtttccccggtaccccgggtttacggtaccgggggtaacccgggtcccgggggtcccggttaaccgggggg

SEQ ID NO: 128930 - DNA, 544 bp, Homo sapiens
  misc_feature: GYAE6OF01CZL5U.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgatttttggagttggttattcggacggtatggacgtcgtggggccaagggaccacggtcaccgtctcctcagcctccaccaacggcccatcggtcttcccctggccaccctcctccaagacgcacctcgtcggggcacgacgccggcccgtgggctcgccgtggtccgaacggactacgttcctcgatccgcgtctggacgcgggcgtcggg

SEQ ID NO: 128931 - DNA, 611 bp, Homo sapiens
  misc_feature: GYAE6OF01AEP5Y.45.78.H01.1.454.CMB.1.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctcgaggtgaaggtctccgtgcgaaggtcttctggatacaccttcaccggtctactatatacacgtgggtgcgacgacggccccgtaggaccgaaggggtcttggaggtgggagtgggatgggactaccaaaccctaaacaagtgggtagacaacaaactatcgacaactaggtaacgtttcgaggggacgaggggtaccaacgagtacggaccgaacggggaccacgtaccacgtcacgcaacacgcctaacgacgtgggacgcgtacggaggcggaggtcgtaggagatcgacgtaccgacggtaccggtccggtaggttacttacgtggtggacggaggagggtacgtaagggtaacttacggtttgtttaggggttacggg

SEQ ID NO: 128932 - DNA, 641 bp, Homo sapiens
  misc_feature: GYAE6OF01CBWIU.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaaccctaacaatggtggcacaaactatgcacagaagtttcagggcagggtcacatgaccaggacacgtccatcagcacagcctacatggagctgagcaggctgagatctgacgacacggccgtgtattactgtgcgagaggcaggaattacgtattttgggagttggttacgttcgggtacggtatgggtaacgtcggtacggggaccgaaaggggacccgtaacgggttccgtacccgttcctcccgttccgaccgtcccgttacccaacccgaacgggtaccccaacggttcccggtccctttccccccgtcggccctaccccgtcccgtacccgaagacgtacctacccgtccgtacgggggtccacgacggcccggccgtcgggctccggccgtcggcgtaaacggcttaaccgttccgtacgtacgtccgtcgtaccgtggacggtcggcgtcggg

SEQ ID NO: 128933 - DNA, 705 bp, Homo sapiens
  misc_feature: GYAE6OF01C6EFZ.45.78.H01.1.454.CMB.1.raw
  modified_base (337)..(337): a, c, t, g, unknown or other
  misc_feature (337)..(337): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggagatcctcttcttggtgcagcagccacgaggacgccccactcccaggtgcagctggtgcagtcgtggggctggaggtgaagacgccgtgggcctcgagtgaggtctcctgacgaggcttcgtggataccaccttccgaccggtctatatatacacgtggtgcgacgacggcccgtaggacgaagggcttggagtggagtgggntaggactaccgaaaccctaacgtaagttgggtacggactaacgtaaacgttatcgaccacgtaaggtaaacggtttaccgaagggtacgtacggggtacctaaccgtacgtaccgaaccggaacgggtacccgtaccgtaccataccgacgacctaaccgaaccgtacccgtaacgtacggtaggacggtcgtaggacggaccgtacgggtcgtacggtaagtacgttaccgtacggaacccggtaccggacccgggttaccggttagttaaccgtttacgggttacggttcgggaacggtagggaacgggtacggtaaacgggttaacgttttaacgggtttaggtttttaggggtttaaacggggg

SEQ ID NO: 128934 - DNA, 728 bp, Homo sapiens
  misc_feature: GYAE6OF01DCQTH.45.78.H01.1.454.CMB.1.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctcgagtgaaggtctcctgcaaggtcttcgtggatacaccttcgaccggtctactatatacacgttgggtcgacgacgacggtccccgtaggaccgaagggtcttaggaggtggtagtgggagtaggactaaccgaaacctaaacgtaagtcgggtacggaccgaaactaaacgtagtacgacaacgtaaacggtaaggtttacggaaggggtacgaacggggtaccaaccgtacgtacggaacccggaaacggggaccctaaccggtaccaacgtacaaccgcaaccgaaccgtacccttaacgacgttagggacgtacgtaggaacgacggacgggtagtaggaacgtacgttacggtaacggaaccggtaaccggacccgggttaccggttacggtttaaacgttaccggttagggtacgggaccgggtaaggtaacggggtaacggtaaaggggttaaacgttttaacgggtttagggtttttaaggggttaacgggg

SEQ ID NO: 128935 - DNA, 675 bp, Homo sapiens
  misc_feature: GYAE6OF01C8N57.45.78.H01.1.454.CMB.1.raw
  modified_base (254)..(254): a, c, t, g, unknown or other
  misc_feature (254)..(254): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcaacaaactatgcacagaagtttcagggcagggtcaccatgaccagggacacgtccancagcacagcctacagtggagctagagcgaggctgagatcgtagacgaccgacggtccgtgtacttacgtgtgcgaaggaggacgaaggtaattacgtagtttttggagtttaggttagttcgggtaacggtagtcgggtacgtccggtaggggacccgaaagggtacccaacgggttccaccgttccgtccttccgacgtccctacccgaaccgtaacgggcccctacgttcccgggttcccttcccccgtcggtccctaccccgttacccacccgaacgcgacctaccgttccggtacggggccaacgtacggcccggtcccgtgggtccgtcgtacccgtggtaccgaaacggtaccctttaccgttccgtaccgtacgttccggtccgttacgtgggacggtcccgggtcgtaccggg

SEQ ID NO: 128936 - DNA, 631 bp, Homo sapiens
  misc_feature: GYAE6OF01BCGAF.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgattttggagtggttattcggacggtatggacgtcgtggggccgaagggaccacggtcaccgtctcctcacgcctccaccgaagggccccacgtccggtccttcccccgtcggcccacccctccctcccaacgacgccaacccgtccgtacgggggccaaccgacggcccgggacccgtcggggcccgtcggcccgttcgggttaccgaaacgggtacccttaaccgttccccgttacccggtaacgttccccgggtccggttacccgttggaacggtccgggggtccgttaccggggg

SEQ ID NO: 128937 - DNA, 652 bp, Homo sapiens
  misc_feature: GYAE6OF01DKAXX.45.78.H01.1.454.CMB.1.raw
  modified_base (295)..(295): a, c, t, g, unknown or other
  misc_feature (295)..(295): n is a, c, g, or t
tcagacgcgatcgacacgaccggtgctcgatttagtgtgagtagtttgggtttggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctgaggtgaagaacgcctggggcctgaggtgaacggtctcctgcaaggtcttcgtggatacaccttcaccggtctactatatacactgggtcncgacgaggccccgtggacaagggcttgagtggagtgggagtgaactctaaacctaactaagtggtggaccaacgtaaaactagtacgacgacgtaaagtaaggtttcgaagggaccgagggtaccaacctagtacggaaccgacgggaacaacggtaccgtacgacgacgaccgaacgaaccgtaccctaacgtaacgtcgggaagtcgtaacggtaaggaccgacgggtagttacggaacgtcgttaccgtacgaaaccgaaccgaccgggtccgtacggtttaccgttagtcgggttacggacggagggaacgacggtaaggtaaacgtttacggtttagtttagggttaacggg

SEQ ID NO: 128938 - DNA, 669 bp, Homo sapiens
  misc_feature: GYAE6OF01C3NSR.45.78.H01.1.454.CMB.1.raw
  modified_base (431)..(431): a, c, t, g, unknown or other
  misc_feature (431)..(431): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctaacatggagctgagcgaggctgagatctagacgacacggccgtagtattacgtgtgcgagaggcgaaggtaattacgtagtttttgggagttggttagttcggaggttagtggacggttcgtaggggccgaaagggaccgacgggttcaaccggttcctccgtaccncgccctcccaccgtaacgggccccacgttccggtacccgttccccccgtgggaccctaccccgttccctacccgaacgacgaccctaccgttcgggtccgggggtccaaccgtcggcccgggtacccgtcggggtcccgtcggccccggttagggtacccgtaaacgggtaccctttacccgttcccggttccgtacgttcccggcgttacgttggaccggtcggggtccgtacgggg

SEQ ID NO: 128939 - DNA, 725 bp, Homo sapiens
  misc_feature: GYAE6OF01AE4GM.45.78.H01.1.454.CMB.1.raw
tcagacgcgatcgacacgaccggtgctcgatttagtgtgagtagtttgggtttgggggaggcatcacccagcaaccacatctgtcctctagagaatcccctgagagctccgttcctcaccatggactggacctggaggatcctcttcttggtggcagcagccacgaggacgcccacctcccgaggtgcagcgtgggtagcgagtcgtggggctggaggtgaaggagccgtgggcctgagtgaacggtctaccgtgacgaaggtcctttgaggacttacgacccttcgacccggtctaactagtatacctagtcgggtcgacgtaccgacggtccccgtagggacgaaaggggtcttacgggacggttagggacggtagggtacgttaagggaccttaccgaaaccccgttaaaggaacgttcggggtcggaaacctaacgaaacttacgtacgaacgtacccgaaaggtttacgttaccgaaggggtacgaacgggtacctaacgacgtacgggaaccgtcgggaaaccctccgtaccgacgtaccacggtaccaaccggactaccgttacgacgtacggtacgagttcggaacggaccgtagggtaccgtagaacgtacgtacgtcggaaccgtaccggtacgaccggttagttaccgttgacggttcggacggtacggacgacggtaacgtaccggtttaagttcgggttttaaggtaacggg

SEQ ID NO: 128940 - DNA, 767 bp, Homo sapiens
  misc_feature: GYAE6OF01ACJUI.45.78.H01.1.454.CMB.1.raw
  modified_base (201)..(201): a, c, t, g, unknown or other
  misc_feature (201)..(201): n is a, c, g, or t
  modified_base (217)..(217): a, c, t, g, unknown or other
  misc_feature (217)..(217): n is a, c, g, or t
  modified_base (278)..(278): a, c, t, g, unknown or other
  misc_feature (278)..(278): n is a, c, g, or t
tcagacgcgatcgacacgaccggtgctcgatttagtgtgagtagtttgggtttggggtggaagaagcctggggcctcagtgaaggtctcctaaaagcaaggtcttcctggatacaccttcgaccggctactactatacacgtgggtgcgacgaggcccctggacaagggcttgaggtggatgggatggatccaaccctaanatggtcgcaacaactntgcacagtagttcaggcaggtcacagtgaccgagggcacgtccagtcagcacgagacctanagtggatcgtgagtcgaggtctagagacgtcgtacggaccgtacgaccggtccgttgtacttacgtggtagacgaggacgtacgtaaggttaatttacggttagttttacgggtaggttcggttaacggttacgggacggttacgtcggtaccggttcggtacggggaccgtaaacgggtacctacggtcccgtacccgtcctccgttaccgccgtacccgtacccgaaccggtaaccgggttcccctacgggttccccgttcccgttccccgaccgggtacccctaccccgtacccgacgtaacgtccgtccgtaacccggttcgggacgggtaccgtaaccgtcccgggtaccggtcccggtagggtcccgtccggtcccggttacgggtaacccggtaccggttaacccgttaccggttcccggtaaccggttccggttccgggtcccgttacggtaccggggccggtccggggtcgaacccgggg

SEQ ID NO: 128941 - DNA, 523 bp, Homo sapiens
  misc_feature: GYAE6OF01BK1KZ.45.78.H01.1.454.CMB.1.raw
  modified_base (517)..(517): a, c, t, g, unknown or other
  misc_feature (517)..(517): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccggcagtcagagtattagtaactggttggcctggtatcagcagaaaccagggaaagcccctaagctcctgctctataaggcatctagtttagaaagtgggtccatcaaggttcagcggcagtggatctgggacagaattcacttctacaccatcagcagcctgccagcctgatgtattttcgactaactttattactgaccaatagtatgtatagttattcgacgttacggaccgaagggtccaaggtgaaatacgaaacgtaacgtggtcgactagacctaccgtataccgtgtccttntacccg

SEQ ID NO: 128942 - DNA, 688 bp, Homo sapiens
  misc_feature: GYAE6OF01B83NT.45.78.H01.1.454.CMB.1.raw
  modified_base (216)..(216): a, c, t, g, unknown or other
  misc_feature (216)..(216): n is a, c, g, or t
  modified_base (287)..(287): a, c, t, g, unknown or other
  misc_feature (287)..(287): n is a, c, g, or t
  modified_base (293)..(293): a, c, t, g, unknown or other
  misc_feature (293)..(293): n is a, c, g, or t
  modified_base (345)..(345): a, c, t, g, unknown or other
  misc_feature (345)..(345): n is a, c, g, or t
  modified_base (641)..(641): a, c, t, g, unknown or other
  misc_feature (641)..(641): n is a, c, g, or t
  modified_base (650)..(650): a, c, t, g, unknown or other
  misc_feature (650)..(650): n is a, c, g, or t
  modified_base (680)..(680): a, c, t, g, unknown or other
  misc_feature (680)..(680): n is a, c, g, or t
tcagacgcgatcgacacgaccggtgctcgatttagtgtgagtagtttgggtttgggggtgaaggaagccgtggggccctcagtgaaggtctcctgctaaggcttctggatacaccttcaccggctactatatacactgggtcgcgacagggtccccctggacaagggcttggacgtggatgggattggatcaaccctaacatggtggcacaaactntgcagagtaaggttcgagggcagggtccaccagtcgaccgagggaccacgtccagtcgagcacacgcctanatgganctagagcgaggctggagactcgtcggaccgcgacggtccgtgtaacgttcgnggtacgcgggtaaggcggtacaagggttaattcggttagttttgggagtttaggttacgttcgggtaacggttagtcgggtacgtacgtggggaccaagggaccctacggttccgaccggttcgttacccgtacgtaccgtaccctacccgtaaccggtacgggacccttaccggtccggttacccttccccgtcggtacccctacccgttctacccaaggtaccgtccaccgtcggtccgggacacgacggcccggccgtagggccgtacgtccgtacgtaccgtacggttaccnccgttaccnggtactcggtccggtcgtaggcggtccggnggtacggg

SEQ ID NO: 128943 - DNA, 764 bp, Homo sapiens
  misc_feature: GYAE6OF01DUMQ9.45.78.H01.1.454.CMB.1.raw
  modified_base (258)..(258): a, c, t, g, unknown or other
  misc_feature (258)..(258): n is a, c, g, or t
tcagacgcgatcgacacgaccggtgctcgatttagtgtgagtagtttgggtttgggggagagcatcacccagcaaccacatctgtcctctagagaatcccctgagagctccgttcctcaccatggactggacctggaggactcctctttcttggtggcagcagccaacgaggacgcccactcccgaggtgcagctggtgcagtcgtggggctggaggtgaaggacgccggtagggcctgaggtgaacggtccttcgtnacgtaacgcttcgagtactacctacctcgaccggtatactatactacgagttggtcgcgacgacgccggtaggacgaaggtctaggtacgtaggaggtggtacgtacgtaactaaccgtaaaccgtaacgtaggtcggtagaccaaacgtaacagtcgactacgtaaggttacgttacgggacggtcggtaacggtaccaaccggtacgtacggaaaccggtaacggaacccgtaacgtccgtaaccgtaaccggtacaacccgaaaccgtcccgtaacgaacgtttaacggaacgggtacgtaacggtcgggaaaccggtacgtaacgggtccgttaaggaccgttacggtaccgggaaaccgtaccgggtaaaccgggtcccgggttaacggttttaacgttacggtttacggttacgggacgggaacggtaaacggggtaaccgggttaaaggttaaacgggtttaaaacgggtttttggttaaccggggtttttaaaggggg

SEQ ID NO: 128944 - DNA, 787 bp, Homo sapiens
  misc_feature: GYAE6OF01C24ON.45.78.H01.1.454.CMB.1.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagacgcctggggcctcgagtgaggtctcctgcaaggcttcgtggactacctaccttccaccggtctactatactacacgtgggtgaccggtacacgggcccccttagggaaccgtaaaggggtccgttaggaggtacgggagtaggggacgtagggaactaccgtaaaacccctaagtaaacgtggggttacggaaccaaactaaaacgttactcggaacctaacgtaaggtaacggtttcgaacggggtaccgtagggggacctaacccgagttaccggaacccggtacgggaacccgtaccgttaacccaacgtcccgaacggacccgaaccgaacggtaccctaaccgtacggtacgggtaacgaccgttaggaacggtaccgaacggggtccgttaggagttaaccgtacgtaaccgggaacccgtaccggtacccgggtaccggttacggtttaaacgttccggttaacgggttccgggtaaccggtaaacggggtaaccggggtaccgtaaaacggggggtttaaccttttaacgggtttacggtttttttaaggggggttaaaaccgggg

SEQ ID NO: 128945 - DNA, 612 bp, Homo sapiens
  misc_feature: GYAE6OF01DJZUR.45.78.H01.1.454.CMB.1.raw
  modified_base (282)..(282): a, c, t, g, unknown or other
  misc_feature (282)..(282): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggcctcccaggtgaccaaatgtgacatccagatgacccagtcctccttccaccctgtctgcatctgtaggagacagagtccaccatcacttgcccggccagtcagagtattagtaacgtggttggcctggtatcagcaagaaaccagggaaacnccctaagctcctgctactagtaaggcattcgttaagtttagaaaggttcgggtacccataccgaaggttcaagcggcgtagtggatcgtagggacagtaacttcactctacacaatcagcacgcctggctagcctagattgtattttgaccttaacttacttacgtacgacctaaacgtagtatagtattacgtttacttacggtaccggtttacggaccgaaacggggtaacccaagggttaacgaaacgttaacgaaaaaccggttaattacgggtccggacttacggacctaacccttacgtcgttacgttcctttcctaaccccgg

SEQ ID NO: 128946 - DNA, 686 bp, Homo sapiens
  misc_feature: GYAE6OF01CYL75.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctagagcgaggctgagatcgtgacgacacggccgtgtactactcgtgacgaggaggcgaaggtattacgtagtttttggagttgggttaactttcgggacggttaatcgggtacggttcggtggggacccgaaagggtaccgacgggttaccacccggtactacccgtcgacgtccctaccccgaacccgtaacgggcccctacggttcccgttcccgtttcccccgtaccggtaccctacccccgttacccgtacccgaaccggtaccgacccgtaacccgttccggtaccgggggtacccaccggaaccggcccgggtcccggtgggtcccgtcggcccgtcgggtaccgaacgggtacccttaccgttcccgtacgtacgtccgtcgtcgtggacggccgggtacgtcggg

SEQ ID NO: 128947 - DNA, 662 bp, Homo sapiens
  misc_feature: GYAE6OF01BM1TF.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccaggacacgtccatcagcacagcctacatggagctgagcaggctgagatctgaccgacgaccggccgtgtacttactggtagcggaggaggacgaaggtaattacgtagttttaggagttagggttagttcgggtacggtagtaggtacgtcggtcgggaccgaacgggaccgacggtccgtaccgtctccctcgacgtacccgtcccaccgtacggccctacgttcccggtcccttccccgacgtccctaccccgtccctacccaacgccgccaccgtccggacggggaccaccggtacggcccgggtaccgtcgggcctcggtcccggtacggttaccgaaacggtaccccgttaccgttccccggttacgtaccgttcccggtcggtacgttacggggaccgggccggggtcgtaccgggg

SEQ ID NO: 128948 - DNA, 782 bp, Homo sapiens
  misc_feature: GYAE6OF01C5WR8.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctacaatggtggcacaaactatgcacagaagtttcagggcagggtcaccatgaccagggacacgtccatcagcacagcctacatggagctgagcgaggctgagatcgtgacgacaccggccgtgtattactgtgcgagaggacaggtaattacgtagtttttggaggtttggttacgttcgggacggttagtcggtacgttcggtacggggaccgtaagggggaaccctacgggtaccgtacccggttcccgtcccgttaccgaccggtaccccgttaccccgaaccccggtaaaccggggtaccccccgtaacggtttcccccgggtttaccccgttttccccccccggtaccgggtaccccctaaccccccgtttccccgttaacccgaaaccggtacccggtacccctaaccccggtttcccgggttaccggggggtacccaacccggtaccgggtccccgggtaccccggtcggggtacccgttccggtcccggttacgggtacccgtaaaccgggtaccctttacccggttcccggttacccggtacgttcccgggtccggttaccgtgggaccggtccggggtcgtaccgggg

SEQ ID NO: 128949 - DNA, 683 bp, Homo sapiens
  misc_feature: GYAE6OF01DK20B.45.78.H01.1.454.CMB.1.raw
tcagacgcgatcgacacgaccggtgctcgatttagtgtgagtagtttgggttggggtgaagaagcctggggcctcagtgaaggtctcctgcaaggcttctggatacacccttcaccggctactatatacactgggtgcgacaggccccctggacaagggcttgagtggatgggatggatcaaccctaacaatggtggcacaaactatgcacagagtttcagggcagggtcaccatgaccgagggacacgtccatcacgcacacgcctacagtggagcgtgacgcgaggcctgagtactcgtcgaccgtaccgaccggtccgtagttacttacgtgtacgcggagacggtcgaaggtaagttacgtagttttgggagtttgggttacgttacgggtacggtagtacgggtacgtcgtagggaccgacggtaccgtacggtccgaccgtcctccgtcgacgtccgtacccaccgtacggccctacgtccgtcccgttaccccgcgtaccctacccctccctaccaaccggtcacccgtaaccgtccgggtccggggacctaccgtacgggccccggtcccggtcgggtccttacgggacccgtagggtaaccggaaccggtacccgttaccgttcccgtacgtccgttcccgtccgtacgtagggccggtccgggtcgtaccggg

SEQ ID NO: 128950 - DNA, 633 bp, Homo sapiens
  misc_feature: GYAE6OF01BPHA0.45.78.H01.1.454.CMB.1.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtgggctggaggtgaagagccgtgggcctcgagtgaaggtctccgtgcaaggcttctggactacaccttcaccggctactatatacacgtggtgcgacgacggcccctggacgaaggcgtgagtggagtgggagtggactaccgaaacctaacgtaagtggtagacgaactaaagtagtacgtacaacgtaggtaacgtttacggaggacgtacgggtacacgtagtacgaaccgaggactaccgtacacgtacagaccacgacgacctacgagtacggactcgtacgacgacgagtaacgtgaaccgtactacgtacggaaccgaaccgtaccgaacctttaacgtttaacgttacgtacggtacggaccggttaggtaacgtttcggggtttaccggttagggtttcgtttccggttttccggttttaaccggg

SEQ ID NO: 128951 - DNA, 613 bp, Homo sapiens
  misc_feature: GYAE6OF01CR8ZA.45.78.H01.1.454.CMB.1.raw
  modified_base (560)..(560): a, c, t, g, unknown or other
  misc_feature (560)..(560): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctcctgcaaggcttctggataccaccttcaccggactactatataacactgggtgcgacaggcccctggacaagggcttgagtggagtgggatggataccaacctaacaagtggtagacaacaaactagtagacacgaagtaacggtttacgacggggacgaggggtaccaaccgagtacggaaccgaaggggacctaaccgtacccaagtaccgaacgaccaacgaacgaccctaacgaacgtgggaacgtcgtaggacgacggacggtcgtaggaacgtacgtcgtacggacgaccgtaccgggtccgtagttaacgttagnggttcggacggaggaggacgtaaggtatttaacggttgttttggggtaacggg

SEQ ID NO: 128952 - DNA, 737 bp, Homo sapiens
  misc_feature: GYAE6OF01A74US.45.78.H01.1.454.CMB.1.raw
  modified_base (198)..(198): a, c, t, g, unknown or other
  misc_feature (198)..(198): n is a, c, g, or t
  modified_base (284)..(284): a, c, t, g, unknown or other
  misc_feature (284)..(284): n is a, c, g, or t
  modified_base (298)..(298): a, c, t, g, unknown or other
  misc_feature (298)..(298): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtcctccttccaccctgtctgcatctgtagganacagagtcaccatcacttggccggcagtcagtagttattagtaacgtggttggcctaggtatcagacaacgaaaccgagggaaacncccctaagcctacngtctactagtaacggctattacgttaagtttaaggaaacggtcggggtaccctaagtacgtaaaggttcaggcggacgtaggtaggacgtcgtaggggaactaggtaactttccaacgttcctaccgaacctactacgacgcctacgtcctacgctaacggtcctaggtacttaggtttacttttacggaacttaaacctttacttaccgtacggtaaccctaacgtacgttaagttaacgttacgtttaacggttttaaccgttaccgggtaaccggtttccgggaaacccggtaaacggggtaacccggtaaagggttaaaccggtaaaaccgttaaacccggtaaaaacggttaccggttacgggttacgggtaccctaaccggacctaacccgttagttacccgtttacgtttacccgttaccgtttaacccccg

SEQ ID NO: 128953 - DNA, 630 bp, Homo sapiens
  misc_feature: GYAE6OF01EKMRZ.45.78.H01.1.454.CMB.1.raw
  modified_base (154)..(154): a, c, t, g, unknown or other
  misc_feature (154)..(154): n is a, c, g, or t
  modified_base (211)..(211): a, c, t, g, unknown or other
  misc_feature (211)..(211): n is a, c, g, or t
  modified_base (307)..(307): a, c, t, g, unknown or other
  misc_feature (307)..(307): n is a, c, g, or t
tcagacgcgatcgacacgaccggtgctcgatttagtgtgagtagtttgggtttggggtgaagaagcctggggcctcagtgaaggtttcctgcaaggcttctggatacactttcgctgcccatgccattcattgggtgcgccaggccccccgganaagggcttgagtggatgggatggatcaacgctggcactggttacacagaatattcanagaaattccaggacagagtcacctatttcgagggacatattcgacgaaacacagcctacatggacctgagcagtttgagatctgacgacgaccggntgtcttattactgtgcgaggagggacggggggaggagtattgcgaactaagtgtaattatacgtagtggtacgccgtagttggtagacgtcgtcccggtaggggcccgaacgggtacccgtcggtccacccgttcctccgtcgacgccctacccgaacgaacccggccctacgttcccggtcccttccccgtggcccgcccgtcgcccgtaccgacggacgcccacccgtccgaacgacgccaccgaccgggcccggtccccgtagggccctcggcccgttgggtaaccgtacgtacccgttacctttcccggaccgtaccgg

SEQ ID NO: 128954 - DNA, 813 bp, Homo sapiens
  misc_feature: GYAE6OF01AEVPZ.45.78.H01.1.454.CMB.1.raw
  modified_base (211)..(211): a, c, t, g, unknown or other
  misc_feature (211)..(211): n is a, c, g, or t
tcagacgcgatcgacacgaccggtgctcgatttagtgtgagtagtttgggtttggggctgaggtgaagaagcctggggcctcagtgaaggtctcctgcaaggcttctggatacaccttcaccggctactatatacactgggtgcgacaggcccctggacaagggcttgagtggatgggatggatcaaccctaacatggtggacacaaactntcgcacagagtttcgagggcagggtcaccatcgaccgagggacacgtccatacagcacagacctacagtgggagcgtgacgcgacggctaggacgacttcgacggaccgaccgtaccggtaccgttgttaacgttacgtaggtacggcggagggtacggacgtaacggttaagtttacgttaggttttaggagggtttacggtttagggttccgggtaacggttagtacgggtaaccggttcgggtacgggggacccgtaacggggtacccgtacgggtacccgtacccggttcccgtacccgttaccgaaccgtaccccgtacccgaacccggtaacccggggtcccgtaacgttccccggttaccccgtttcccccggtacggtacccctaccccgttacccgttaccgaaccggacccgtaccccgtaacccggttccgggaccgggggtaccccaacggacccgggtcccggcccgggttaccgggtccggtaccggttccccgggtacgggttaccggtaacccgggttacccgtttaccgttaccccggtacccggtacggttacccggtcccggttacggtccgggtacccgggg

SEQ ID NO: 128955 - DNA, 683 bp, Homo sapiens
  misc_feature: GYAE6OF01B1RG7.45.78.H01.1.454.CMB.1.raw
  modified_base (189)..(189): a, c, t, g, unknown or other
  misc_feature (189)..(189): n is a, c, g, or t
  modified_base (236)..(236): a, c, t, g, unknown or other
  misc_feature (236)..(236): n is a, c, g, or t
  modified_base (251)..(251): a, c, t, g, unknown or other
  misc_feature (251)..(251): n is a, c, g, or t
  modified_base (627)..(627): a, c, t, g, unknown or other
  misc_feature (627)..(627): n is a, c, g, or t
tcagacgcgatcgacacgaccggtgctcgatttagtgtgagtagtttgggtttggggagcatcacccagcaaccacatctgtcctctagagaatcccctgagagctccgttcctcaccatggactggacctggaggatccctcttcgttggtggcagcagccacaggagcccactccagtgcagctggngcagtctggggctgaggtgaagaagccaggggcctgagtgaaggtcncgtgcaaggtcttgnggactacgaccttcgaccggtctactatatacgacgtggggtcacgacgacggcccctaggacaacgggtcttaggaaggtggaagtggggactagggtactaccgaaacccctaaagtaaacggtggttacgggaacctaaacgtaaaaccgttagttcggtaaccaacgtaacgtaaaccggtttgaacggggtacaggggtactaacccgtagacggaaccgacgggttaacgacggttaccagttacgaacgtaccgaacgacgaccttaaccgagttacgggaccgtacgttacgggacgtacggacggtcccgtaagaggtacctacgtacggaacggtaccgaccggtccgttaaggttgttaaccggngggtccgacggtaggacggtacgtaagttaaggttaacgtttaggtttaggtacgg

SEQ ID NO: 128956 - DNA, 715 bp, Homo sapiens
  misc_feature: GYAE6OF01E17S6.45.78.H01.1.454.CMB.1.raw
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtccacatcacgttcggccgggcagtcagagttattagtacgtggttcgccgtggtatcgagacgaagaaaccgaggaaacgcccctaagccttacctgaccttactaagtaacggctattacgttaaggttttaagaaacgggtcgggtacccctaagttaccgaaacggtttcgaggtccggtacgacggtgggtaactcggtaggggaactaacggtaactttccgacttacctaccaaccgtactccgaagacctacggtccgtaggaccacggtaccgtagacgtttacgttagtttacgtaccttaaaccgtttacgttaaccgtacggtaaccctaacgtagttaaggttacgttaagtttaacggttacgttacccgggttaacgttacgggacccggtaaacgggtaccgtaaagggtaacgtaaaacgtaacgtaaaaccgttacgtagggtaccgacgttacgaccgtaccgtacgttccgtacgtttcctccgttaacccg

SEQ ID NO: 128957 - DNA, 621 bp, Homo sapiens
  misc_feature: GYAE6OF01DT5QI.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacagacccctggacaagggcttgagtggatgggatggatcaaccctaacaatggtggcacaaactatgcacagaagtttcagggcagggtcaccatcgaccagggacacgtccatcagcacagcctacatggagctggagcgaggcgtgaggacgtctagacggacacggccgtagtacgttactgtgcgagacggcaggtaacttacggtatttttggagttggttagttacgggacggtagtggacggtcgtaggggacctaagggaccacgggttcaccggttctcctacgacgcccttaccgaaccgaacgggacccagtcccggttacctcccccgtcggcccaccccgttccctaccgaaccgtacgacctacctcggcggggtacctacgacgcggaccctgggctcgccgtggtaccgacggtactccgttccacgtactcccggtcgttaccgtgacggtccgggcgtacggg

SEQ ID NO: 128958 - DNA, 672 bp, Homo sapiens
  misc_feature: GYAE6OF01EIXL0.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgagcgtgagatcagacgacgaccggcgtgtattacgtgtgcgaggaggacgaggtaacttacggtagttttggaggttggttagttcgggaaggttagtcgggtacggtcggtacggggaccgaaacgggacccgacgggtccgtaccgtcctcccgtcgacgccctcccgtaaccgaaccggtcccacgtcccggtcccttcccccgtcggtcccaccccgtccctaccgaacgacgccctaccgtcggtcgggggaccacggtaccggcccgggtcccgtcgggtccgtcggtccgttaccgggtaccgaaaccgggtacccttacccgttcccggttaccgtacgttcccggtccggttcgttacgggacgggtccggggtcgtaccgggg

SEQ ID NO: 128959 - DNA, 788 bp, Homo sapiens
  misc_feature: GYAE6OF01C9AZ4.45.78.H01.1.454.CMB.1.raw
  modified_base (290)..(290): a, c, t, g, unknown or other
  misc_feature (290)..(290): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctccaggtgccaaatgtgacatccagatcgacccagtctccttccaccctgtctgcatctgtaggagacagagtcacatcacgttcggccgggaccagtcagtagttattagtaacgtggttcggccgtggtatcgagacaaggaaaccgaggggaaacncccctaagcctacctgacctactaagtaaggctaagttacgttaaggtttaaaggaaacgggttcggggtacccctaagtaccgtaaacggttcaacgggaccggacgtaagggtaggtaacgttaccggtaaggggaaacctaaggttaaacttttacccaaccgttacctacccaaacccgtacgtaccaacggtaccaacggtccccgttaggaaccgtaacggtccgttaaggtaactttagggtttaactttttacggaaacctttaaacttttaacgttaaccctacggtaaaccctaaagttaaggtttacgttaaggttaacgtttaacggtttaacgtttaccggtaacccgggtttaccggaaaccgggaaaccggggtaacgtaaagggttaaacgaaaaacgtttaaccggaaaaccggttaacgttcggtacgggtacctacggtacctaaaccgttacttacttacggttaccctcgtttaccc

SEQ ID NO: 128960 - DNA, 609 bp, Homo sapiens
  misc_feature: GYAE6OF01DMCC4.45.78.H01.1.454.CMB.1.raw
  modified_base (260)..(260): a, c, t, g, unknown or other
  misc_feature (260)..(260): n is a, c, g, or t
  modified_base (284)..(284): a, c, t, g, unknown or other
  misc_feature (284)..(284): n is a, c, g, or t
  modified_base (303)..(303): a, c, t, g, unknown or other
  misc_feature (303)..(303): n is a, c, g, or t
  modified_base (405)..(405): a, c, t, g, unknown or other
  misc_feature (405)..(405): n is a, c, g, or t
  modified_base (408)..(408): a, c, t, g, unknown or other
  misc_feature (408)..(408): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtcctccttccacctgtctgcatctgtaggagacagagtcaccatcacgttggcccgggcagtcagtagtattagtaacgtggttggcctaggtntcagcaagaaaccgagggaaaccnccctaagcctctgctatanaaggctatcttaagtttagaaaggtcgggtacctagtacgtaaggttcaggtcggacaggtaggacgtcgtagggaactagtaactcactctaccacatcanacncgtcctgactacgctgatgttacttgtactagtttacttaccgtacgacctaagtagtaacttagtaactttaggttacgttaccggttaccggttacgggacccgtaaaggggaaccctaaggggtaaccgtaaatacccggtaaaacgtaggtacggtacggactacgacctactacttccttacgttcttactacccg

SEQ ID NO: 128961 - DNA, 604 bp, Homo sapiens
  misc_feature: GYAE6OF01APYTJ.45.78.H01.1.454.CMB.1.raw
  modified_base (591)..(591): a, c, t, g, unknown or other
  misc_feature (591)..(591): n is a, c, g, or t
tcagacgcgatcgacacgaccggtgctcgattagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagcgtcgagcaggctgagatctggacgacacggccgtgtattacgtgtgcgagagcaggtaattacgtatttttggaggttggttagttcgggacggtagtggtacgttcgtaggggccgaagggaccgacggtcaccggtcctctccgacgcccgtacacccgaagggccccagtccggttacccttccccgtcgcccacccctcctaccgaacgacgcaccctcggtcgggggaccaacgcgacccgggtcgtacgggcctcggcccgtggtccgaacggacccttcgttcccgtcgtacgtcgtccggttcaggccggngggtcgtacgggg

SEQ ID NO: 128962 - DNA, 628 bp, Homo sapiens
  misc_feature: GYAE6OF01EEHNZ.45.78.H01.1.454.CMB.1.raw
  modified_base (293)..(293): a, c, t, g, unknown or other
  misc_feature (293)..(293): n is a, c, g, or t
  modified_base (300)..(300): a, c, t, g, unknown or other
  misc_feature (300)..(300): n is a, c, g, or t
  modified_base (319)..(319): a, c, t, g, unknown or other
  misc_feature (319)..(319): n is a, c, g, or t
  modified_base (337)..(337): a, c, t, g, unknown or other
  misc_feature (337)..(337): n is a, c, g, or t
  modified_base (342)..(342): a, c, t, g, unknown or other
  misc_feature (342)..(342): n is a, c, g, or t
  modified_base (439)..(439): a, c, t, g, unknown or other
  misc_feature (439)..(439): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacacggcccctggacaagggtcttgagtggatgggatggatccaaaccctaacaagtggtggacaacaaaactatcgacaacgaggtaaacgtttcgaggggcaggggtccaccgtatacgaaccgagggaccacgtcatcacgcacagcctanagtgganctgagcgtaggctagagtntcagtacgacacgcgtantctgngtcgagagtactaggtaattgtagtttggagttcggttagtcggacgtgtcggcgtcggtgggaccgaaggaccgtacgtccaccgtctcctcgacncctaccgaccgaccgtccacgtccgtccctcccgtcgccctacccgtcctacacgtcgtccgtaccgtcggaccgacgtaccgcggtcccggtaccgtcggccgtcgtaccgtacggtccgtaaccgtacttaccgtccggtaccgtcgtaccgttccgtccgagggtcccgtacggggtcgtaccggg

SEQ ID NO: 128963 - DNA, 637 bp, Homo sapiens
  misc_feature: GYAE6OF01COLLS.45.78.H01.1.454.CMB.1.raw
  modified_base (192)..(192): a, c, t, g, unknown or other
  misc_feature (192)..(192): n is a, c, g, or t
  modified_base (242)..(242): a, c, t, g, unknown or other
  misc_feature (242)..(242): n is a, c, g, or t
  modified_base (282)..(282): a, c, t, g, unknown or other
  misc_feature (282)..(282): n is a, c, g, or t
  modified_base (359)..(359): a, c, t, g, unknown or other
  misc_feature (359)..(359): n is a, c, g, or t
  modified_base (379)..(379): a, c, t, g, unknown or other
  misc_feature (379)..(379): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggacgcccactcccaggtgcagctggtncagtcgtgggctgaggtgaagaagcgtgggctacgagtgaacggtctccngacgaggtcttcgtggaactactacttcgaccgctaactntaatacacgtggtcgacgacacggccctaggacgaagggtcttaggagtggagtgggatggaactacaacccgtaanaagtggtagacaactaaacntacgactaacgagtaacggtttcgaagggcgaggtacaaccgagtaggaaccgagggactacgtacaacgtgaacgcgtaacacgtaccctacgtagtacggtacgacgtacggacgacgaaggtccgtaggaacgacgttacgacgtaacggacccgtacgggtaccggttaagtacgttaggttacggttcgggaacgacggtaagggacgttaaacgggttaactttacgggtttaaggttttagggttaacggg

SEQ ID NO: 128964 - DNA, 731 bp, Homo sapiens
  misc_feature: GYAE6OF01DSEF2.45.78.H01.1.454.CMB.1.raw
tcagacgcgatcgacacgaccggtgctcgatttagtgtgagtagtttgggtttgggggagagcatcacccagcaaccacatctgtcctctagagaatcccctgagagctccgttcctcaccatggactcgaccgtggaggatcctcttcgttggtggcagcagccacgaggcgacccactccgaggtcgacagtctggtcgacgtacgtcgtcggggctaggaggtagaacgacgtccgtgggcctacgagtacggacgtctcgtgacgtaagtccgttcgtaggtactaccgtaccttaccgaccgtacttacgtaacgttactaccgtacggtgggtacgaccgtaacgaccggtcccgttagggaaccgtacggtcgttacgggacggtacgggtaaggtggaagttcggtaactaaccgtaaacctaacggtaacgtcgggtacgaactaaaccgtaaacgttacgtacgaccaacggtaaaggttacgtttacggacgggtcgtaacgggtccaacgagtacgggaaccgaggtacctacggtaccagtaccgtacgaccacgactacccgttaagcggtacgaacgtcgtaggaccggtacgtacggtagtacgaacgtcgtaaccggtccgaacgtccggtacggtccggttaaacttcgtaacgtcgacggcgtaaacggtaccggtaaggttaggttaaacgttggttttagggttaacggg

SEQ ID NO: 128965 - DNA, 729 bp, Homo sapiens
  misc_feature: GYAE6OF01BKYCS.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatcggtggcacaaactatgcacagaagtttcagggcagggtcaccatcgaccagggaccacgtccatcagcacagccctacagttggagctgacgcgaaggctaggaacgatcgtacggaccgaacgacggtccggtagtacgttacgtggtagacggtaaggacggacgtaaggtaacttacggttaagttttggaggtttggttaagtacgggtacggttagtcgggtacgttccgggtacggggccgtaaaacggggcccgtacgggttaccgtacccgttctccgttaccgacgtcccttacccgaaccggaaccgggtacccgtaaccggttcccggttaccccgttcccccgtcggtacccctaccccgtcccgtaaccgaaccgacgacccgtacccgtccgggtacggggtaccaaccggacgggtcccggtacccgtcgggtaccgtcggtacccgtcggtaaccgtacggtaccgttacgttcccgtacgtacgtccgtaccgtacgtaggcggtcgggtcgtaaccggg

SEQ ID NO: 128966 - DNA, 654 bp, Homo sapiens
  misc_feature: GYAE6OF01DP208.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcatcggctactatatacactgggtgcgacaggcccctggacaagggcttgagtggatgggatggatcaaccctaacaatggtggcacaaactatgcacagaagtttcagggcagggtcaccatgaccaggacacgtccatcagcacacgcctacagtggagcgtgacgcgaggtcgtacgagatcgtacgaccgacgaccggtccgtgtaacttactgtggcgaggaggacgaaggtaacttacgtagttttaggagtggttagttcggtaggtgtcggtacggtcggtacggggacgaacgggaccgacgtccaccggttctccctacgacgccctaccgaaccgaccgggacctcgttcccggttcccttcccccgtgtacccctacccgtccctacccgaaggccgtacctccccggtcgggtacggggccctacggccggtcccggcccgtggggtacctccggtccgtacgggtcctaacggtacccttaccgttcccgtagtaccgtccggtccttacggtaggcggccgggtcgg

SEQ ID NO: 128967 - DNA, 583 bp, Homo sapiens
  misc_feature: GYAE6OF01BTTSN.45.78.H01.1.454.CMB.1.raw
  modified_base (253)..(253): a, c, t, g, unknown or other
  misc_feature (253)..(253): n is a, c, g, or t
  modified_base (291)..(291): a, c, t, g, unknown or other
  misc_feature (291)..(291): n is a, c, g, or t
  modified_base (348)..(348): a, c, t, g, unknown or other
  misc_feature (348)..(348): n is a, c, g, or t
  modified_base (355)..(355): a, c, t, g, unknown or other
  misc_feature (355)..(355): n is a, c, g, or t
  modified_base (360)..(360): a, c, t, g, unknown or other
  misc_feature (360)..(360): n is a, c, g, or t
  modified_base (365)..(365): a, c, t, g, unknown or other
  misc_feature (365)..(365): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtagaagaagccgtggggcctgagtgaggtctccgtgcaaggcttntggatacaccttcaccggctactatatacacgtgggtncgacgacggccctaggacgaagggcttggagtggagtgggatggatccaaacctaanagtgtanacaanaactngacagagtagttcgaggctagggtacactagtcgacgaggacacgtcagtcgagacacagtaccctagagtacggacgtcgagacgacgagggtactaggaacgtcgtaccgagggaccgaacgccgggttaccgttaggtactttacggacggtcggaacggtacggaacggtaggtaaacggttaagtttacgggtttaaggttttcgggtaaggg

SEQ ID NO: 128968 - DNA, 642 bp, Homo sapiens
  misc_feature: GYAE6OF01CJ1MH.45.78.H01.1.454.CMB.1.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtgggctgaggtgaagaagccgtgggcctcgagtgaggtctctgcgagcttcgtgatactaccttcgaccggtctactatactacacgtgggtcgcgacgacggccccgtaggacgaagggtcttagaggtggagtgggatacggtaactaccgaaaccgtaacagtgggtacggaactaacaaactagtacgacaagtaagtaagtttcgacgggctacggtacgaccgagtacgacgacggacgtacgtacacgtacgacgacgacgacgtaccgtaacgtacgtacggacgtacgtacgacgacggacggtacgtacggtagtacgtacgtacggaacggaccggtaccgtccggggggttaattacggttacggtacggtcggacggaaggacggtaacggtaaggttaaggtttaacggtttaggtttagggtttaacggg

SEQ ID NO: 128969 - DNA, 741 bp, Homo sapiens
  misc_feature: GYAE6OF01CHG8K.45.78.H01.1.454.CMB.1.raw
  modified_base (641)..(641): a, c, t, g, unknown or other
  misc_feature (641)..(641): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacacggcccctggacgaagggcttgagtggagtgggatggataccaaaccctaaacaagtggtggacaaactaaaactatcgacaactaagtaagtttcgaagggcgaagggccaccagacgaacgagggacacgtccatcagcacagcctacagtgagctgacgcgaggctgagctcgacgaacgaaccgacggtccgtagtacgttacgtggacgacggaggacggacgaaggttaacgttagttagttttaggacgtttagggttagtacggtaggtagtggtacgtcgggtacgggacgtaacgggacccgtacggtaccctaccgttcgtcctaacgcgtacccctacccgaaaccggaaccgtccctaacggttccccggttccccgtaccccggtacgtccccgtaccccctaccgtaccgaaaccgcccgtaccgtaaccggtcccgggacggggtacccaaccgggccggtccccgggtcccgtacgggtccnccgggttaccgtagggtaaccgtaacgggttaccctaccctttccggccgacgtttccccggaccggttacgtaggggacccggtccgggtaagtccggg

SEQ ID NO: 128970 - DNA, 610 bp, Homo sapiens
  misc_feature: GYAE6OF01EQAGF.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgtagttttggagttggttagtcgggtacggtagtggtacgtcgtggggaccgaagggaccgacggtcgaccgtcctccgtcacgtccctcccaaccgaacggcccagtccggtccttcccccgtcggccctacccctccctacccgaacgacgccacctccgtcgggggacaccgacggccggcccgtcgggcctcggcccgtcggtaccgtaacggtaccttaccgttcccgtaccgtacgtcccggtccgttcgtcggacgccgggtcgtaccggg

SEQ ID NO: 128971 - DNA, 747 bp, Homo sapiens
  misc_feature: GYAE6OF01C29G4.45.78.H01.1.454.CMB.1.raw
tcagacgcgatcgacacgaccggtgctcgatttagtgtgagtagtttgggtttgggggagcatcacccagcaaccacatctgtcctctagagaatcccctgagagctccgttcctcaccatggactggacctggagatcctcttcttggtggcagcagccacaggacgcccactcccgaggtgcagctggtgcgagtcgtggggctggaggtgaagacgccgtggggcctcaggtaggaacggttcctccgtggacgaacgggtcttcgtaggtactacctaccttaccgaccggtacttaacttaatacgtaaccgtcggtgggtacgacggaccgaccgggtcccgtacgggaacggaacgggtctttagggaggttgggaaggtacgggtagtaacgggactaacccgtaaacctaagtaggtcgggtacgaacctaaacgtaacgtagtcgaaccaagtaacggttaacgtacgggacgggtacgtaccgggtacctaacgtaggtaaccgaaccggtaacggtaaccgtaccgtacctaacgacgaaccgtacgaacgaccgacttaacggagttacgggacgtaggtacggaacgacggtaaggtccggtaagacgtcttacggacgggtaaccgccggtaacgtccggttaagttaccgtgggttcggacgggtacgggaacggacgggtaaacgttacggttaacggttttaccggttaaagttttcggggttaacggg

SEQ ID NO: 128972 - DNA, 573 bp, Homo sapiens
  misc_feature: GYAE6OF01BL18Y.45.78.H01.1.454.CMB.1.raw
  modified_base (331)..(331): a, c, t, g, unknown or other
  misc_feature (331)..(331): n is a, c, g, or t
  modified_base (476)..(476): a, c, t, g, unknown or other
  misc_feature (476)..(476): n is a, c, g, or t
  modified_base (493)..(493): a, c, t, g, unknown or other
  misc_feature (493)..(493): n is a, c, g, or t
  modified_base (521)..(521): a, c, t, g, unknown or other
  misc_feature (521)..(521): n is a, c, g, or t
  modified_base (551)..(551): a, c, t, g, unknown or other
  misc_feature (551)..(551): n is a, c, g, or t
  modified_base (567)..(567): a, c, t, g, unknown or other
  misc_feature (567)..(567): n is a, c, g, or t
tcagacgcgatcgacacgaccggtgctcgattagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaacctaacaatggtggcacaaactatgcacagtaagtttcgagggcagggtcaccatgaccagggacacgtcatcagcacagcctacagtggagctaggagcgaaggctaggacgtatcgtaggaccgacgaccgggtccgtagtaacttcgnggtgcggaaggaggcaaggtacttacgttagttttaggagttaggttagtcgggtacgtagtcggacgtcggtcggggaccgaaacgggcctacggtccgaccgtctccgtcacgcctccgacgacggccagtccgtcctcccgngcctaccctctacgacncgcacgtcgtcgggctacgcgccgccgngctcgcgtagacgacgtactctcgcgtacnccgtctcgagcgcggngtacgg

SEQ ID NO: 128973 - DNA, 591 bp, Homo sapiens
  misc_feature: GYAE6OF01AO2N3.45.78.H01.1.454.CMB.1.raw
  modified_base (256)..(256): a, c, t, g, unknown or other
  misc_feature (256)..(256): n is a, c, g, or t
  modified_base (274)..(274): a, c, t, g, unknown or other
  misc_feature (274)..(274): n is a, c, g, or t
  modified_base (355)..(355): a, c, t, g, unknown or other
  misc_feature (355)..(355): n is a, c, g, or t
  modified_base (557)..(557): a, c, t, g, unknown or other
  misc_feature (557)..(557): n is a, c, g, or t
tcagacgcgatcgacacgaccggtgctcgatttagtgtgagtagtttgggtttggggagagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaaagaagccgtggggcctcgagtgaaggtctcctgcaaggcttcnggatacaccttcaccggntactatatacactgggtgcgacgacggcccctaggacgaagggtcttggaggtggagtggggatggactacgaaacctaanaagtggtgacaacaaactagtacgacaacgaagtaacgtttacgaagggcgtaacgggtacaaccgtagtacgaaccggaaggaccaaccgttaccaagtaccgaagtaccaacctaacgcccgtaagacgtacggacgtcgtaggacgcgggtacggacgacggaaggactcgtaagacgacgtacggcgtacgtatacgngtcgacgagacgtacgagtacttagtagtttagg

SEQ ID NO: 128974 - DNA, 709 bp, Homo sapiens
  misc_feature: GYAE6OF01BAUPI.45.78.H01.1.454.CMB.1.raw
  modified_base (335)..(335): a, c, t, g, unknown or other
  misc_feature (335)..(335): n is a, c, g, or t
  modified_base (679)..(679): a, c, t, g, unknown or other
  misc_feature (679)..(679): n is a, c, g, or t
  modified_base (685)..(685): a, c, t, g, unknown or other
  misc_feature (685)..(685): n is a, c, g, or t
  modified_base (704)..(704): a, c, t, g, unknown or other
  misc_feature (704)..(704): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggagtgggatggatccgaaaccctaaacaagtgggtcggacaactaaaactatgacaacgagtaaggttttcgagggctagggtccaaccagtacgaccgagggaccaccgtccatcgacgacacgaacgtcctacagtggagtcgtggacgcgaggtccgtaggacgtntacgtacggaccgacgtaccggtcgttagtaacttacgtcggagacggaggacgacgtaaggtaacgtttacggttagtttttagggaggtttacggtttacgttcggggtaacggttacgtcggtacgttcgggtcggggtaacgaacgggtaccctacgggtaccgtccgttacgtcccgtccgtacgtccctaccgaaccgtaccggcccgtaccgttcccgtccccgttccccgacggtcccctaccccgtaccgtacccgaagtacccgtccgtaccgtcgggacgggcaaccggcgtcccgcgtcgccgtcgcgttacgacgtcgtaccttcgtccgngtaccncggtcggtcaggcgtcggngtcgg

SEQ ID NO: 128975 - DNA, 699 bp, Homo sapiens
  misc_feature: GYAE6OF01CFW4Z.45.78.H01.1.454.CMB.1.raw
tcagacgcgatcgacacgaccggtgctcgatttagtgtgagtagtttgggtttgggggagcatcacccagcaaccacatctgtcctctagagaatcccctgagagctccgttcctcaccatggactggacctgggaggatcctcttcttggtggcagcagccacaggagcccactcccaggtgcagctggtgcagtcgtggggctgaggtgaagaagccgtggggcctcgagtgaacggtctcctgcgaaggcttcgtggactacaccttcgaccggtctacttatactacgacgttggggtcgacgacgacggcccctagggaaccgaagggtctttggaaggtggagtggggactgggactaccaaacccgtaacgaaagttcgggtacggaccaacgtaaaacgtataggacctaaaccgtaaggtaaacggttttccgaacggggtacgtaaccgggggttaccaacccgtaagtaccggaacccgggaacgggaacccgtaacccgtacaacgtaccgaacgaccaaccgacgacccctaagtacgtacggaagtcgtagacggtacgacgggtctaggacgactacgtacggaccgacggtaccggtaccgttgttaacgttacggttggtcggtacgaaggtaccggtacgtaaaggttacgttttaaacggttaggtttttgggtaacggg

SEQ ID NO: 128976 - DNA, 721 bp, Homo sapiens
  misc_feature: GYAE6OF01EU4KX.45.78.H01.1.454.CMB.1.raw
  modified_base (275)..(275): a, c, t, g, unknown or other
  misc_feature (275)..(275): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaacctaacaagtggtggcacgaaactatgcacagaagttcaggcagggtcaccatcgaccacgggacaccgtccatcagcacacgcctacatggancgtgagcgacggctaggacgtagtcctacggaccggaccgtaccgggccggtagtaacgttacgtggtacggacggtagggacggaccgtaagggtaaacgttacggttaagttttgggagttcggtttagttacgggtacggttagtcgggacgttcggcggggtaaccgaacgggtaccgaccgggttaccgtcccggttcctcccgtacgtaccgtccccgtaccgaacccgtaaccgggtccctaacgtcccggtttccccgttcccccgtccgggtaccccctcccgttacccctaacccgtaaccgacgtacccgtacccgtcgggtccggggaccaccggtacggcccgggtacccggtcgggtacgtccggtccgtacggtaccgacggtaccttacgttcccgcgtacgtcgtcgtcgacgcgggcggtcgtacggg

SEQ ID NO: 128977 - DNA, 740 bp, Homo sapiens
  misc_feature: GYAE6OF01CEVXU.45.78.H01.1.454.CMB.1.raw
  modified_base (188)..(188): a, c, t, g, unknown or other
  misc_feature (188)..(188): n is a, c, g, or t
  modified_base (306)..(306): a, c, t, g, unknown or other
  misc_feature (306)..(306): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacacgtgggtgcgacaggcccctggacaagggcttgagtggatgggatggatcaacctaanatggtgcaacaaactatgcacagtaagttcgagggcacgggtacaccgatcgaccgagggaccacgtccatcgagccaacagcctacgagtggacgtctaggacgcgaggctaggagngtcgtagacgacgtacggccgttagtacttacgtggtcgacggaggtacgacgtaagggtaactttacggttagtttttacgggaaggtttgggttaaacgttacggggtacggttagtacgggtaccggttcggtaaccggggtaccgtaaacgggggacccttaacgggtacccgtaacccgtttccgtacccgtaccgtaccgttacccaccccggtaaaccggaaaccgggtccctaacgttcccggtttaccccttaccccggtccggtaccctacccccggttcctacccgtaacgaccgtccgtacccgtcgggtaccgggctaaccggacggtcccgccggtggccgtccgccgtacggtacgtaacgtccgttaccgtccgtacccgtagtcccgtacgttcggagaccgggtcggtcggtacgg

SEQ ID NO: 128978 - DNA, 780 bp, Homo sapiens
  misc_feature: GYAE6OF01DJ2DI.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaaccctaacaatggtgcacaaactatgcacagaagtttcagggcagggtcaccatgaccgagggacacgtccatccagcacagcctaacatggacgctgagcgaggctgagatctaggacgacgacggtccgtgtattacgtgtagcggagagacgaggtaacttacgtagtttttggagtaggtttagttcgggtacgtagtggtacggtggtacgggaccggaaacgggtacccgacgggtccgtacccggttcctcccgtaccgacgtccccgtaccccaccgggaaacccgggtcccctaacgttccccgggttacctttcccccccggtcggtaccccccgtaccccttcccccgttaacccgaagggaacccgtccccgtaacccggttcccgggtaccggggggacccgaaccggtacccgggggtacccgggtccccccgggttcgggggtaccccttcggggttaccccgtcgggggttaaacccctaaacgggggtttaaccccttaccccgttttacccggacccggttaaccgttccccgggtaccgtttcccgggtaggtacccggggtcgggccggtaaccggggg

SEQ ID NO: 128979 - DNA, 690 bp, Homo sapiens
  misc_feature: GYAE6OF01ENY0C.45.78.H01.1.454.CMB.1.raw
tcagacgcgatcgacacgaccggtgctcgatttagtgtgagtagtttgggtttgggggagagcatcacccagcaaccacatctgtcctctagagaatcccctgagagctccgttcctcaccatggactggacctggaggatcctcttcttggtggcagcagacacaggagcccactcccgaggtgcagcgtggtgcagtcgtggggctggaggtgaagaacgccgtgggcctcgagtgagtctccgtgacgaggtcttcgtggtactacgaccttcgaccggtctactaatatacgtacgtgggtacgccgacacggtccccgtaggaaccgaacggtcttaggagtgggagtgggagtacggactaccaaccgtaagagtcgggtacgacaactaaactgtacgactaacgtaaggttaacgttacggacgggtaccgtaacgggtaccaaccggtaacgtacggaacccggtaacgggtaaccctaaccggtaccgtaacgtaccggaacgtacccaaaccgtaccgtaaccccgtaacgtaacggttcggaacgtcggtacggaacggcggtaacggcgtagacggtacgtacgtacggaccgtaacggaccggtacgttattacgttcgtgggtacgacggtaggacggtacgtaagggtttaacgttaggtttaggttttagggg

SEQ ID NO: 128980 - DNA, 731 bp, Homo sapiens
  misc_feature: GYAE6OF01EJNVW.45.78.H01.1.454.CMB.1.raw
  modified_base (276)..(276): a, c, t, g, unknown or other
  misc_feature (276)..(276): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcaacaaactatgcacagaagtttcgaggcagggtcaccatcgaccagggacacgtccatcagcacacgcctacagtggancgtgaagcgaaggctagagtactcgtagaccgaccgaccggtccgttagttacttaccgtgtcggacgaggacggtacaaggtaacgtttacggttagtttttggggaagtttgggtttaacgtcgggtaacggttcgtcgggtacggtcgtacggggaaccgaaggggtaccctacgggtccgtaccgtccctaccgtccgacgtcccctacccgtaacccggaaccgggtacccctacgttcccgggttacccctttcccccggtaccggtacccctaccccgtcccgttaacccgacgtaccgcccgtacccgtcgggtccggggacctacggacggccggtcccggtcgggtccgtcggtcccgtcggtaaccgaaccgggttacccttacccgttccgtaccgttcgtacccggttccgttacggtaggcccgggcgggtccggtacggg

SEQ ID NO: 128981 - DNA, 701 bp, Homo sapiens
  misc_feature: GYAE6OF01BCMJS.45.78.H01.1.454.CMB.1.raw
  modified_base (284)..(284): a, c, t, g, unknown or other
  misc_feature (284)..(284): n is a, c, g, or t
  modified_base (331)..(331): a, c, t, g, unknown or other
  misc_feature (331)..(331): n is a, c, g, or t
tcagacgcgatcgacacgaccggtgctcgatttagtgtgagtagtttgggtttggggcgtgaggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgancgagctgagatctgacgacacggccgtgtacttactcggtgcgtagnggcgaaggaatttaccgtagtttttgggacgtttagggtttacttcgggaaccgggtttatcgggacggttcgttcgggggaccaaacgggggtaccctaacgggttccgtaacccggttccgtcccttcgaacggtccccttcccgaacccgtaaccggggccccgtaacgttcccgggttacccgtttcccccccggtaggtccccgtaacccccttcccgttacccgaacgaccggaccgtaacccgttccgttacgggggaccacccgtaacggccggtcccgtcgggtccctggacccggttgggtaccgaagggtacccttaaccgttccgtaccggacttcccgcggttaccgtggaaccggg

SEQ ID NO: 128982 - DNA, 722 bp, Homo sapiens
  misc_feature: GYAE6OF01C9XJA.45.78.H01.1.454.CMB.1.raw
  modified_base (272)..(272): a, c, t, g, unknown or other
  misc_feature (272)..(272): n is a, c, g, or t
  modified_base (308)..(308): a, c, t, g, unknown or other
  misc_feature (308)..(308): n is a, c, g, or t
  modified_base (382)..(382): a, c, t, g, unknown or other
  misc_feature (382)..(382): n is a, c, g, or t
  modified_base (414)..(414): a, c, t, g, unknown or other
  misc_feature (414)..(414): n is a, c, g, or t
tcagacgcgatcgacacgaccggtgctcgatttagtgtgagtagtttgggtttgggggagtcagacccagtcaggacacagcatggacatgagggtccccgctcagctccgtggggctcctgctgctctggctcccgaggtcgacctaaatgtgacactccagactcgacccagtcctcctcccacctgtctgctagtcgtagtaggagacaagtacgtaccaccatctacgtcggccggccagtcagtagtatagtagtggtcgctgtacncgagacaacgaacgaggaacctccgtaagctaccgngtacctactaagtacgtctagtgttaaggtaacggaacgggtccggtacctagtacgtaggtacgaggccgagnggtacgacgtacggtaggaactagtactaccnctactacaactacgacacgtcgacgccgtagccgacgtcgtaagtacgttagttaacgttaccgtaactttaacttacgttactaaccggtaaccctaagttaacggttataacggttaacggttttaaggttaaccgttaccgggttaacccgggtacgggtaaacccggtaaaccggggtaaaaggtaaacgggttaaaccggtaaaacggtaaacccggtaaaaccggttgtaacggggttccgacggttaacccgtaaccctacgtttaactacccggttcgtttacccccgtgttaaaccccg

SEQ ID NO: 128983 - DNA, 671 bp, Homo sapiens
  misc_feature: GYAE6OF01BWQ1O.45.78.H01.1.454.CMB.1.raw
  modified_base (277)..(277): a, c, t, g, unknown or other
  misc_feature (277)..(277): n is a, c, g, or t
tcagacgcgatcgacacgaccggtgctcgatttagtgtgagtagtttgggtttggggtgaagaagcctgggcctcagtgaaggtctcctgcaaggcttctggactacgaccttcaccggctactatatacactgggtgcgacaggcccctggacgaagggcttgagtggatgggatggatcaaccctaacaatggtggcaacaaactatcgcacagtaagtttcagggcagggtcaccatgaccagggacacgtccatcagcacagcctacatgganctgacgcgaggctagagatctgacgaccgacggccgtgtacttacgtgtcgcgaggaggacaggtaacgttacgttagttttagggagtttgggttacgttcggtaacggttagtacggacggttcggtcggggaccgaacgggtacccgacggtccgtaacccggttcctcccgtacgtacgtacccctaccgaaccgaaccgggtccctaacggttcccgggttacccctttcccccgcgggtaccctacccctcccgtaacgaaccgctacccgtaccgtccggtcggggaccaccgacgggcccgtccggtcggcctcggtcccgtaggaccgtacggtaccttaccgtcccgtacgcgtacggtcgtcgtagccgggtcggtcgtcggg

SEQ ID NO: 128984 - DNA, 675 bp, Homo sapiens
  misc_feature: GYAE6OF01EUHO0.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacacgcctacactggagctgagcgaggctagagactcgtgacgacgacggccgttgtacttacgtgtcgacgtagaggcgaaggtaacttacggtattttgggaggtttcggttaagttcgggtaacggttagtcgggacgttcgtggggacctaacgggaccctaacgggtccaaccggttcctcccgtacgaccgtccctacccaaccgacgggccctacgtcccggtccttcccccgtcgccctacccctcctaccgaacgcgcctacccgtcggtcggggaccaccgacggcccggtacccgtgggcctaccggtccgtacggtaccgtaacggtaccttaacccgttcccgtacggtacccgttcccggtaccggttaccgtgggtaacccgggtcggggtaccgtaccgggg

SEQ ID NO: 128985 - DNA, 591 bp, Homo sapiens
  misc_feature: GYAE6OF01BPPGI.45.78.H01.1.454.CMB.1.raw
tcagacgcgatcgacacgaccggtgctcgatttagtgtgagtagtttgggtttggggctgaggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctagagcgaggctgagatctgacgacaccggcgtagtattacgtgtgcgagaggacaggtaagttacgtagttttggagttaggttattcgggacggtagtggacggtcgtggggaccgtaacggggaccgtacggtctaccgtctcctcacgcctccaccgacggccctagtccggtccctccccgtgccctaccctcctaccgaacgcgcctaccgtcggcgggaccacgcggccggtccgtgggcccgtcggcccgtggacgtacggtaccttacgttcccgtacgtacgtcggtcgttcgtggaccggg

SEQ ID NO: 128986 - DNA, 808 bp, Homo sapiens
  misc_feature: GYAE6OF01EPHDA.45.78.H01.1.454.CMB.1.raw
  modified_base (188)..(188): a, c, t, g, unknown or other
  misc_feature (188)..(188): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaanaagtggtggcacaaactatgcacagaagtttcagggcaggtcaccatgaccgaggacacgtccatcagcacagcctacagtggagctgagcgaggctgagatctacgacgacgaccggtccgttagttacgttacgtgtaggacgaaggacggacgtaaggtaactttacggttagtttttgggaggtttggtttaacggttacgggtaacggttagtacgggtacgttcgggtacggggtaaccggtaaacggggacccgtaccgggtaccgtaacccggttcccttacccgtaccgtaccgtaccccgtaaccccgaacccggtaaccgggccccttaacggttccccgggtttccccctttacccccggtccggtaccccctaccccccgttacccgtaaccccgaacggaccgtacccctacccggttccgggaccgggggtaccccaccgggacccgggtccccgggtccccgggtacggggtcccgttccggtccccggttacgggtaaccggtaaacccgggttacccgtttaccccgttcccggtacccgtaaccggttcccgggtccggtttaccggaccgggtaaccgggtccgggttacggtaccgggg

SEQ ID NO: 128987 - DNA, 647 bp, Homo sapiens
  misc_feature: GYAE6OF01DQXJU.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctaacagtggagctgagcgaggctgagactctacggacgaccgtacggccgttgtatttacgtggtgcgagagacgaaggtaattacgtagtttttggagttggttacgttcggtacggttagtcgggaccgttcgtcggggactaaacgggcccgtacggtccgaaccggttcctcccgttaccgacggtaccctacccgaccgaacgggccctaccgttccgggttcccttccccgtccggccctaccccgtcctacccgaagtcgccctaccgtcggtcggggccacgacggtcccggccggtcggccgtcgtcccgtcggtacgaacggtaccctacgttcctacgtcgtacgtccgtacgtggacggcgggtcgtacggg

SEQ ID NO: 128988 - DNA, 575 bp, Homo sapiens
  misc_feature: GYAE6OF01DV292.45.78.H01.1.454.CMB.1.raw
  modified_base (188)..(188): a, c, t, g, unknown or other
  misc_feature (188)..(188): n is a, c, g, or t
  modified_base (545)..(545): a, c, t, g, unknown or other
  misc_feature (545)..(545): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaanaatggtggcaacaaactatgcacagaagtttcagggcagggtcaccatgaccagggacacgtccatcagcacagcctacatggagctgagcaggctgagatctgacgacgacggccgtgtattactgtgcgagaggcaggattacgatttttggagttggtattcggacggttatggtacgtcgtggggccaagggaccgacggtcgaccgtctcctcacgcctccgaccgaacggcccagtccggtccttaccccgtcggccctacccctcctacccgaacgacgccctaccgtccgtcgggggcacgacgccggcccgtcggcgtcgccgtggtacgaacggtacctacgttccncgtactcgtcgtcgtgcggcggcgtacggg

SEQ ID NO: 128989 - DNA, 724 bp, Homo sapiens
  misc_feature: GYAE6OF01CHUT6.45.78.H01.1.454.CMB.1.raw
tcagacgcgatcgacacgaccggtgctcgatttagtgtgagtagtttgggtttggggagagcatcacccagcaaccacatctgtcctctaagagaatcccctgagagctccgttcctcaccatggactggacctggaggactcctctttcttggtggcagcacgccacaggacgcccactcccgaggtgcagcgtggtgctagtcgtgggctggaggtgaaagaacgcggtcgggctcgagtagaacggtcctcgtgacgaaggtcttcgtaggactacaccttcgaccggtattactatactactaggtgggtcgacgacgaccggtccgtaaggacgtaacgggtcgttaggtacggtaggagttgggaagtacgggaacttaaccgaaaaccgtaaaccgtaaaggttcgggtacgaaccgaaacgtaaaacgtgtacgtaacgaacgtaaacggtaaagtttccgagggtacgaacgggtaccaacgaacgtacggaaccgaagggtaacaacggtaaacacgtacgacgacaaacgtaccgtaccgtaacgtaacggtagggaacgtacgtaacggacggtaacgaacggtcgtaaggaacgtacgtaacgtaacggaaccggaaccgtaaccgggttcgttaaaggttaacgtttacgacgggtacgaggtaaaggacggtaaagtacggtaaaactttggtttaacggttttagggg

SEQ ID NO: 128990 - DNA, 609 bp, Homo sapiens
  misc_feature: GYAE6OF01AT7AM.45.78.H01.1.454.CMB.1.raw
  modified_base (273)..(273): a, c, t, g, unknown or other
  misc_feature (273)..(273): n is a, c, g, or t
tcagacgcgatcgacacgaccggtgctcgatttagtgtgagtagtttgggtttggggctgaggtgaagaagcctggggcctcagtgaatgtctcctgcaaggcttctggatacaccttcaccggctactatatacactgggtgcgacaggcccctggacaagggcttgagtggatgggatggatcaaccctaacaatggtggcacaaactatgcacagaagtttcaggggcagggtcaccatgaccagggacacgtccatcagcacagcctanatggagctgagcaggctgagatctgacgacgacggccgtgtacttacgtgtgcgtagaggcgaacggaattacgtagttttggagtggttagttcgggtaggtatggacgtcgtggggaccgaagggaccgacggtcgtaccgtctccctcgacgtccctacccaccgaacgggccctacgtccggtcccttcccccgtcggccctacccgtcccttaccgaacgaccgtcctaccctcggtacggggccacgacggccggtacccgtcgggccgtcggtccgtagggtccgtaacggtaccttaccgttccgacgtactcgccggttcgtacggg

SEQ ID NO: 128991 - DNA, 972 bp, Homo sapiens
  misc_feature: GYAE6OF01CHJUM.45.78.H01.1.454.CMB.1.raw
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatcgacccagtcctcccttcccaccctgtctgcattcgtggtaggagacgagagtccaccatccacgttcggcccggccagtcgagtagtattagtacgttggtcgtcgtagtactacgagtacgaacgaaaccggaacgggaaacccgtaccccgtaacgtcccttaccgtcggtaccttaacgtaacgtaaccggaccttagttaaccggtttaaggtttaaacgggtaaacgggtttcccggggtaccctaagttaaccggtaagggttaccgtaacggggtacccggtacgtagggttacgggtacgttaccggtaacggggtaactaacggttaactttacccgtaaccttcccgtacctaacccgtactaccggaaccgtccgaaccccggttcgtaccggaaccctaggttacccgttaaggttaacccggttttagttttaaaccggttttacccgttaaaccttttaaaacccgtttttaccggttaccgaaccccggttaaaactaaaccgggttttaacggtttaacgtttaaagggtttaaccgtttttaaaccggtttacccgggttttaacccgggggtttaaccccccggggtttaaacccggggaaaacccggggttaaaaaccccggggggttaaacgggttaaaacggggttaaacccgggaaaaacccttaaaccggggtttaaaaacccggtcgggttttacggggtaccggtaaacccgtaccccgttaaccccgtaaaccgtttccggtttaccggtttttaccccgtccgtttttaaacccttaccccccgg

SEQ ID NO: 128992 - DNA, 844 bp, Homo sapiens
  misc_feature: GYAE6OF01CFJB7.45.78.H01.1.454.CMB.1.raw
  modified_base (291)..(291): a, c, t, g, unknown or other
  misc_feature (291)..(291): n is a, c, g, or t
  modified_base (301)..(301): a, c, t, g, unknown or other
  misc_feature (301)..(301): n is a, c, g, or t
  modified_base (316)..(316): a, c, t, g, unknown or other
  misc_feature (316)..(316): n is a, c, g, or t
tcagacgcgatcgacacgaccggtgctcgatttagtgtgagtagtttgggtttgggtgaagaagcctggggcctcagtgaaggtctcctgcaaggcttctggatacaccttcaccggctactatatacactgggtgcgacaggccccctggacaagggcttgagtggatgggatggatcaaccctaacaatggtggcacaaactatgcacagaagtttcagggcagggtcaccatgaccagggacacgtccatcagcacagccgtacatggagctgagtcgaggctgaagntctgacgacncggccgtgtattacnggtgcgagaggcaggtaattacggtagttttgggacggttggtttagttccgggaacggttagtcgggtaacggtccggttacggggggacccgaaaacgggggtaccccgtaacgggttcccgtaacccggttccgtaccccgttaccgaccggtccccgttaccccgtaacccggaaaccggggtacccccgtaaccgttaccccggggtttacccccgtttacccccccgttaccggggtaccccctaccccccgtttaccccgttaccccgtaaaccgggacccggtaccccgtaaacccccggttcccgggttaacccggggggggtacccctaaacccgggaacccgggttaccccggggaccccccggttacgggggtccccgttccgggtacccccgggttacgggggttacccgtaaaccggggttaacccgttaaccccggttttccccgtacccggttaacgtccccggtcggttacccggtaccgggaacgggtcccgggggtccgtacccggggg

SEQ ID NO: 128993 - DNA, 948 bp, Homo sapiens
  misc_feature: GYAE6OF01BMHPB.45.78.H01.1.454.CMB.1.raw
  modified_base (164)..(164): a, c, t, g, unknown or other
  misc_feature (164)..(164): n is a, c, g, or t
  modified_base (170)..(170): a, c, t, g, unknown or other
  misc_feature (170)..(170): n is a, c, g, or t
  modified_base (192)..(192): a, c, t, g, unknown or other
  misc_feature (192)..(192): n is a, c, g, or t
tcagacgcgatcgacacgaccggtgctcgatttagtgtgagtagtttgggtttggggagagcatcacccagcaaccacatctgtcctctagagaatcccctgagagctccgttcctcacatggactggacgtggaggatcctcttcgttggtggcagcagccanaggacncccactccaggtgcagctggtncagtcgtgggctggaggtagaagaacgccgtggggcctacgaggtggaacgtcctaccgtgacgtaaggtcttacgtaggtaactaacctaccgttacgacccggttactaaaccttagtaacgtaacctacggttaggggacgtccggaacgtaaccgggtccccgtaggaaccggtaaaggggtcctttacgggaaggttacgggtaaggttcggggtaaacttggaaacttacccgaaaaaaccccgttaaggtaaacgttacgggggtacggtaaaaccctaaacggtaaaaaccttttacggaacggtaacccgtaaacgtaaacgggtttaaacgttttaccggggtaaaacgggcccgtaaagggggttaaccccaaaccggttaacggttaaccgggtaaaccgggtaaacccgggtaaacccggttaaccgtaccccggttaaaagtccccggttaaacccgggtaaccaaaccgggtaacccgtaacccgttaaaccgtaaggggtttaccgggaaaaccggttggtaaccgggttaccgggaacccggtaaacgggtccgttaacgggtaaacggtacccggttaagttaacccgggtaaacccgggtaaccgtaacccggggttaaccggtttaacgtttaacggttaaacgtttcccggggaaaacggtccggtaaagggtcccgggttaaacgggttaaagggtttaaccccgtttagggtttaaggttttttaaccggggg

SEQ ID NO: 128994 - DNA, 677 bp, Homo sapiens
  misc_feature: GYAE6OF01AO0L5.45.78.H01.1.454.CMB.1.raw
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttggccggccagtcagagtattagtaactggttgccgtggtatcgagacaagaaaccgagggaaacgcccctaagcctcctgtctactagtaagctattacgtaagtttaacggaaaggttcggggtacccagtacgtaaaggttcgacgacggcgaggtggtagtcggtagggacaagtacttacaccttccgtacaacctatacgacgctacgcctagccgacgcgttacgagttacgttaattttcggaaccttaacgtttaacttacctacggacctaaacgtagttaattagttaacgtttaaggttttaccgttacgggttaacggttaccgggaaccgttaaacggggaaccgtaaaggggttaacgtaaaacgtaccggtaaaacggtaccggtagggttacggtaccgtaacggtccctaactacgttaccttacgttacccgttcgttaccccg

SEQ ID NO: 128995 - DNA, 808 bp, Homo sapiens
  misc_feature: GYAE6OF01DQYWA.45.78.H01.1.454.CMB.1.raw
  modified_base (324)..(324): a, c, t, g, unknown or other
  misc_feature (324)..(324): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggacgcccactcccaggtgcagcgtggtgcagtcgtggggctgaggtgaagacgccgtgggctcgaggtgaaggtctccgtgacgtaaggtcttcgtggactaccgtaccttcgaccggtactactatactacgacgtgggtcgacgacgacggtcccgnggaacgacgggtcttggaggtggtaggtagggtagtcggaacttaccgaaaccctaacgtaacgtcgggtacggactaaaccgtaaactagtacgaaccgtaaacgtaaggttaacggtttaccgggaacggggtaccggtaacggggttacccaacccggtaaggttacccgggaaccggtaaccggggaaaccccgtaaccggttacccgaacgttacccggaaccgaccgtaaacccgacgggtaccccttaaggaacggtttacggggaccgtaccggtaacgggacggtaccggtaacgggtcgttaacggaacgttacgttaaccggtaccggaaccgggtaacccggtacccggggtaccggtttaaggtttacccgttaagggttccgggttaccggaacgggaacggggacggtaaccggtaaagggtttaaaccggtttacgggtttttaagggttttaggggtttaaacgggg

SEQ ID NO: 128996 - DNA, 745 bp, Homo sapiens
  misc_feature: GYAE6OF01DN7FM.45.78.H01.1.454.CMB.1.raw
  modified_base (273)..(273): a, c, t, g, unknown or other
  misc_feature (273)..(273): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatccttcttcttggtggcagcagccacaggagcccactcccgaggtgcagcgtggtgcgagtcgtggggtcgtggaggtagaaggacgtccgtggggcctcgaggtgaacggtcctccgtgacgaaggtctttcgnggaacttaccgtacccttaccgaccggtacttaactaatactaacgacgtggggtacgaccgtacgaccggtccccgtaggaacggtaagggtcttggaggttaggagtagggtatagggaacctaaccgtaaaccctaaacgaggttcggggaacgacctaaaacgtaaaaccttagacggtaactaacggtaaacggttaaggtttacgggaacgggtaacgtacggggtaacctaaccgacgttaacgaaccggaacggggaccctacccgtaacctaagtaccgacgacccaccgaccgtacctacgtagacgggtagcgtaacggagtacgggaacggtcgtaacggaacgtacggtacgtacgaacccgtacggaccggttacgtacgttaaccgtagttcggaagtaccggtaaggaggtaacgttaacggttaagttttaacggtggtttttaaggtaacgggg

SEQ ID NO: 128997 - DNA, 806 bp, Homo sapiens
  misc_feature: GYAE6OF01AMX3J.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctacctatatacactgggtgcgacaggcccctggacaagggcttgagtggatgggatggatacaaccctaacgaagtggtggacaacaaactatcgacaacagtaacgtttcgagggtcacgggtcaaccagtgaccgaggtacaccggtccaatcgacgacacgacgacctaacagtcggaagtcctaggacgacgaggtccgtaggaacgacgtacgtacggaaccgacgacccgggtaccgtttaagttacgttaaccgtggtacggaccggtaaggacggtaccggtaaggtaacctttaacggggttaatttttacggggaaggtttaggggttaccgttacggggtaaccggtttaaggttacgggtaccggttacggtacgggggtacctaaggggtaacccgtacgggtaccgtacccggttcgtaccgtccgtacgtcccgtaccgaaccggacggtaccccgtacgtccccggtcccgttccccgtccggtacccgtccccttacccgacgtaaccgccgtaccgacccgggttaccgtaccggggaccctacggtaccgggtaccccggtcccggtacgggtcccttacgggaccgttcggtaccggtaccgtacgtaccggtttcccggagtccggtccggtcggttccgttagggaccggtcggtcggtaccggg

SEQ ID NO: 128998 - DNA, 699 bp, Homo sapiens
  misc_feature: GYAE6OF01EDFKR.45.78.H01.1.454.CMB.1.raw
  modified_base (600)..(600): a, c, t, g, unknown or other
  misc_feature (600)..(600): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctgggaggatcctctttcttggtggcagcagccacaggacgccccactcccgaggtcgcagctggtgctaggtcgtggggctggaggtagaagacggccgtgggcctgagtgacggtctctgcaggtcttcgaggtactacctaccttcgaccggtctaactatactacgaggttggggtacacgtacgaccggtcccgtaggaaccgtaacgggtcttaggacggtagggacggtgggtactagggacctaaccgaaacccgtaaagtaacggttgggtaacgaccgtaaaccgtaaagttacgacgtaaccgaacgtaacggttaacggttacggaacgggtacggtaacgggttacccaacggtacggtaaccggaccggaacggggtaaccctaccgtaccgtacgtaccgacgtaacgaccgtacgtactaacgagtcggaactcgtacgagcgtagtcgtaganacgtcgacggaccgacggtccggtacgttacgtacgttaggaggtcggacggtagggtacggacgttaaggttacggtttagttaggtttgggtaacgg

SEQ ID NO: 128999 - DNA, 637 bp, Homo sapiens
  misc_feature: GYAE6OF01CNULL.45.78.H01.1.454.CMB.1.raw
  modified_base (261)..(261): a, c, t, g, unknown or other
  misc_feature (261)..(261): n is a, c, g, or t
  modified_base (292)..(292): a, c, t, g, unknown or other
  misc_feature (292)..(292): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaaccctaacaatggtggcacaaactatgcacagaagtttcagggcagggtcaccatcgaccagggacacgtccatcagcanacgcctacatggagctagagcaggctgagtntcgtagacgacgaacgggtccgtgtactttacgtggtgcggaaggaggcgaaggtaatttacgtagtttttgggagtttgggtttagttcgggtaggttagtgggtacgtcggtcggggaccgaacggggaccgacggtcacccggttctcctcgacgccctaccaccgacgggcccagttcccgtcccttccccgcgccctaccccgtctacccaagctcctacccgtcggtcggggaccacgacggtccggtcccgtagggccgtcggcccgtgggtaccgaacggtccttaccgtttcccgacgtacgtccggtcgttcgtaggacgggtcggtcgtacggg

SEQ ID NO: 129000 - DNA, 669 bp, Homo sapiens
  misc_feature: GYAE6OF01AK74R.45.78.H01.1.454.CMB.1.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactccccaggtgcagctggtgcagtcgtggggctggaggtgaagaagtccgtgggggcctcgaggtgaaggtcctccgtgacgaaggtccttcgtggataccgtacccttcaccgggacttaccgtaattactacgacgttgggtcgaccggacgaccggtccccgtaggaaccgaacgggtcttagggagtggaaggtggggactggactaccgaaaccctaaacgaagttcggtaggaccaacgaaacttgtacgacaacaagtaacgttacggaggtaccggagggtaccaccgtaagtaccggaaccgaacgggggaaccctaccgtaccgtactacgacgaccgaaccgtaccgacctaacgtaggtacggacgtacgtggaacggtaccggacggtcgtacgacggtacgtacgtacgaaccgcgaccggtcgtagtacgttagtaggtcgagaacggtacgagacgtaagttcgttaggtttggtaacggg

SEQ ID NO: 129001 - DNA, 593 bp, Homo sapiens
  misc_feature: GYAE6OF01EUITX.45.78.H01.1.454.CMB.1.raw
  modified_base (372)..(372): a, c, t, g, unknown or other
  misc_feature (372)..(372): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtatagtaactggttggctggtatcagcaagaaaccagggaaacgcccctaagctcctgctctataaggcatctagttagaaacgtgggtccatacgaggttcaggcggcaggtggatgtgggacagaattcactctcacancagcacgcctggcacgccgtagattgtattttcgacttaaactttagtttacctacgacccgaaactaagttaagtagtaatttaaggtttacgttaccggtacggtttaccgggacccgtaaacggggtaaccgtaaacgggttaaggaaaacgttaaccgaaaaccggtaacgttacgggtagtccgtaggactacctaattctacgttccttctaccg

SEQ ID NO: 129002 - DNA, 635 bp, Homo sapiens
  misc_feature: GYAE6OF01EBM2G.45.78.H01.1.454.CMB.1.raw
  modified_base (527)..(527): a, c, t, g, unknown or other
  misc_feature (527)..(527): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcgagggcagggtcaccatgaccagggaccacgtccatcagcacagccctacatggagctgaagccgaggctaggagatcgtagaacggacaccgggccgttgttaattactggttgcgagacggacgaggtaacttacgttagtttttggggagttaggtttagttacgggaacggttatgggacgttcggtggggaccgaaagggcccgacgggtcctaaccgtccttcccgcaccgccctaccccgacgaaccggccctagtcccggtcccttcccccgcggtacccaccccgtccctacgaacgcnccgaccgtcggtcggggccaccgcgcggcccgtggccgtcggccgtgtacgtacggtacttccgttcccgtcgtaacgtccgtaccgttcagggcgtcgggcgtcggg

SEQ ID NO: 129003 - DNA, 618 bp, Homo sapiens
  misc_feature: GYAE6OF01B15XZ.45.78.H01.1.454.CMB.1.raw
  modified_base (479)..(479): a, c, t, g, unknown or other
  misc_feature (479)..(479): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtgcacaaactatgcacagaagtttcagggcagggtcaccatgaccagggacacgtccatcagcacagcctacatggagctgagcgaggctgagatctcggaccgacgaccggccgtgtacttacgtggtgcgagaggacgaaggtaatttacgtagttttgggaggttggttagttcgggtacggttagtggtacgtcggtggggccgaaacgggaccgacgggtccacccgtccgtacctcgacgccctaccgaccgaacgggcccacgtccgtcccttccccgngtcccaccctcctacaacgcaccaccgtcgcggggccacgaccggccggcccgtcgggcctcggtccgtcggtaccgacggtacctacccgttccgcgtacgtccggccgttcgtaggacggtccgggtcgtaccgggg

SEQ ID NO: 129004 - DNA, 779 bp, Homo sapiens
  misc_feature: GYAE6OF01BYIGM.45.78.H01.1.454.CMB.1.raw
tcagacgcgatcgacacgaccggtgctcgatttagtgtgagtagtttgggtttgggggagagcatcacccagcaaccacatctgtcctctagagaactcccctgagagctccgttcctcaccatggactggacctggaggatccttcttcttggtggcagcagccacaggacgcccactcccgaggtgcagcgtggtgcgaggtcgtggggctggaggtagaagaacgccgtggggcctcgaggtaggaaggttcctccgtagacgaaggtcttcgtaggactacctaccttcgaccggctacgtatactacagtgggtcgcgacgacggcccgtggacgaagggtcttaggacgtggagtgggtagtggaacttaccgaaacccgtaaacgaaggtcgggtacgaccgtaaacaaacgtagtacgacgacgtaaaggttaacgtttcggaacggggacgtacgggtaccgaaccgtacgtaacgggtaacccgaaacggggtaacccgtaaccggttaccccgaagttaccgaaaccggacccaacccggtaaccgtaaccccgtaacggtaacggtaccgggtaaccgtaccggttaagggtaaccggacgggtaaccgggtacgtaacgggtaagtaccgttaccgtaacgggaaccggaacccggttaccggggtccggtttaggttaaccgttacggtacgggttgggaacccggtaagggaccggttacggaaagggttaacgttttaacgggtttagggtttttaaacgggg

SEQ ID NO: 129005 - DNA, 813 bp, Homo sapiens
  misc_feature: GYAE6OF01A8JGL.45.78.H01.1.454.CMB.1.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggacgcccactcccaggtgcagcgtggtgcgagtcgtggggctggaggtagaagaacgcgtgggcctcgaggtaggaacggtcctcgtgacgtaacggtccttcgtggaacttaacctacccttaccgacccgggtaccttaaccttaacttaactaccgtaacgtggggttacggaccgaaccggaccgggtccccgtacgggaaccggtaacggggtccgtttagggaacggtagggtaaggtaggggtaacgttaggtaacgtaacccgtaaaacccgttaaacgtaaagttacggggtacggaccgtaaaactaaaccgtaagttcgaacgtaacgagggtaaacgtttacgagggtacgaccgggtacaacgtaccgtacgaaccggacgggaaccgtacccgtaccgtacgtaaccgaacgaccaaacgaccgtaacccgtaacgtacggtaggaaccgttcggaggacggtaccgaacgggtcgtacggtaacgtagtaccggacgaacccggtacgggacccggttacccgggttacgttaacggtttacggttcgggttaccggaacgggtaacgggacgggttaacggaaaggttaaacggttttaacgttttagggttttaacggggttttaaggggg

SEQ ID NO: 129006 - DNA, 693 bp, Homo sapiens
  misc_feature: GYAE6OF01BQ7TZ.45.78.H01.1.454.CMB.1.raw
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtcctccttccaccctgtctgcatctgtaggagacagagtcaccatcacttgccggcagtcagtagtattagtaactggttcgctggtatcagacagaaaccgaggaaacgcccctaagtcctactgctactagtaacggctattacgtagttaagaacggtcgggtaccatcgtaaggttcacggcggacgaggtcggtaagtcggtagggaactaaggtaacttccacgttcctaccaactattaccgacggactaaccggtcccttaggacccctaggtccgtagtaagttcggtaacgtttttacgaacctttaaacgttttacgttaaccgtcggtaacctaaagttaacgggttatacggtaattaccgtttaagttcccggtaacggtttacccgaaccggtaaacgggaaccgttaaggggttaaagaaaaccttaccgaaaacggttcggttacgtaccggggtaccttacggaacccttaccttacggtacccgtttacgtttcccgttacgtacccg

SEQ ID NO: 129007 - DNA, 697 bp, Homo sapiens
  misc_feature: GYAE6OF01ETJJF.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagttcagggcagggtcaccatgaccgagggacacgtccatcagcacacgcctacagtggagcgtggacgcggacggtcgaggaacggacgtacgtacgaacgtaccgacggccgtagtacttacgtggtgacgagacgtcgaaggtaacttagttagttttggaggttggttacgttacgggtacggttagtcgggacgttcgggtcgggtaccgaacggggtaccctacgggtaccctccggttcctcccgtaccgaccgtcccgtacccgaccggtaacccgggacccgttccgttaccccgggttaccccttcccccggtcgccccctaccccgtccctacccggaacgtacgcccgacccgtcgggtaccggggaccaccggcgcccgggtcccgtcgggtccgttcgaccggtacggtaccggtacgttacgttacccttcgccgtacggccgttacgtcgaggcgggccgtcggacgg

SEQ ID NO: 129008 - DNA, 591 bp, Homo sapiens
  misc_feature: GYAE6OF01E32QY.45.78.H01.1.454.CMB.1.raw
  modified_base (411)..(411): a, c, t, g, unknown or other
  misc_feature (411)..(411): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatccacgttcgccgggccagtcagagttattagtaacgttggtcggcctggtatcagcaacgaaaccgaaggggaaacgcccctaaagccttccgtgcctactaagtaacggctatacttaaggtttaagaaacggttcggggtaccctagtcgaacggttcgacggcggacgtaggtggatcgtaggacagtaattcactcncacactcagcagctgcgagcctgacgttgtatttgacttaacttcttactcgtacctaagtagttagtatagtttacgttacgttacgtaccgttacggacggaacggtacgaagggtacgaaactacgaacgtaagtggtcgacgtcgaccgtaactgttaccttgttcctcttacccg

SEQ ID NO: 129009 - DNA, 789 bp, Homo sapiens
  misc_feature: GYAE6OF01CTJJ3.45.78.H01.1.454.CMB.1.raw
  modified_base (136)..(136): a, c, t, g, unknown or other
  misc_feature (136)..(136): n is a, c, g, or t
  modified_base (187)..(187): a, c, t, g, unknown or other
  misc_feature (187)..(187): n is a, c, g, or t
tcagacgcgatcgacacgaccggtgctcgattagtgtgagtagtttgggtttggggtgaagaagcctggggcctcagtgaaggtctcctgcaaggcttctggatacaccttcaccggctactatatacactgggtncgacaggcccctggacaagggcttgagtggatgggatggatcaaccctaanaatggtgcacaaactatgacaacagaagtttcagggcagggtcaccatagaccgaagggacacgtccatcagccaacacgacctacagtggagctgagcaggctgagatcgtacgacgacgacggtccgtagtacttacgtgtcgacggaagaggcgaaggtaattaacgttagtttttgggaagtttagggttagttacgggtaacgggttagtcgggttaaccgtcggtacggggtaccggaacgggtaaacccgtaccggttacccgtaccccgttcctcccgttaccgtaccgccccttaacccgaacccgaaacccgggtaccccgtaacgttccccgggttacccctttcccccccggtccgacccctacccccgttaccctaccgaaaccggtacgtaccccgtacccggttcccgggttacggggggcctaaacccggaccggtaccccgggtccccggtcggggtaccccgtccgggttacccgtacggggtaaccgaaacccgggttaccccgtttacctttcccccggtacgttaccggtacccggtcccgtttaccggacgggaaccgggtccgggtaccggtaccgggg

SEQ ID NO: 129010 - DNA, 718 bp, Homo sapiens
  misc_feature: GYAE6OF01ERFUJ.45.78.H01.1.454.CMB.1.raw
  modified_base (203)..(203): a, c, t, g, unknown or other
  misc_feature (203)..(203): n is a, c, g, or t
tcagacgcgatcgacacgaccggtgctcgatttagtgtgagtagtttggggtttgggggagtcagacccagtcaggacacagcatggacatgagggtccccgctcagctcctggggctcctgctgctctggcctcccaggtgccaaatgtgacatccagatcgacccagtcctccttcccaccctgtctgcatctggtagganacagacgtccaccatccacgttggcccggccagtcagagtattagtacgtggttcggctggtatcagacaagaaaccgagggaaacgtcccctaagccttcccgtgtccttacttaagtaacggcctaattacgttaaggtttaaggtaacggttcgggtaccagttacgtaacggttacaggcggacgagggtacgtagtcggtaggaactagtaacgttccaaccgttactaccaactactacgacgacctacggtcctcgaccgtacggtccctaggttagttacgtttaagttttactaacgtttaacttttaaacgtcctacggtaacctaaccgtagttaacttaggtaacgtttaaggtttaccgttaccggttaccggtttaccggaaccccgggtaaaggggaaccgtaaacgggttaaggaaaacgttaacgaaaacggtacgggttaggtcgtacccggtactacccggtaacttaccggttcttaaccgtttctcccgtaccc

SEQ ID NO: 129011 - DNA, 830 bp, Homo sapiens
  misc_feature: GYAE6OF01C90GO.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggataccaaaccctaacaagtggtggacaacaaactatgcacagtaagttcgagggcaggtcacatcgacgagggacaccgtcatcagcacacgcctacagtggacgctaggagcgacgcgtacgaagtacgtcgtacgacgaccgaacggtccgtagtacttaccggtagtcggtacggaaggaccggagtaacgggtaacgtttacggtttaaggtttttagggaaggtttcgggttaacggttacggggtaacggtagttacggggtaaacggttcgggtacgggggaaccggtaacgggtacccgtacgggttacctacccggtctaccccgtacgaccgtacccctaacccgtaaccggaccggtaccctaccggttcccggttcccccgttaccccgtcccgggtacccccttaccccggtacccctaacggaaacccggaccgttaccccgtaacccggttccggggaccgggttacccaaccgggcccgggtaccccgggcccgttccggggtccgtacccgggttaccccgggttagggtaacccgtaaaccgggtttacccgttaccccgtcccgggttacccgaacggttccccgggtacggtttacccgaaggggttccccgggaagggtccgtaacccggggg

SEQ ID NO: 129012 - DNA, 708 bp, Homo sapiens
  misc_feature: GYAE6OF01EL9SB.45.78.H01.1.454.CMB.1.raw
  modified_base (188)..(188): a, c, t, g, unknown or other
  misc_feature (188)..(188): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaanaatggtggcacaaactatgcacagaagtttcagggcagggtcaccatcgaccagggacacgtccatcagcacagcctacagtggagctagagcgaggctgagatctgaccgacgaccgggtccgtgtaacttacgtgtaggacggaaggacggacgtaaggtaacttacggttagtttttagggaggttggtttagttcggacggttagtagggtacgtcgggtagggaccgaaacgggtaccgtaccggtacgtacccgtccttcccgtcgacgccctacccgaaccgaaccgggccctacgttccgtccccgttccccgtaccggtaccctaccccgtcctaacccgtaggaccgtacccgtaccgtccgggtaccgggggccaaccggccgggaccccggtcccggtacggggcccgtccggtacccgggttacggaacccggtaacggtaccctttacccgttccgtaccgtaccgttccgtccggttcggtacggacgggtccggcggtaccggg

SEQ ID NO: 129013 - DNA, 752 bp, Homo sapiens
  misc_feature: GYAE6OF01CFQJ9.45.78.H01.1.454.CMB.1.raw
  modified_base (303)..(303): a, c, t, g, unknown or other
  misc_feature (303)..(303): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggagtgggatggataccaaaccctaacaagtggtggcaacaaaactatcgacacaggtaagtttcgagggaccgagggtccaaccatacgaccgaagggacctacgtccatcgagccaacacgacctaacagtggaanccgttaggaaggccaaggccgtgaagtatcgaggaccgacgtaccggtccgttagttaactttacgtggtacgacggaacggaggacgaaaggttaacgtttaaggtttagtttttagggtaacggttagggtttaagttaccggggtaacggttagtagggtaccgttcgggtacggggtaccgaaagggacccgtacggttaccgaccgttcctccgtacgaccgtccctaccgaacccggtaaccggacccgtacgttccccggttacccttcccccggtacgaccctacccccgtaccctaccgaaacccgtcggaccctaaccggttccggacggggtacccaacgtccggcccggtacccggtcggtcgtccgacccgtggtaaccgaacgtaccgttaccgtccgacgtacgtcgtcgtaccgaggccggtgggcgtacggg

SEQ ID NO: 129014 - DNA, 644 bp, Homo sapiens
  misc_feature: GYAE6OF01CODGZ.45.78.H01.1.454.CMB.1.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctcgagtgaaggtctccgtgcaggcttcgtggataccaccttcgaccggctactatactacacgtgggtcgcgacgacggcccgaggaccgaaggtctaggaggtggagtgggatggtactaccgaaaccgtaacgtaaggtcgggtggaacctaaacgtaaactagtacgtacgaaacgtaaggtaacggtttacggagggcgtaacggggtccaacctgtacgaccggaagggtaccacgttacacgtcgacgacacgacgaccctagacggtggacgtcgaggtacgacgtacgggtcgtaggacgtagtcgacggaccgaccggaccggtacgttagttaacgttagtcggtgtacgggaaggtacgacggttaaacggttaagtttaacggtttgggttttaagggtaacggg

SEQ ID NO: 129015 - DNA, 796 bp, Homo sapiens
  misc_feature: GYAE6OF01CKS24.45.78.H01.1.454.CMB.1.raw
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatcgaccagtcctcctccaccctgtctgcatctggtagagacagagtccacatcactcggccggcagtcagtagttatagtacgtggttggcctgtatcagcaagaacgaggaacgccctagcctctgctactagtacgctactcgtaagttaggaacggttcggggtaccctaacgtacgtaacggttcgaacggtccggtacgtaaggtcgggacgttacggtacgggaacctaagttaacgttacctaccttccgtaccgaaccctagtaccgaaccgtcgtaacgtccctacggtaccgtacgtccgttaggtagtttaccgttagtttttaaccggaacctttaaaccgttttacgttaaccgtaaccggttaaccctaaaccggttaaggtttaacgtaaggtttaacgtttaaacgggttttaccgttacccgggtttacggggtacccggtaacccgggtaaaccggggtaaaccggttaaacggggttaaaccggaaaaccttaaaccgggtaaaaccccgggtttaacgggtaccgggtttaccgggtaacccgttaacccggaacccgtaaacccgtttaccggttacccgtttaaacccgttcggttttaaaccccgtttcccccgg

SEQ ID NO: 129016 - DNA, 511 bp, Homo sapiens
  misc_feature: GYAE6OF01CA5I8.45.78.H01.1.454.CMB.1.raw
  modified_base (197)..(197): a, c, t, g, unknown or other
  misc_feature (197)..(197): n is a, c, g, or t
  modified_base (270)..(270): a, c, t, g, unknown or other
  misc_feature (270)..(270): n is a, c, g, or t
  modified_base (348)..(348): a, c, t, g, unknown or other
  misc_feature (348)..(348): n is a, c, g, or t
  modified_base (409)..(409): a, c, t, g, unknown or other
  misc_feature (409)..(409): n is a, c, g, or t
  modified_base (416)..(416): a, c, t, g, unknown or other
  misc_feature (416)..(416): n is a, c, g, or t
  modified_base (490)..(490): a, c, t, g, unknown or other
  misc_feature (490)..(490): n is a, c, g, or t
  modified_base (497)..(497): a, c, t, g, unknown or other
  misc_feature (497)..(497): n is a, c, g, or t
  modified_base (502)..(502): a, c, t, g, unknown or other
  misc_feature (502)..(502): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtagganacagagtcaaccatcacttgccggcagtcagagtattagtaactggtgctggtatcagcagaaacagggaaancccctaagctcctgctctataaggctatacttagttaagaaaggtcgggtcccatcgaaggttcagcggcagtgatcnggacagtaatcactctcacatcagcagcctgcagctagactgtatttgactaacttatacngaccaanatactagattagttacgttacgacgttcgggacaacgggtaacaagggtagaaacacgtaaacgatggtgctanacacctntactnttctctacg

SEQ ID NO: 129017 - DNA, 688 bp, Homo sapiens
  misc_feature: GYAE6OF01CBGZ3.45.78.H01.1.454.CMB.1.raw
  modified_base (475)..(475): a, c, t, g, unknown or other
  misc_feature (475)..(475): n is a, c, g, or t
tcagacgcgatcgacacgaccggtgctcgatttagtgtgagtagtttgggtttgggtgaagaagcctgggcctcagtgaaggtctcctgcaaggcttctggatacaccttcaccggctactatatacactgggtgcgacaggcccctggacaagggcttgagtggatgggatggatacaaaccctaacgaatggtggacaacaaactatgcacagtaagtttcgagggcagggtcaccatcgaccgaagggacacgtccatcagcacacgcctaacagtggagctaggagacagactgacatcgtgacacgacgtactatttatactagtgacgaggtattggttaccggtgtcttcggtttcgtttagacggtacggtcgggacgtaaccgggtaacctggtaccacgtactcctcctacacgaccctacccgaccgacgggcccctacggttcccggtccctttacccccggngtaccccctacccttaccccgtaaccgaacggacctcccgacccgttaccgggaccggggaccaaccgggtaccgggccccggttcccgggcgggtccgtacccgtccggttagtaccgggtaaaccggtaccccttaccgttaccgtacggtcttacccggcgttcgaggggtaccggccgggtacgtcgggaacccaagggccgaatacgg

SEQ ID NO: 129018 - DNA, 591 bp, Homo sapiens
  misc_feature: GYAE6OF01AFU66.45.78.H01.1.454.CMB.1.raw
  modified_base (481)..(481): a, c, t, g, unknown or other
  misc_feature (481)..(481): n is a, c, g, or t
  modified_base (500)..(500): a, c, t, g, unknown or other
  misc_feature (500)..(500): n is a, c, g, or t
  modified_base (524)..(524): a, c, t, g, unknown or other
  misc_feature (524)..(524): n is a, c, g, or t
  modified_base (528)..(528): a, c, t, g, unknown or other
  misc_feature (528)..(528): n is a, c, g, or t
  modified_base (535)..(535): a, c, t, g, unknown or other
  misc_feature (535)..(535): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagtaagtttcgagggcagggtcaccatgaccgagggacacgtccatcagcacagccctacagtggagctggagcgaggctgagatcgtgacgacgaccggcgtgtacttacgtgtgacgaggaggcgaaggtaattacggtagttttggagttgggttagttcgggacggttagtggtacgtcgtcggggaccgaagggaccgtacgggtaccaccgttcctccgtcgacgtccctacgaccgtacgggccctagtcccgtcccttcccgngcccacccgtcacaagccncaccgtggcgggcacgcgccgcgnggcncgtccgnggacgacggtccttacgtcctacgctcggtccgtctagggcggtcgggtcgacggg

SEQ ID NO: 129019 - DNA, 913 bp, Homo sapiens
  misc_feature: GYAE6OF01DXQB3.45.78.H01.1.454.CMB.1.raw
  modified_base (140)..(140): a, c, t, g, unknown or other
  misc_feature (140)..(140): n is a, c, g, or t
  modified_base (203)..(203): a, c, t, g, unknown or other
  misc_feature (203)..(203): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtnaccaaatgtgacatccagatacgacccagtcctccttccaccctgtctgctagtctgtagganacagacgtcacacttcgacttcggcccgggacctagtcaaggtaagttaatttaaggtaacgttgggttacggccgttaggtactacgaagacaacggaaaaaccgaacggggaaaccgtaccctaacggccttacccgtaggcttacgtaacgtaaaggtctaacgttacgttaaggtttaaggaaacggttcggggtaccccaagttaccgaagggtttacgaacgggaccggtacgtaaggtacgggtaacttcgggtaacgggaaactaacggtaactttacggaacctttaccaacgaaccctagtaacgataccgtacgtacccgttagaccgtaacgtcccgtaagtaacgttaggttttaacttttacggtaaacctttaacgttttaacccttaacggtacgttaaaccccgtaaaggttaaagtttaacgttaacggttaaagttttaaccgggttttaacgttttaaccccgggtaacccgggttttaaccgggaaaacccggggttaaaaaccggggaaaaacccgggtttaaaagggggttaaaaccggtaaaaaacgttaacccggtaaaaaaaaccggttaacccgggtttagggggtaaaccgttaccccgggtacgttaaacccccgttaacccgggtttaactttacccggttttaacccgtttccggttttaacccttttaaaccccccgg

SEQ ID NO: 129020 - DNA, 721 bp, Homo sapiens
  misc_feature: GYAE6OF01DWV3C.45.78.H01.1.454.CMB.1.raw
  modified_base (232)..(232): a, c, t, g, unknown or other
  misc_feature (232)..(232): n is a, c, g, or t
  modified_base (246)..(246): a, c, t, g, unknown or other
  misc_feature (246)..(246): n is a, c, g, or t
  modified_base (253)..(253): a, c, t, g, unknown or other
  misc_feature (253)..(253): n is a, c, g, or t
  modified_base (267)..(267): a, c, t, g, unknown or other
  misc_feature (267)..(267): n is a, c, g, or t
  modified_base (292)..(292): a, c, t, g, unknown or other
  misc_feature (292)..(292): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccagtggactggacctggaggatcctcttcttggtggcagcgagccacgaggacgcccactcccaggtgcatcgtggtgcagtcgtggggactgaggtgaagacgccgtgggccncgagtgaggtctcngcagctngatacactcgcgtntactatactacacgtggtcgcgacncggccccgtggacgaggcttggagtggtagtgggatggactaccaaaccgtacaagtggtacggacacgaaactacgtcgacgactaaggtaaagtttcggaacgggtacgtaggggtacccaaaccgtagtacggtaacccgaagggtaacccgtaaaccgtacctaacgtaccaaccgggtaccaaaccgtcgtaaccccgtaagtacggtcgggtaagtccgtaggaccggacggtaacggtaccgggtacgtaaacggtacgttacggtaccgggaaaacccgtacccggtaacccggggtaccggtttaacgtttaacccgtttaacggttcgggttacgacggggttaacggaaacggggtcctttaaaaacggggttacccggtttaaaggttttaaacggtttttccgggggttaaacggg

SEQ ID NO: 129021 - DNA, 713 bp, Homo sapiens
  misc_feature: GYAE6OF01BIF1P.45.78.H01.1.454.CMB.1.raw
  modified_base (136)..(136): a, c, t, g, unknown or other
  misc_feature (136)..(136): n is a, c, g, or t
  modified_base (187)..(187): a, c, t, g, unknown or other
  misc_feature (187)..(187): n is a, c, g, or t
  modified_base (205)..(205): a, c, t, g, unknown or other
  misc_feature (205)..(205): n is a, c, g, or t
  modified_base (278)..(278): a, c, t, g, unknown or other
  misc_feature (278)..(278): n is a, c, g, or t
  modified_base (560)..(560): a, c, t, g, unknown or other
  misc_feature (560)..(560): n is a, c, g, or t
  modified_base (619)..(619): a, c, t, g, unknown or other
  misc_feature (619)..(619): n is a, c, g, or t
tcagacgcgatcgacacgaccggtgctcgattagtgtgagtagtttgggtttggggtgaagaagcctggggcctcagtgaaggtctcctgcaaggcttctggatacaccttcaccggctactatatacactgggtncgacaggcccctggacagggcttgagtggatgggatggatccaaccctaanagtggtggcaacaaactntcgcacagtaacgtttcagggcagggtcacatacgaccgagggaccacgtccatacagccactacgccctaanagtggacgtctggaacgcgacgggctaggagtacttcgaggaaccgaaccgtccggtccgttagttacgttaccgtggtacggacggaacggaggtacgtaaggttaactttacggttaagttttggggagttaggttagtccgggaagttcgtacgggtaccgtttcggacggggaacctaaaccggggtccgaccgggttacccaaccggttccaccgttaccaccgtccctaacccgaaccgaaccgggccctaacgtcccggttaccctttcccccgngtacccctaccctccgtaaccgaccgtacgtccctaaccggtcgggaccggggtaaccnccggtacggtaccggtcccgtcgggtcctcggccgtaggtaccgacggtacctaccgtccgtacgtacgtccgtcgtcagggcgccggtagcgg

SEQ ID NO: 129022 - DNA, 984 bp, Homo sapiens
  misc_feature: GYAE6OF01CS0C9.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacacggcccctggacaagggtcttgagtggagtgggatggatccaaaccctaacaatgggtggacaacaaactatcgacaacaaggtaagtttcgacgggacgaggggtaccaacctagtacggaaccgaacgggtaccaccgtaccgactacgacgaccaacgaacgtccctaacgagtacgggacgtcgtaggaacgcggaacggtcgtacggaaggtacttacccggtaacggaaacccgggacgtaacccggggttcccgttaacggttttaacgttttaaccggtggtttacgggaacggtaaacgggtaccggaaaggttaaaacggttaaacggttttaaacgttttaagggttttttagggttaacggggttttaggggttttaacggggttaccgggtaaacgggtttaacgggtaccggggttaaccggggtttaccgggggtaaccgggggtaaacccggttaaacccgggggtaacccgtaacccggggtttacccggtaaccccggttacccggttcccgttaaccgtacccggtaccccgtaacccccgtaaacccgggtaaacccgggtccccgtaaccggtttccccgggtttacccccgttaccccccgggttaccggtaccccctaaccccgttacccgtaccccgtaaaccggtacccggtacccgtacccgtcccgggtaccggggtaccgaaccggtccgggaccggtcccggtccggtcccggtacgtacccggtacggtaccgtaacggtaccgtttacccgtaccggttaccgtaccggttacgtccggttacggcggaacgggtccgggtacggtacggg

SEQ ID NO: 129023 - DNA, 773 bp, Homo sapiens
  misc_feature: GYAE6OF01EVLW9.45.78.H01.1.454.CMB.1.raw
tcagacgcgatcgacacgaccggtgctcgatttagtgtgagtagtttgggtttgggggagcatcacccagcaaccacatctgtcctctagagaactcccctgagagcctccgttcctcaccatggactggacctgggaggactccttcttcgttgggtggcagcacgccacgaggacgcccactcccgaggtcgcagcgtggtcgctaggtcggtgggcgtggaggtagaaggacggtccggtcggggcctacgaggtaggaaccggttctccgtagacgtacggtcttacggtaggaacttacctacccgttcgaccggtactactatactacgtacggtgggtcgaccgaccggaccggtcccgtaggaacggtacgggtcttagggacggttggagggttaggagtacggaacctacccgaaaccgtaaggagttcgggacgaacctaaacgaaattcgacgacgtaaaccgtaagggttaacgttacgggacggtaacggtacgggtaccaaccggtagaaccgggaaccgtaacggtaccccgtaaccgtaccgacgtacgaccggaacctaccggaccgtaccgtaacgtaggtaccggacgttaacggcgtaacggaccgtaggtaccgtagaagtaccgtacgggaaccgaccgggtaaccgtccggttaaccggttgttaaacccgttggacggtagggacgtaacgggacggtaacggttaaacggtttacctttaaggggtttaggtttgggttaaacgggg

SEQ ID NO: 129024 - DNA, 756 bp, Homo sapiens
  misc_feature: GYAE6OF01DT7HN.45.78.H01.1.454.CMB.1.raw
  modified_base (185)..(185): a, c, t, g, unknown or other
  misc_feature (185)..(185): n is a, c, g, or t
  modified_base (202)..(202): a, c, t, g, unknown or other
  misc_feature (202)..(202): n is a, c, g, or t
  modified_base (207)..(207): a, c, t, g, unknown or other
  misc_feature (207)..(207): n is a, c, g, or t
  modified_base (273)..(273): a, c, t, g, unknown or other
  misc_feature (273)..(273): n is a, c, g, or t
  modified_base (282)..(282): a, c, t, g, unknown or other
  misc_feature (282)..(282): n is a, c, g, or t
tcagacgcgatcgacacgaccggtgctcgatttagtgtgagtagtttgggtttggggtgaagaagcctagggcctcagtgaaggtctcctgcaaggcttctggatacaccttcaccggctactatatacactgggtgcgacaggcccctgacaaggcttgagtgatgggatggatcaaccctaanaagtggtgcacaaactntgcanagtaagttcgagggcagggtcaaccgatcgacgagggacaccggtcatacagcaacagtccctaanagtcggaancgttggacgcgacggtgacggagtactccgtagaccgtaacgtaccggccgtttaagtacgttaactggtagaccgtaaggaacggtacgtaaaggtaactttaggtaaattttggggaagtttacggttaaacgttcgggtaacggttaagcgggttaaccgtacggttacgggggaacgttaaaccgggaccttaccgggtacctaccggtcttaccaccgaactaccccgtaccgaacccgttaacgggaccccgtaagttcccggttacccttcccgacgtacctacccctctacgaaacgtcgaccgtaccggacgcgggtaaccacgaaccgggtcccgtacccggacggttccgtaccggtccggttaaacggttacccgtaaacggggtaccctttaccggtacccgttacgttacggtacccggtacggttccgtaacgggtacgggtcccggcgggtaaccggg

SEQ ID NO: 129025 - DNA, 656 bp, Homo sapiens
  misc_feature: GYAE6OF01D5T44.45.78.H01.1.454.CMB.1.raw
  modified_base (287)..(287): a, c, t, g, unknown or other
  misc_feature (287)..(287): n is a, c, g, or t
  modified_base (291)..(291): a, c, t, g, unknown or other
  misc_feature (291)..(291): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgaggctganatcngacgcgacggccgtgtattctgtgcgaggagcgagtaattacgtagttttggagttggttagtcgggtaggtagtggcgtgtcgggaccgaaagggaccgacggtcaccgttcctcccgtcacgccctacccgaccgaacggccctacgtccggttcccttcccccgtcggtcccctaccccgttcccgtaccgaacgcgtacctacccgttcggtaccgggggtccctaaccgacgggtccccggcccggttacgggtccgttcgggacccgttagggtacccgaaacggggttacccttacccggttccccgttaccgtcgtccggtcccgttcgtacgggtcggtcccgggcgtacccgggg

SEQ ID NO: 129026 - DNA, 762 bp, Homo sapiens
  misc_feature: GYAE6OF01BS9NR.45.78.H01.1.454.CMB.1.raw
  modified_base (270)..(270): a, c, t, g, unknown or other
  misc_feature (270)..(270): n is a, c, g, or t
tcagacgcgatcgacacgaccggtgctcgatttagtgtgagtagtttgggtttggggagagcatcacccagcaaccacatctgtcctctagagaatcccctgagagctccgttcctcaccatggactggacctgggaggactcctcttcgttggtggcagcagccacgaggacgccctacgtcccgagggtcgcagcgtggtcgcaggtcgtggggctggaggtagaaagacgccgtgggcctcgagtgaagtctcgtgacaggcttcgngactactaccttcgaccgtctaactagtactacacggtggtcgacgacgccggcccgtggaacgtacggggtcttgggacggttagggtagtgggtaagttcggaacttaaccgaaaccccgttaaagtaaggttcgggtacgaacctaaacgaaaactgtacgactaacggtaacgttaagttaccggagggtaccgaacggggttaccaaccgtaaggtccgtaaaccggaacgggtaaccgtaacgttaccgtaacgtaccgaacgtaccgaaccgtaacgaccgtaacgtaaggtcgaacgttcgaaggaaccggtaccgtagggttaccgtaggtaacgtcgttacccggagtaaaccgggtaccggttacccgggttaggttaaccttaaggtttaaccggtcgggttaacgggaacccgggaggtaaaccggtacgggtaaaacgggtttaacggtttaacccgggtttaggtttttaacggggg

SEQ ID NO: 129027 - DNA, 842 bp, Homo sapiens
  misc_feature: GYAE6OF01CGO6K.45.78.H01.1.454.CMB.1.raw
tcagacgcgatcgacacgaccggtgctcgatttagtgtgagtagtttggggtttgggggagtcagacccagtcaggacacagcatggacatgagggtccccgctcagctcctgggggctcctgctgctctggcctcccgaggtgacctaaatgtcgacatccagatacgacccagttcctcccttcccacctgtctgcatcgtaggtaggagacgagtacgtacaaccatcctaccgtcggcccgggtacctagtacgaagtagttaagttaacggttacggttgggttcggtaccgtaggtaatcgaacggtaacgaaacgggaaaccggaaacggggtaaaccgtacccccgtaagtcccgtaccgtcggtactacgtaagtaacggtactagttacgtttaaggtaacggtaaacgggttcgggtacctagtacgtaacgtacggacggcggtacggtaggtacggtatacgggtacggaactaaggttaactctaccgtacaccgtacactaccgacggtaccacgtacgacgtacgtacgtccgttagtaacgtttacggtttacttttaagaacctttaaaccgttatttacccgtaactaaccgtaaacttaggttaacttaacgttacgtttaaacgtttaccgggttaacggttacccgggttaaccggggaaccggttaaaaccggggaaccggtttaaaacggggtaaaccgggtaaaacgtaaacccgggtttaaaaccgtagggttaaccgggttacggtacccgttaacggaaccttaacccggtttacttaccggttttacccgttacctcccggttttaaacccgg

SEQ ID NO: 129028 - DNA, 631 bp, Homo sapiens
  misc_feature: GYAE6OF01D7YH0.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggagtgggatggatcaaccctaacaatggtggcacaaactatgcacagtaagttcagggcagggtcaccatgaccaggacacgtccatcagcacagcctacatggagctgagcgagctgagatctgacgacgaccggcgtgtacttacgtgtgcgaggaggacaggtattacgtattttgggagttggttagttcggacggtagtggacggtcgtcggggaccgtaacggggacctacggtcgacccgtcctccctcgcgtccctacccaccgaacggccctacgtccggttccctccccgtcggccctaccccgtccctacccgaacgaccggccgtaacccgtcggtaccgggggtaccaccgacggcccggcccggtcggccgtacgtcccgtggtaccgtaacggtacctacgttcccgtacgcgtaccggtccgtcgtaggaccggtcgggtcgtacgggg

SEQ ID NO: 129029 - DNA, 585 bp, Homo sapiens
  misc_feature: GYAE6OF01DNET1.45.78.H01.1.454.CMB.1.raw
  modified_base (128)..(128): a, c, t, g, unknown or other
  misc_feature (128)..(128): n is a, c, g, or t
  modified_base (310)..(310): a, c, t, g, unknown or other
  misc_feature (310)..(310): n is a, c, g, or t
  modified_base (313)..(313): a, c, t, g, unknown or other
  misc_feature (313)..(313): n is a, c, g, or t
  modified_base (316)..(316): a, c, t, g, unknown or other
  misc_feature (316)..(316): n is a, c, g, or t
  modified_base (345)..(345): a, c, t, g, unknown or other
  misc_feature (345)..(345): n is a, c, g, or t
  modified_base (439)..(439): a, c, t, g, unknown or other
  misc_feature (439)..(439): n is a, c, g, or t
  modified_base (446)..(446): a, c, t, g, unknown or other
  misc_feature (446)..(446): n is a, c, g, or t
  modified_base (547)..(547): a, c, t, g, unknown or other
  misc_feature (547)..(547): n is a, c, g, or t
tcagacgcgatcgacacgaccggtgctcgatttagtgtgagtagtttgggtttgggggagtcagacccagtcaggacacagcatggacatgagggtcccccgctcagctcctggggctcctgctgctntggctcccaggtgccaaatgtgacatccagatcgacccagtctccttccaccctgtctgcattctggtaggagacagagtaccacctatccgtacttcggcccggcagtcagtacgtattacgtacgtggttcgccgttggtatcagacaagaaaccgaggaacacccaagcctctgctcanagnatntagtagaagtcggacatcgaatcgagcgntaggtgatcgtagacagtaactcactcacactgcagcagcctgacacgtcagtatgttacttagacttaacttacgttactcgaacctaaggtntaagttntaacgttagttacgttcggttaaccgtacgggtaccgaacggggaacccgtaggttaaaccggaacgtaacccggtaaaacgaggttcggtacggttaccnggtaacccacgtattcccgttacttccgtaactacccg

SEQ ID NO: 129030 - DNA, 885 bp, Homo sapiens
  misc_feature: GYAE6OF01C7K54.45.78.H01.1.454.CMB.1.raw
tcagacgcgatcgacacgaccggtgctcgatttagtgtgagtagtttgggtttgggggagcatcacccagcaaccacatctgtcctctagagaactcccctgagagctccgttcctcaccatggactggactggagactcctctttcttgggtggcagcacgacccacgaggacgcccacctcccgagggtcgcaggtcgtggtcgcgtacggtcggtggggtcgtaggaagggtagaaaggaacggtccggtcggggccttacgaaggtacggtaacggttcctccgtaggacggtaacggtcgtttacgtacggtaaccttaaccgtacccgttaccgtaaccggtacctaacttaataactaaccgtacggttggggaccggtaccggacgtacccggtacccggtagggaacggtacggggtcttagggacgggtaggtaggtacgggtagtacggtaacctaacccgtaaaccgtaacggtaacggtcggggtaacggaactaaacctaaaacgtcgaacgtaaccgtaacggttaaacggttaacggtttaccggaaacgggggaccgtaaacgggggtaccctaacggtaccggtaaacgggacccggtaacgggtaccccgtaaaccgttaccgtaacgtaccggaacgaccgtaaaccgtaccgtaccgttaacgacgggtaccggacgtaacggaacggtaaccgggtacggacggtacggtaagtacgtaccgtacggtacgaaccccggtaacggtccgggtaaccgttacggttaacttaccgggtaggtacgggaacggtaacgggtaaccggtaacggttaaaccgggttttaggtttaaaccgggtttgggtttaacgggtttaagggg

SEQ ID NO: 129031 - DNA, 746 bp, Homo sapiens
  misc_feature: GYAE6OF01EGBY1.45.78.H01.1.454.CMB.1.raw
  modified_base (188)..(188): a, c, t, g, unknown or other
  misc_feature (188)..(188): n is a, c, g, or t
  modified_base (281)..(281): a, c, t, g, unknown or other
  misc_feature (281)..(281): n is a, c, g, or t
  modified_base (334)..(334): a, c, t, g, unknown or other
  misc_feature (334)..(334): n is a, c, g, or t
tcagacgcgatcgacacgaccggtgctcgatttagtgtgagtagtttgggtttgggggagcatcacccagcaaccacatctgtcctctagagaactcccctgagagtcctccgttcctcacctagtcggactggacctgggaggtactcccttcgtttcgttgggtcggacagcacgccacgaggacncccacctcccgaggtcgcgagcgtggtcgacgtaggtcggtggggctggaggtagaagacggtccggtgggcctacgagtacggacgtctcgngactagtcttgcgactacctacctcgacgtctactatactacgacgtgggtcncgacgccggtcccgtaggacgtacgggtcttaggaggtaggtaggtaggtacgtacggtaacctaacccgtaaaccgtaaggtacggtacggggtacaaccggtaaacctaacgtacgtacgaaccgtaaacggtaaaggtttacggttaccgggacggtacgggtaccgttaacccgaacgttacgggacggtaaacccgggcgtaaacccggtaccgtaacctacggtaaccgaccgaccgtaaccgtacgtacccgtagtacggtacgcgtacggcgacggtacgacggttgacgtacggtctacggaccggaaccgtaccggtacgtagttacgtaccgttagtcgggacggtaggtaggacggttagtaacggtttaaccgttttggttggttaccgggtttaaggg

SEQ ID NO: 129032 - DNA, 654 bp, Homo sapiens
  misc_feature: GYAE6OF01CYDVR.45.78.H01.1.454.CMB.1.raw
  modified_base (184)..(184): a, c, t, g, unknown or other
  misc_feature (184)..(184): n is a, c, g, or t
  modified_base (268)..(268): a, c, t, g, unknown or other
  misc_feature (268)..(268): n is a, c, g, or t
  modified_base (294)..(294): a, c, t, g, unknown or other
  misc_feature (294)..(294): n is a, c, g, or t
  modified_base (302)..(302): a, c, t, g, unknown or other
  misc_feature (302)..(302): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcgttggtggcagcagccacaggacgcccactcccaggtncagctggtgcagtcgtggggctgaggtgaagacgccgtggggcctcgagtggaaggttcctcctgctaaggcttcaggataccnccttacaccggtactactatactacncgtgggtnaccgacacggccctaggacgaagggtcttaggagtggagtgggatggactacgaaacctagaagtcggtaggacaaactaaactgtcgacgacgtaaggtaacgttacgacgggacgtaggggtaccaaccgtagtacggaaccgaacgggaaccctacggtaccaacgtccgacgacccacgtacgaccctagtacgtacggaacgtatacggacgacgtaacgggtgtaggaacgtcgtaccgtacggaaccggtaccggaccggttccgtagttaaacgttcgaggtcggaaccgggtaggacggtaacggtaaacggttaggtttaacgttgggttttggttaacggg

SEQ ID NO: 129033 - DNA, 706 bp, Homo sapiens
  misc_feature: GYAE6OF01ACYBT.45.78.H01.1.454.CMB.1.raw
  modified_base (211)..(211): a, c, t, g, unknown or other
  misc_feature (211)..(211): n is a, c, g, or t
  modified_base (339)..(339): a, c, t, g, unknown or other
  misc_feature (339)..(339): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacacgtgggtgcgacaggccccctggacaagggcttgagtggatgggatgactaccaaccctaacaagtggtgccaacaaactntgcacagtaagttcgaggcgaggtcaccagtagaccgaggacacgtcatcgacgcacacgtccacgaagtggacgcgtgacgcgagctaggacgactgtacggacgtacgaccgtcgtagtactacgngtacgacggagacgtacgtagtaacgtttagttacgtttaggacgtttagtaccggttaggtacgtaggtacggtacgtcggaacgggaccgtaacgggtaccctgggaccccgtaccgtacccgtacctaccgacgtacccgtacccctaaccggtaccggaccctacggttacccgtcccgttaccccgtccgaccctccccgtactacccgacgccctcgtacccggacgtaccgggacaccgtcggaccggtcgtaccgggtccttggacccgttaggtaaccgaaccggttccgttaaccgtcgtaaccgtacgttacccgtacggtaccggttacgggaccggtcgggtcccgtaaccggg

SEQ ID NO: 129034 - DNA, 646 bp, Homo sapiens
  misc_feature: GYAE6OF01BXCQY.45.78.H01.1.454.CMB.1.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtggggcctcgagtgaaggtctcctgcgaaggcttctggactacaccttcaccggctactatatactacgtaggtgcgacgacggcccgtcggacgaaggtcgttggagtggagtgggagtggactaccaaacctaacgtaagtgggtcggacaacgtaaactagtacgacacgaagtaacggtttacgacgggcgtaacgggtacaccgtagtacgacgaacgggacaccgtaccatcgacgcaacgacgacccgtaactacgtaggacgtcgtaaggacgggacggtacgggtcggtacgtaaacggggaccgtacgacggtaaaccgggacgtaccgggtacgttaggtaacgttccgttaagggtcgaacgggaggaaccggagttaacgggtaagtttacgggttaagttttggggttacggg

SEQ ID NO: 129035 - DNA, 600 bp, Homo sapiens
  misc_feature: GYAE6OF01BGPM3.45.78.H01.1.454.CMB.1.raw
  modified_base (197)..(197): a, c, t, g, unknown or other
  misc_feature (197)..(197): n is a, c, g, or t
  modified_base (535)..(535): a, c, t, g, unknown or other
  misc_feature (535)..(535): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcnggggctgaggtgaagaagccgtggggcctcgagtggaaggtctcgtgacaaggccttcgtggactacgtaccttccgaccggctactaatatacacgtgggtcgcgacgacggcccctggacaagggcttggagtggagtagggatggatcgaaaccctaacaagtggtacggacaacaactagtagacgacagtaagtttcgaggacgtacggtacaccgatacgacgacgggacacgtacatacagccacgacgtcccacgagtaggacgcgtagaggacgaggtacctaggagactcgtacgaccgaccgaccggtccggtagttacgtttacgnggttacggacggaggaacgggtacgaaggttaaacgtttacggtttaggttttgggttaaacggg

SEQ ID NO: 129036 - DNA, 781 bp, Homo sapiens
  misc_feature: GYAE6OF01DEKLW.45.78.H01.1.454.CMB.1.raw
  modified_base (253)..(253): a, c, t, g, unknown or other
  misc_feature (253)..(253): n is a, c, g, or t
  modified_base (274)..(274): a, c, t, g, unknown or other
  misc_feature (274)..(274): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcacatcacgtgccggccagtcagagtattagtaactggtggctggtatnagacagaaaccgagggaaacncccctaagctcctgctctagaagctatacttaaggtttaagaaaggtcgggtacccaagtacgtaagggttacgaggtcggactaagggtggaacttcggtacggggaacctaaggtaaactttacccaaccttcctaccgaaaccctacgttacgaacggtaccaacggtccccttaggacctaaacgggtcccttaaggtagttaggtttaaacgttttttcggaaaccctttaaacgttttaaactttaaccgtacggtaaaccccctaaagttaacggttaacgtttaagttaaacgtttacgggtttttaaaccgttaccggggttaacccggtttacccgggaaccgggtaaaaaccggggtaacccggtaaaaggggttaacgggtaaaaaaccgttaaccggtaaaaaaccgggtaaccttgggggtaacgggtcccttaagggtaacccctaaacccgttagttaccgttttcggtttaacctttcccggttaaaccc

SEQ ID NO: 129037 - DNA, 679 bp, Homo sapiens
  misc_feature: GYAE6OF01BS1BM.45.78.H01.1.454.CMB.1.raw
  modified_base (287)..(287): a, c, t, g, unknown or other
  misc_feature (287)..(287): n is a, c, g, or t
  modified_base (658)..(658): a, c, t, g, unknown or other
  misc_feature (658)..(658): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatcgacccagtctcccttccaccctgtctgcatctgtaggagacagacgtccaccatccacgttcggcccggcagtcagtagtattagtacgtggtgccgtggtatcgagacaacggaaacgaggaaccnccccgtaagcctccgtcgacttacgtagtaacggcctattacgttaaggtttaaggaacgggttcgggtaccctaagttaccgtaaggttcgacgggcggtacgtaagggtcggacgttcgggtaagggaacctaacggtaactttacccgtacttaccgtacccaaaccctagtacccgacggtccaacgtcccgtagaccacgtccgtagtagttagtttacgtttacgtaaccttaacgtttaactaccgtacgtaacctaacgtagttatagtaactttagttaccttacggtaccggtaccggaacggtaacggtacgaaggttacgaaacgtacgtaaagtcgtagtcggctacgtacgtacctnttaccgtcgtccttcgtcccc

SEQ ID NO: 129038 - DNA, 665 bp, Homo sapiens
  misc_feature: GYAE6OF01A11JW.45.78.H01.1.454.CMB.1.raw
  modified_base (193)..(193): a, c, t, g, unknown or other
  misc_feature (193)..(193): n is a, c, g, or t
  modified_base (574)..(574): a, c, t, g, unknown or other
  misc_feature (574)..(574): n is a, c, g, or t
  modified_base (630)..(630): a, c, t, g, unknown or other
  misc_feature (630)..(630): n is a, c, g, or t
tcagacgcgatcgacacgaccggtgctcgatttagtgtgagtagtttgggtttgggggagcatcacccagcaaccacatctgtcctctagagaatccccctgagagctccgttcctcaccatggactggacctggaggatcctcttcttggtggcagcagccacaggagcccactcccgaggtgcagcttggngcagtcgtgggctgaggtgaagaacgccgtgggcctacgagtggtaaggtcctccgtagacgaacggtcttccgtaggactaacctacccgttaccaccggtactaacctaattactacgtacgtgggtcgacgacgaccggtccccgtaggacgagggtctacggtagtacggaggtcgggaagtacggtactacgtaaacccgtaaacagtacggtacgaccgtaacaaacgtagtacgacgaacgtaacgttaagttacggacggtacgtagggtaaccacctagtacgaaccgaacggtacgaccgtacgactacgacgtaccaacgacgtacccgtagtacgtacggagtcgacggtacgaccgagtcgtaggaanaccgtacgtacggaacaccggtacgtaccgtagtacgtacgtggtacgcgaacggngtaacgtagtaacgttacgttgtttaggtaacggg

SEQ ID NO: 129039 - DNA, 654 bp, Homo sapiens
  misc_feature: GYAE6OF01AVFHI.45.78.H01.1.454.CMB.1.raw
  modified_base (538)..(538): a, c, t, g, unknown or other
  misc_feature (538)..(538): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtagaagaagccgtggggcctcagtggaacgggtctccgtgacaaggtcttcgtggactactacccttcgaccggtcctaactatatacacgtgggtacgcgacgacggcccgtaggacgaacgggtcttggagtcggtagtagggagtggtactaccaaaccctaaacgtaagtcggggtacgaacctaacgaaaaccttagacgtaccaacgtaaaggttaacgtttaccggaacgggtacgtacgggtaccaaccgtagtacggaaccgacgggtacaccgtaccgacgtacgacgacctaacgacgtaccctagacgtcgggaacncgtaggacgacggacgtcgtagacgtacgtcgtagaccggacgtaccggtcgttaggttacgttagtcggcgacgagtacggagttaacggtaagtttacgttggtttggtaaggg

SEQ ID NO: 129040 - DNA, 734 bp, Homo sapiens
  misc_feature: GYAE6OF01CU6EI.45.78.H01.1.454.CMB.1.raw
  modified_base (471)..(471): a, c, t, g, unknown or other
  misc_feature (471)..(471): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatacaaccctaacaatggcggcaacaaactatgcacagtaagttcgagggcagggtcacatgaccgagggacacgtccatcgagcacacgcctaacagtaggacgtcgtagacgacgtacggctggaagactccgtacggaaccgacgaccggtcgttagttaacgttacgtgtggaccgaggaggacgaaggtaatttacggttagttttagggacgttaggttacgttacgggtacggttagtggtaacggtcgtacggggaccgtaacgggaccgtacgggtccacccgttntacccgctaccgccctaccgaaaccggacgggacccctaggttccccggtaccccttccccggtacgaccccttaccccgttcccgtaacgaaccgggtcctaccccggtaccgttaccggggtaccggggaacccaacgggtcccggttccccggggaccggtttcgggacccttcgggcccgttaccgggtacgtaacccggtaccttccgtcccgtacggtacgttcccgacggttctaggcgggccggtggtacccggg

SEQ ID NO: 129041 - DNA, 762 bp, Homo sapiens
  misc_feature: GYAE6OF01EC4DA.45.78.H01.1.454.CMB.1.raw
  modified_base (206)..(206): a, c, t, g, unknown or other
  misc_feature (206)..(206): n is a, c, g, or t
  modified_base (281)..(281): a, c, t, g, unknown or other
  misc_feature (281)..(281): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaaggcttgagtggatgggatggatccaaccctaacaatggtggacacaaactntgcacagaagtttcgagggcagggtcaccagtcgaccgagggaccaccgtcatcagcacacgcctaacagtgganctagagcgaggctagagtacgtcgtacggaaccgaccggaccgggtccggttagttactttaccgtgggtgaccggtaggacggtacgtaaggttaactttaacggtttagtttttaggggtaggtttacgggtttacggttacgggtaacggttagtaggggttaccgttcgggtacggggaccggaacgggtacccgtaccggttccgtaacccgttcctacccgtctaccgtccctacccgaaccggtacccgggccctacggttccccgttccccgtttcccccgtccgggacccctaccccttccgtaacccgaacgaccggtaccctacccgttcggacggggtacccacggaccggcccggtacccggtcggcccgtccggtcccgttggtaacccgtaaccggttaccgttaccccttccgtaccgcttaccccgggtcggttcgtacgggaccgggtgggtcccggtacggg

SEQ ID NO: 129042 - DNA, 804 bp, Homo sapiens
  misc_feature: GYAE6OF01AYHHE.45.78.H01.1.454.CMB.1.raw
  modified_base (282)..(282): a, c, t, g, unknown or other
  misc_feature (282)..(282): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacgagtaagtttcgagggcagggtccaccatcgaccgagggaccacgtccatccagcacagacctacagtggancgtggacgcgaggctaggagtacgtcgtaggaaccggaccgtaccgggccgttagttacgttaccgtggtacggacggaaggacggtacgtaaggtaactttacggttagtttttagggaggtttgggttaacgttacggggtaacggttagttacgggtacggttaccgggtacgggggaacccgaaacggggtacccgtaccgggttacccgtacccgttccgtacccgtacgaccgtccccttacccgaaccggtaaccggggtacccctacggttcccggttaccccttcccccgacggtaccccctaccccgtccctaccgaacgtaccgtacccgtaacccggttcgggaccggggtacacccggtaccgggccccgggtacccggtcggggtaccgttccggtacccggttcgggtaacctaacccggttcccgtttacccggttcccgtaccgggttaccgttcccggtccggttaaccggtacgggaccgggttccgggggcctaaccggggg

SEQ ID NO: 129043 - DNA, 836 bp, Homo sapiens
  misc_feature: GYAE6OF01ATMBH.45.78.H01.1.454.CMB.1.raw
  modified_base (137)..(137): a, c, t, g, unknown or other
  misc_feature (137)..(137): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtncgacaggcccctggacaagggcttgagtggatgggatggatcaaccctaacatggtgcaaccaaactatgacacgaagaagtttcagggccagggtcaccatcgaccgaggtaccacgtccatcagcacagacctacagtcggacgtctaggacgcgaaggccttaggaacgacttcgtacggaaccgcgaaccgggtccttgtaactttacgtggtacgacgtaggacggtacgtaaggttaaacgtttacgtttacggtttttaggggagtttaggtttaacggtccgggtaagggttagttacgggtcggttaccgggtcgggggtaacccgaaacggggacccgttaccgggtaccctacccggttaccgtaccccgtaccgtaccggtcccctaccccggaaccgggaaccccggttacccgtaaccggttccccgggtttacccccgttttcccccggtacccgggtacccctaacccccgtttcccgtaaccgaaccccggtgaacccccgtacggttcccgggtaaccggggacccgtaaccggtcccgggtccccgggtaccgtccggggtaccttccgggtccccggtacggtaaccggtaaaccgttacccgttaaccggttccccgttaagtacccggttccgacccggtttccggtaagggtcccgggtcgggccgtaacccgggg

SEQ ID NO: 129044 - DNA, 805 bp, Homo sapiens
  misc_feature: GYAE6OF01DIOH0.45.78.H01.1.454.CMB.1.raw
tcagacgcgatcgacacgaccggtgctcgatttagtgtgagtagttttggtttggggtgaagaagcctggggcctcagtgaaggtctcctgcaaggcttctggatacaccttcaccggctactatatacactgggtgcgacaggcccctggacaagggcttgagtgatgggatggatcaaccctaacatggtggacacaaactatgcacagtaagtttcagggcagggtccacctatcgaccagggacacgtccatcagcacacgcctaacagtggacgcgtgaacgcgaacggtgtagacgtattccgtaggaccggacgtaccgggccgttaggtaactttacgtcgtaggaccggaaggacggaccgtaaggtaactttaaccggtttaggttttttagggaggttttagggttaacgtttacggggaagggtttacggtggtaaccggttcgggtacgggggtaccgaaaggggtaccccacggtccgtaacccgttccgtcccgtaccgtacgtccccgtacccgaaccggaaccgggtcccctaacggttccccggttacccctttacccccccgtcgggtaccccctacccccgtttccccgtaacccgaacgtacccggtaacccttaaccggtcccggggttaccgggggacctaaccggcccgggtccggtaccccggtcgggtcccgtcggtccccggttagggtaacccggaacggttacccttaccgtttacccgtacggtaccgttcccggtacggttcccgagggtaaccgggccgggttcgaaccgggg

SEQ ID NO: 129045 - DNA, 623 bp, Homo sapiens
  misc_feature: GYAE6OF01AGRQ7.45.78.H01.1.454.CMB.1.raw
  modified_base (345)..(345): a, c, t, g, unknown or other
  misc_feature (345)..(345): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggctcagtgaggtctctgcaggcttctggatacgaccttcaccggtctactatatacactgggtgcgacgacggcccctggacgaagggcttgaggtggagtgggtatgggatccgaacctaanaagtcgggtggacaacaaactagtgacacagtaagtttcgagggcgagggtcaaccgagtacgaccgtacgggactacggtaccatacgacgacacgacgtcctaacgagtacggacgtcgtaggaacggccgaacgggtcgtaagggagtaaccgtcggtaaggaacccggtaacgtacccggggtaccgttacggttaacgttaccgttagggtcgggacgaagggacgggtaccgtaagggtaaacgtttacggttggttttagggttaacgggg

SEQ ID NO: 129046 - DNA, 769 bp, Homo sapiens
  misc_feature: GYAE6OF01BZ927.45.78.H01.1.454.CMB.1.raw
  modified_base (150)..(150): a, c, t, g, unknown or other
  misc_feature (150)..(150): n is a, c, g, or t
tcagacgcgatcgacacgaccggtgctcgatttagtgtgagtagtttgggtttggggagtcagacccagtcaggacacagcatggacatgagggtccccgctcgagctcctggggctcctgctgctctggcctccgaggtgccaaatgtnacatccagatcgacccagtcctcccttccacctgtctgctatctggtaggagacgagagtccaacactcacgttgcccggaccagtcaggagtagttaagtaacgttggtcggaccgttggtactcgagaccgaacgaaaccgacgggaaactcccgtaacgtcgtccctagtctacttaacgtagtacctagttacgttaaggttaacggaaacgggttccgggtacctaacgttcgaacgggttcacggtacgtacgtaggtacggtagtcggtaacgggactaacggaaccttcctaaacgttccttaaccaccgtaagttaccgaacgccgtaacggtccttacggaaccttccgcgttacgtaagttcgtttacttttaacgacctttaaccgttacgttaccgtacgtaacccgttaaagaacgtttcgtaacgtttaagtttaaccgtttagttaaccccggttacggttaacccggtaacccgaacgggggtaaacccttaaacgggttacgtaaaaccggtaaacctttaaaacggggactttacggggtaccgacgtacgttaacccgaaccgtttatttacccggtttcccttaagttaaccccttcg

SEQ ID NO: 129047 - DNA, 879 bp, Homo sapiens
  misc_feature: GYAE6OF01C03C3.45.78.H01.1.454.CMB.1.raw
tcagacgcgatcgacacgaccggtgctcgatttagtgtgagtagtttgggtttggggagagcatcacccagcaaccacatctgtcctctagagaatcccctgagagctccgttcctcaccatggactggacctggaggatcctcttcttgggtggcagcagccacaggacgcccactcccaggtgcagctggtgcagtcgtggggctggaggtgaagacgccgtgggcctcgagtgaaggtcctacgtgacgaaggtccttcgacggtactaacctacccttcgacccggtacttacctaatactaccgacgttgggtcggaccgaacgaccggaccccgttagggaacgaacggggtcttagggaaggttgggaaggttgggggaattcgggaacgttaaacccaaacccgttaaaacgtaacggttagggtacggaacctaaaaacgtaaaacgtacttacgggaacctaaacgtaaagggttaaacggtttaccggaaacggggttaaccgtacgggggttaaccctaaccgtaaacgggttaccggaaaccgggaaccggggtaaaccctaaccgggtttaacccaacgttaccggaacgaaacccgtaacccgtaaccggtaaccctaacgtaacgggttagggaacgttaaccgacggggaacgacgggtacggtacgtaacgggtaagtaccgttaccggaacgggtaaacccggacccgggttaacgggtaccccggttttaaggtttaaaccgtttaaccggttcggggttaaaccgggacgggtaaaacggggtaaccgggttaaaaccggttaagggggttttaaaacgtttaaccgggggttttttaaggttttttaaaacgggggg

SEQ ID NO: 129048 - DNA, 851 bp, Homo sapiens
  misc_feature: GYAE6OF01DZ8L7.45.78.H01.1.454.CMB.1.raw
  modified_base (261)..(261): a, c, t, g, unknown or other
  misc_feature (261)..(261): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtgcacaaactatgcacagtaagttcgagggcgagggtacaccatcgaccgaggacacgtcatcagcanacgcctacagtggagccgtaggacgacgaggcgtacgagtagttcgtacggaaccggaaccgacccgggtcgttaggttactttacgtggtacgacggtaaggacggtacgtaaggtaaacgtttacggtttaggtttttagggaggtttagggtttaggtttacccggggtaaggtttacggtacgggtaccgggttcgggtacgggggaaccgtaaacggggtacccgtaacgggtacccgtacccgttcccgtccccgtaccgacccgtacccctaaccccggaaccggaaacccgggtccctaaccggttccccggtttaccccgttaccccccggtcggtacccccttacccccgttacccgtacccgtaaccgggtacgtaacccccgttaccgggttaccggggtacccgggggtacccaaccgggttacccgggccccgggttccccgggtcggggttaaccccgtccggtacccgggttccgggttaaccggtaacccgggttaaccctttacccggttcccgtaccggtacccgttccggtacccggttcgagggtttaccgggcggtcggtacccgggg

SEQ ID NO: 129049 - DNA, 850 bp, Homo sapiens
  misc_feature: GYAE6OF01CCHT7.45.78.H01.1.454.CMB.1.raw
  modified_base (138)..(138): a, c, t, g, unknown or other
  misc_feature (138)..(138): n is a, c, g, or t
  modified_base (198)..(198): a, c, t, g, unknown or other
  misc_feature (198)..(198): n is a, c, g, or t
  modified_base (308)..(308): a, c, t, g, unknown or other
  misc_feature (308)..(308): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactggggtncgacacggcccctggacgaagggtcttggaggtggagtgggatggataccaaaccctaanagtgggtgacaacaaactagtcgacacgaagtaacgtttcgagggcgagggtaccaccagtcggaaccgagggacctaccggtaccatacgacgacacgaccgtcctaanaggttacgacgtcctaggacgacgaggtccgtagacgtacgttcacggaaccggtacgaccgggttaccggttagtttaacgttacggtcgggtacggtacgggaagggtacggtaaggtaaacggttaacgtttagggttttaggtttttaggggaggttttacgggtttaacggtaccgggttaagggtacgttacggggttacggtacggggtaccgggaacgaacggggtaccgtaccggtaccgtaccgtccgtccgtacgtaccgtacccgtacccgaaccgtaccggtacccgtacccgttacccgttccccgttacccggtacccgtacccctaccccgtacccgtaacccgaaccgtaccgtacccgtacccggtccgggtaccgggtccgaaaaaaccggtcccgggtaccggtacccggtcgggtacccggtccggtccggtacggtaccggtaaccggtaccgttacccgttcccgtaccgtaccgttccggttaccggtacggtacggtcggtccgggtcggtaccggg

SEQ ID NO: 129050 - DNA, 760 bp, Homo sapiens
  misc_feature: GYAE6OF01DFW7B.45.78.H01.1.454.CMB.1.raw
  modified_base (332)..(332): a, c, t, g, unknown or other
  misc_feature (332)..(332): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggagtgggatggactccaaaccctaacaatgggtggacaactaaactatcgacacgtaggtaacgtttcgagggcgaggtacactaacgtcgaccgagggacctacgtacctatccgagccaactaccggcctaacgtagtcgggaacgtcgtaggagccggacggngtacggagacgttacgacggaacgaccggtccggtacgttagtacttacggtgcggtaacggagacggtacgtagttaacgtcgtttagtttggtacgttggtacggtggtacgtaggtggtacggttcgcgggtaacggacggtaccgtcgtacccgaccgtccgtacctccgtaccgtcccaaccgaaccgggtaccgtacccgtaccggttacccgtccccgttcccgtaccgtcccctaccccgtacctaaccggtaccgacggtacccgtaccggtcggtaccgggggacctaccggcccggtaccggtcccggttagggcccgtccgtaccgtcggtaaaccgtaccggtacccttacccgttccgggtaccgtaccgtcccggtccgttacgggtaccgggtacggtcggcgggtaccggg

SEQ ID NO: 129051 - DNA, 665 bp, Homo sapiens
  misc_feature: GYAE6OF01DLTMR.45.78.H01.1.454.CMB.1.raw
tcagacgcgatcgacacgaccggtgctcgatttagtgtgagtagtttgggtttggggagagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtgggcctcagtgaaggtctccgtgcgaaggtcttcgtaggactacctaccttccgaccggtccttaactaatactacctacgtggggtcggaccgaaccgacggccccgtgggaaccgaaggggtcttgggagtcggagtgggatggactaccgtaacccgtaacaagtgggacggacaactaaactatcgcaagagtaacgtttacgaagggcgtaacgggtccaccgagtacggaacgaacgggacctacgtccacgtacgacgaccgacacggaccctacgacgcgggacacgtaggaacgacggtaggtacgtaggtaacgtctacggtaccgaaaccgggtccgaaccggggtaccgttggttaacttacggttcggtaccggacggtaaggacgggtaacggtaagggttaaacttcgggtttaggttttaacggggg

SEQ ID NO: 129052 - DNA, 694 bp, Homo sapiens
  misc_feature: GYAE6OF01BLNGG.45.78.H01.1.454.CMB.1.raw
  modified_base (188)..(188): a, c, t, g, unknown or other
  misc_feature (188)..(188): n is a, c, g, or t
  modified_base (207)..(207): a, c, t, g, unknown or other
  misc_feature (207)..(207): n is a, c, g, or t
  modified_base (212)..(212): a, c, t, g, unknown or other
  misc_feature (212)..(212): n is a, c, g, or t
  modified_base (275)..(275): a, c, t, g, unknown or other
  misc_feature (275)..(275): n is a, c, g, or t
tcagacgcgatcgacacgaccggtgctcgatttagtgtgagtagtttgggtttggggtgaagaagcctgggcctcagtgaaggtctcctgcaaggcttctggatacaccttcaccggctactatatacactgggtgcgacaggccccctggacaagggcttgagtggatgggatggatcaaccctaanaagtggtggcaacaacgtntgcanagtaagttcagggctagggtcaccatcgaccgagggaccacgtccatcgagctacacgcctanagtcggaagctgaacgcaggtctaggacgtatcgtagaccgacgccggtcgttagtacttacgtgtcgacgaggacggtgaagttacgttacggttaaggttttggggtaagttacgttcggacgttagttcgggaccgttcggtcggggaccgtaaagggtccctacggtacctacccggttctaccgtcaccgtcctaccgaccgaaccggtccacggttccgtcccgttcccgtcgcccctcccgtacgtacctagaccgtacgaccgtcgggtacgggtaccacgtaccggcccgtaccgtcggtacctcggtacgtacgggtaccgaaccgggttcctaccgttccgttacccggacggttcccgtcccggttaaccggcgggtacccggccgggtaccgttcggaaacccggg

SEQ ID NO: 129053 - DNA, 668 bp, Homo sapiens
  misc_feature: GYAE6OF01AO2WX.45.78.H01.1.454.CMB.1.raw
  modified_base (201)..(201): a, c, t, g, unknown or other
  misc_feature (201)..(201): n is a, c, g, or t
  modified_base (281)..(281): a, c, t, g, unknown or other
  misc_feature (281)..(281): n is a, c, g, or t
  modified_base (293)..(293): a, c, t, g, unknown or other
  misc_feature (293)..(293): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatcgacccagtcctccttaccaccctgtctgcatcgtgtagganacgagagtcaccatcacgttcgccggacagtcagagttatagtaacgtggtcgcctgtatcagacaacgaacgaggaacnccctaagctccncgactacgtagacgactatacgttaaggttaacgaacggtcgggtacctagtacgtaaggtcaggcggacaggtggacgtcgtacgggaactaagtaacgtttcccgaacttaccgtaccaaccgtactacgacgtacgaccgtaccgtcgtacaacgtcgttagatttacgtactttacgaacttaactttataccgttatactaacgtaacgttactttaacaccgtttacccgtacggttactaaccggttaccggaaccgtaaacgggtacccggtaaaggtaaaccgtaaacgtacccgaaaagggttacgtcggtacggtacgtaccgaccctaacggtaccttgttacccgttcttaacccgttcccg

SEQ ID NO: 129054 - DNA, 716 bp, Homo sapiens
  misc_feature: GYAE6OF01EY6IF.45.78.H01.1.454.CMB.1.raw
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatcgacccagtcctcccttcccaccctgtctgcatcgtgtaggagacagactcaccatcacgttggcccggcagtcgagtagtatagtacgttggttgcgtgtatcgagacgagaacgaaggaaacgccctaagcctcctgctactagtaagctagtcttaggttaagaacggtcgggtaccagtacgtaacggttcgacggcggacgtaggtaggtacgttcgtagggaacgaagtaacgttacctacgttactaccactactacgacgacctacgtccgtcgacacgtcctaggtacttacgttatttacgtaaccttaacgtttattaccgtacgtacccgtaaagtaacgttagttaacgtagttttaacggtttaaccggtttaaccggttaacccggttaaccggggtaacccgtaaacggggtaaacccggttaaaggggttaaaccggtaaaacgttaaaccgtaaaccggtaaaggttacgggttaccggaccgtaacggtaacccgaaccgttactttacccggttacgttacctttcccgtaaccccg

SEQ ID NO: 129055 - DNA, 844 bp, Homo sapiens
  misc_feature: GYAE6OF01C2P4S.45.78.H01.1.454.CMB.1.raw
tcagacgcgatcgacacgaccggtgctcgatttagtgtgagtagtttgggtttgggggagtcagacccagtcaggacacagcatggacatgagggtccccgctcagctccgtggggctcctgctgctctggcctcccgaggtcgaccaaatgtagacatccaagatcgaccctagtccttccctcccaccctgtctgcatcgtaggtaggagacgagacgtccacctactctacgttcggcccggacagtcgagtaagttatttaacggtaacggttgggttacggtccgttaggtactcgacgaacgaaaccggaaaccggaacgggaaaccgtaccccgtaaggtccttcccgtacgtacttacgtaacgtaacggtacttactttaacggttaacggtttaaacggaacgggttaccggggtaacctaacgttaaccggtaacggttacggacggtacggtacggtagggtacgggtacgtacggtaacgggaactaacgtaacttaccgtaccttaccgtaccgaactacggtacacgtaccgtacgtccgacgtacggtacgtacgttacgtagtttacgtttaacgtttactaacgtttaacctttacttaccgtaacgtaacgtaacgttaacgttacgttaacgttagtttaacgtttaaccggttaccgggttaaccggttaacccgggaaccggtaaacgggtaaaccggtaagggtaaacccgtaaaacgttaaaccggtaaacgggttacggttaccggtacggtaaccccgtacggttaccccgtaaacgtttaacgtccgtttaaccgtttcccgttaaccgttaccccg

SEQ ID NO: 129056 - DNA, 868 bp, Homo sapiens
  misc_feature: GYAE6OF01AMUT3.45.78.H01.1.454.CMB.1.raw
tcagacgcgatcgacacgaccggtgctcgatttagtgtgagtagtttgggtttgggggaggagcatcacccagcaaccacatctgtcctctagagaatcccctgagagctccgttcctcaccatggactggactggaggatcctcttcttggtggcagcagccacaggacgcccacctcccaggtgcgacgtcgtggtcgcgagtccgtggggcgtggaggtaggaagaacggccgtcgggggacctcgaggtcggaacggttcctccgtcgacgtaaggtcctttcgtacggtaactaccgtaccttaccgacccggtacttaaccttaatacgtaccacggtggggtcgaccgtacgaccgggtcccccgtagggaacggaacgggttcgtttacgggaacgggttagggtaggttacgggggtaacgttacggaaccgttacccggtaaaaacccccgttaaacggtaaaggtttacgggggttaccggaacctaaaacccgtaaaacgttacggtaacggaaccctaaaccgggttaaaggtttaacccggtttaggaacccggggggtacgtaccggggtaacctaaaccgtaacggttaaccgggtaacccgggtaaacggggtaacccgtaacccggttaaccccgtaaggtacccgtaaccggaacccgaaccggtaaccgtaacccgttaaccgtaggtaccggggactacggtaggaccggaacgtcgacgttaggacgtactcggtaccggacgtacccggcggtacggttacgtaagttttcggaggtaccggtacgggaacggttaaccgggtaacgtaacgggtttaaccgtttaagggtttgtttaacggggg

SEQ ID NO: 129057 - DNA, 544 bp, Homo sapiens
  misc_feature: GYAE6OF01C0LO4.45.78.H01.1.454.CMB.1.raw
  modified_base (328)..(328): a, c, t, g, unknown or other
  misc_feature (328)..(328): n is a, c, g, or t
  modified_base (365)..(365): a, c, t, g, unknown or other
  misc_feature (365)..(365): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgcccgggcagtcagagtattagtaactggttagcctggtatcagcaagaaaccaggaaacaccctagcctctgctacataggcatctagttagaagtcgggtccagtcaagtnagcgcagtgatcgtggacagaatcactctcacatacngacacgctgcagtctagtactgtatttgaccttaacgtttattacctgacctaacgtagtaacgttgtaattagtttagtccgtacgttaccggaccgtaagggacctaaagggtacgaaataccgaaaacgtagtacggtggcctacgacctaactattagtcgttacttcgtacccg

SEQ ID NO: 129058 - DNA, 658 bp, Homo sapiens
  misc_feature: GYAE6OF01A9879.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccaggacacgtccatcagcacacgcctacagtggacgcgtgagcgaggctggagatctgacgacacggcgtgtattacgtgtgcgagaggacgaggtaattacgtagttttggagttggttagttcgggtacggtagtggcgtcggtcggggccgaacgggaccgtacggtcacccgtcctccctcacgtccctacccaaccgacgggtcccacgtcccgttccttccccccgtcgccctaccccgttcccaccgaacgccgacccgacccgttccgggtacgggggtacccaaccggccgggaccccggtcccggtacgggtccgtccggtccggtacgggtaccgtaaacggttacccttaccgttcccgtaccggtacgtccggtaccgttcgtacgggcgggtccgggcgtacgggg

SEQ ID NO: 129059 - DNA, 995 bp, Homo sapiens
  misc_feature: GYAE6OF01EY22S.45.78.H01.1.454.CMB.1.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggacgccccactcccgaggtgcagcgtggtgcagtcgtggggctggaggtagaagaagccgtggggcctcgagtgaacggtctccgtgcgaaggtcttcgtggactaccacccgttcgacccggtactaactatataaccacgtggggtacgcgaaccgaccggtacccccgtagggaacgtaacggggtcttagggtacggttagggtaggttaggggtaagttacgggtaaccttaaacccgtaaaaaccccgttaaaacgtaaacggtttggggtaaccgggtaaccaaaacccgttaaaaacgttaacgttaaccggaaccgttaaaaacccggtaaaagggtttaaaacggtttttacccggggaaacggggtacccgggttaaaaccgggggggttacccctaaaacccgggtaacggtttaaccccggggaaaccccgggtaaaacccgggggggtaaaacccccgttaaacccgggttaaccccgtaaacccgtttaacccggaacccgggtaaacccgttaaaccccgggaaacccggttaaaccccgttaaacggttaaccggttaacggggtaaccggtaccggtaaccgggaacggggaacccggtacgggggttaacgtaacgggtaaaccggtacttaccgggtaaacccggtaacggtaaacccgggtaaacccgggtttaccggttaaggtttaaacccggtttagggttacgggtaacggtaaccggggtaaagggtaacggtaacgggttaaacgggtttaaaacgggtttttaaccgggttttaagggtttttaacggggtttaaacggggg

SEQ ID NO: 129060 - DNA, 685 bp, Homo sapiens
  misc_feature: GYAE6OF01DVXA5.45.78.H01.1.454.CMB.1.raw
  modified_base (388)..(388): a, c, t, g, unknown or other
  misc_feature (388)..(388): n is a, c, g, or t
  modified_base (436)..(436): a, c, t, g, unknown or other
  misc_feature (436)..(436): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacatggtgcacaaactatgcacagtaagttcagggcagggtcaccatgaccagggcacgtccatcagcacagcctacagtggagtcctaggacgtcgaggctacgagtatcgtagacgacgacggtcgttagttacttctgtgacgagtaggacaggtaacttacgttagttttggagttaggttacgttcgggacggttancgggtaacgtcggtagggtaccgaagggaccgtacggtcacccgtacnccttcgacgtccctaccgaccgaacgggccctacggttccggtacccttccccgtggccccacccgttccgacccaagccgtacccaccgtcgggtaggggaccctacggtaccgggccccggtaccgtcgggacccttcggccccggtttagggacccgtaaacccgggttaccttacccggttttcccacccgggtacgttcccggtccggttacgtaggaccgggggtccggggtcgtaaccgggg

SEQ ID NO: 129061 - DNA, 1026 bp, Homo sapiens
  misc_feature: GYAE6OF01C57A3.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaaccctaacaagtgggtggacaacaaaactagtcgacaacgagtaacgtttcgaggggcaggggtccaaccagtacgaccgagggaccaccgtaccagtcacgccacaacgccctaacgagtggacgcgtagacgcgaggctgagactacgtgaacggacgaccggtccgttagttacttacggtgtcggacggaaggtacggaacgtaaggttaacgtttaacgtttaggttttttacgggtaacgggtttacgggtttaacggttaccgggttaacgggttaacgtacggggttaaccgggttcgggtaaccgggggaacccggtaacgggggtaaccccgtaccgggttacccgtacccgttcccgtaccccgtaccgtaccggtaccccccgtaacccccggaaccccgggtaaaccggggtccccccgttaaaccgggtttccccccggggttttacccccccgttttacccccccccgggtacccgggtaccccccccgttaacccccccggttttacccccgtaaacccccggtaaaaccgggtaccccccggttaacccccggttaaacccccggggtttccccgggggtaacccggggggtaccccggtaacccggggaacccccggggttccccccggggtcccccggggttagggggttacccccggttcccgggtaccccgggggttacggttaaacccgggtaaaacccggggttaccccgttttaaccccgttttaaccccggttaccgggtttacccggttaccggttttaacccgggttaccggttaccggggaacccggggttccgggggtaacccgttaaccgggggg

SEQ ID NO: 129062 - DNA, 609 bp, Homo sapiens
  misc_feature: GYAE6OF01DIEXD.45.78.H01.1.454.CMB.1.raw
  modified_base (593)..(593): a, c, t, g, unknown or other
  misc_feature (593)..(593): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggccccctggacaagggcttgagtggatgggatggatcaaccctaacaatggtggcacaaactatgcacagaagtttcagggcagggtcaccatgaccagggaccacgtccatcagcacagcctacatggagctgagcaggctgagatctcgacgacacggccgtgtattactgtgcgagaggacgaggaattacgtagtttttaggaggttggttagttcggtacggttagtggacggtcgtggggaccgtaacgggaccgacggtcaaccgtcctcctcacgccctccaccgaacggccctacgtccggtccttcccccgtcggaccctacccctcctacccaacgacgacctaccgtcggtcgggggccaccggtcggacccggtcccgtgggcctcggccgttggacgaacggtacttccgttcctcgtacgtccgtcgttacgganacgggcggcggtacgg

SEQ ID NO: 129063 - DNA, 856 bp, Homo sapiens
  misc_feature: GYAE6OF01CWDRR.45.78.H01.1.454.CMB.1.raw
  modified_base (139)..(139): a, c, t, g, unknown or other
  misc_feature (139)..(139): n is a, c, g, or t
tcagacgcgatcgacacgaccggtgctcgatttagtgtgagtagtttgggtttgggggagtcagacccagtcaggacacagcatggacatgagggtccccgctcagctcctgggctcctgctgctctggctcccaggtnccaaatgtgacatccagatgaccctagtctccttccacctgtctgcatctagtaggagacagatcacagtcacgttcggaccggcagtcagtatatagtaacgtggtcgtctagtatacagacgaacgaaacgtaaggaaaccaccgtaagccctctagtactacgtaagtaacggctaacttcgttaaagtttaacggaaaacggttccggggtaacctaacgttaacggtaaacggtttcgaacggtcggtaacgtaaggtacggtaacgttacgggtacgggtaactaaacggttaaacttccgtaaaccgttcccttaaaccgtaaacccaacttaacgaacggaaccccgacggtaccccttaacggggacccgaaaccgttaccggtttaaggtaacgttttggttttaaacgttttccggtaaaaccctttaaaacgttttaaaccgtttaacccgtaaacggttaaacccctaaaaccggttaaagttttaaacggtacgttaaagtttttaaaccggtttaaggttacccccggttaaacggggttaaccgggtaaaccgaaaacggggggtaaaccgtaaaacggggtaaaggttaaaaaccctaaacggaaaaacccggtttaaaggcggtttaacgggaccctttaggaaaccccgtaactttaacgtcccgttttaaaccgttccgtttaacccttaaacccgg

SEQ ID NO: 129064 - DNA, 712 bp, Homo sapiens
  misc_feature: GYAE6OF01AMKBI.45.78.H01.1.454.CMB.1.raw
tcagacgcgatcgacacgaccggtgctcgatttagtgtgagtagtttgggtttgggggagagcatcacccagcaaccacatctgtcctctagagaatcccctgagagctccgttcctcaccatggactggacctggaggatcctctttcttggtggcagcagcccacaggacgcccacctcccaggtgcagctgggtgcagtcgtggggctggaggtgaagaggccgtggggcctcgagtggaaggtcctccgtgacgaaggtcttcgtggactaccaccttcgacccggtctactatactacacgtgggtcgcgacgacggccccgtagggacgaacgggtcttaggaggtaggaggtgggagtaggactaccaaaccctaacgaagttcggtacggacaaaccaaactagtacgaccgaacgtaaggttaacggttacggacgggtaccggtacgggtaacccaaccggtacgtaccggaaccggtaaccgggaaccgtacccgtacctaacgtccgaacgaccaccgaacgtacctacgtagtacgggaacgtcgtaggacggtacggaggtacgtacgaacgtcgtaacggtccggaacgtaccggtaccggtcgttacgtttaattacgggtacggtacggacccggtagggtaaaccggtcggttaaaagtttaaccggtttaagggttttaggttttaacggggg

SEQ ID NO: 129065 - DNA, 855 bp, Homo sapiens
  misc_feature: GYAE6OF01C3ACU.45.78.H01.1.454.CMB.1.raw
  modified_base (207)..(207): a, c, t, g, unknown or other
  misc_feature (207)..(207): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgaccaaatgtgacatccagatcgacccagtcctcccttcccacccttgtctgctatcgtaggtagganacagactacaccactccacgttcggcccggcagtcagtagttaattacgtacgtggttcggtccgttaggtacgtacgacggaacgaaacggaaaaccggtaacgggaaaccgacccctaagtccctaccgtacgtaccttacgtaagtacgactacgttacgttaaggtttaacggaacgggttaccgggtaccctacgtacggtaacggttcgaacgggccggtagtacggtagtacgtacggtaacgggaactagtaacgttcctaccgttacctaacctaacctacgtacaacggtcccgacggtccgtacgacccgagttaccgaaggtttcttaacgtttacgttttaccgtaaacccttttaaacgtttaccgttaacccttaaccggaaccttaaaacggttaaggtttaagttaacggttaaacgttttttacgggttaaccggtttacccggggttaacccgggtttaacccggggaacccgggtaaaacgggtaaacccggggttaaaaggtaaaccgggtaaaaaccttaaacccggggtaaaaacggtttaccggtagggttaacccggacgtttaccggaacccttaaccgtacgtttacccgtttaaccttcccgttccgttaaaccccccgg

SEQ ID NO: 129066 - DNA, 647 bp, Homo sapiens
  misc_feature: GYAE6OF01A6B3A.45.78.H01.1.454.CMB.1.raw
  modified_base (504)..(504): a, c, t, g, unknown or other
  misc_feature (504)..(504): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaaaggaagcgtggggcctcgagtgaaggtcctcgtggcgaaggtcttcgtaggactacaccttcgaccggtcttactatactacacgtgggtcgacgacgaccggcccgtggaacgaggtcttggaggtaggagtagggtagtacggactaccgaaacctaaagaggtggacggaccaactaaacgtagacgactaacgaagtaacggttcgacgggacgtcggtaacgactaagtcgaacgtacgggactacgtacagtcgaacgtacgaccacgacctaagagtaggacgngtacggagaccgacggtaccgtaggacgtacgtccgaacggtaccgccggtaaccggtcggttaagttacgtttacggacggtacgacgggacgtaacggggacttacgggtaactttttacggtaggtttttaggtaacggg

SEQ ID NO: 129067 - DNA, 690 bp, Homo sapiens
  misc_feature: GYAE6OF01EL22J.45.78.H01.1.454.CMB.1.raw
tcagacgcgatcgacacgaccggtgctcgatttagtgtgagtagtttgggtttgggggagagcatcacccagcaaccacatctgtcctctagagaatcccctgagagctccgttcctcaccatggactggacctggaggatcctcttcttgggtggcagcagccacaggacgcccactcccagggtgcgagcgtgggtgctagtcgtggggctggaggtgaagaacgccgtgggcctgaggtgaggtctcgtagcacggtcttcgtggactacctaccttcgacccggtactactatatactacgtgggtcgcggacacggccctaggacgaaggtcgttcggagtggtagtagggtagtagactacctaaacctaacgtaagtgggacgacaaactaaactagtcgacctaagtaggtaacggttcggagggtaccgtacgggtacccaacgtaacggtacggaacccggacgggtaacccaccggtaaccgacgtacgaaccgtacccgaacgtacccggtacctaaacggacggtacggaacgtcggtaacggacggtacggacggtccgtaggtacgtacttacggacgaaccgggaccgtacgggttccgttggttaacttaggtcgtcgggaagaccggaggggtaacctaaggtttaaacgttacggtttggttttaacgggg

SEQ ID NO: 129068 - DNA, 871 bp, Homo sapiens
  misc_feature: GYAE6OF01CGFW7.45.78.H01.1.454.CMB.1.raw
tcagacgcgatcgacacgaccggtgctcgatttagtgtgagtagtttgggtttgggggagtcagacccagtcaggacacagcatggacatgagggtccccgctcagctccgtggggctcctgctgctctggctcccaggtgccaaatgtgacatccagatcgacccagtcctccttccaccctgtctgctagtcgtaggtaggagacagacgtccaacctatctacgttcggcccgggaccaggtcgagtacgttaattaggttaacgtgggttcgtccgttaggttactcgaaggaccgaaacggaaaccggaacggggaaacctcccccgtaaaggtccttaccgtcgtaccttaacgtaacgtaaccggtacttaagttaaccggtttaaaggttttaaacgggtaaaaccgggtttcccgggggtaaccctaacggtttaaccggtaaaacgggttttccgaaaccgggtccggtaccggtaagggttacgggaacgttacgggtaacggggaacctaaacggttaacttacccgaaccgtttaccttacccaaccgttaacgtccgaacggtacccgtacggtcccgttacggacccgtaccggttaccgtaaggttacttttacgggttaaccttttacggtacctttaaaaccgttttagttacccgtaaacgtaacccgtaaaagttacggttacgttaaggtttaacggtttaacgtttaacgttcccgggtaaccgggtttacccgggaaccggtaaacgggaacccgttaaagggtaaacgtaaaccgtaaccgtaaacggtacggttggtaccgtacgtaacgactacccgttaattccttagtttccctcgttacccg

SEQ ID NO: 129069 - DNA, 658 bp, Homo sapiens
  misc_feature: GYAE6OF01B2J9P.45.78.H01.1.454.CMB.1.raw
  modified_base (269)..(269): a, c, t, g, unknown or other
  misc_feature (269)..(269): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacacggcccctggacaagggcttgagtggatgggatggatcaaccctaacaatggtggcaacaaactatgcacagtaagttcgagggcgaggtcacatggaccaggacacgtccatcagcacacgcctanagtggagctaggagcgaggtctagagacgtcgtacgaccgacgtacggccgttagtacgttacgtggacgacggaggtacggaccgtaaggtaatttacggttagttttagggagtttaggttagtcgggtaggtaggtcggtacggtggtacgggaccgtaacgggaccgtcgtaccgtaccgtcctctccgacgcccgtaccgacggtaaccggcccacggttcccgtcccttcccgtcgccctacctcccgtacaaccgtcgccgtaccgtccgggacgggtaccacggcggtcccggccgtcggtcgtacgccgtaggtacccgacgtacctaccgttccgacggtaccttcggtacgttcggacgtacgggcccggtggtacgg

SEQ ID NO: 129070 - DNA, 560 bp, Homo sapiens
  misc_feature: GYAE6OF01BVCAV.45.78.H01.1.454.CMB.1.raw
  modified_base (453)..(453): a, c, t, g, unknown or other
  misc_feature (453)..(453): n is a, c, g, or t
  modified_base (459)..(459): a, c, t, g, unknown or other
  misc_feature (459)..(459): n is a, c, g, or t
  modified_base (503)..(503): a, c, t, g, unknown or other
  misc_feature (503)..(503): n is a, c, g, or t
tcagacgcgatcgacacgaccggtgctcgatttagtgtgagtagtttgggtttgggggagagcatcacccagcaaccacatctgtcctctagagaatcccctgagagctccgttcctcaccatggactggacctggaggatcctcttcgttggtggcagcagccacaggagcccactcccaggtgcagctggtgcagtctggggctgaggtgaagagcctggggcctcagtgaaggtctcctgcaaggcttctggatacaccttcacccggctactatatacacgtgggtgcgacacgggcccctggaccaagggtcttggagtggactgggatgggatccgaaaccccttaaacgaaattggggtaggaccaacgaaaactattcggaccacgaagtaacgttttcgagggcgaagggtcaccacgtgaccgaggacaccgtcatcagcacngcctanatgagctgacgcgagctagagctcgagtaccgcgacgtaccggnttagttacgtcgtggtacgaggtaggaccaagggtaatttacggtaggttttacggg

SEQ ID NO: 129071 - DNA, 654 bp, Homo sapiens
  misc_feature: GYAE6OF01BDZ7Z.45.78.H01.1.454.CMB.1.raw
  modified_base (397)..(397): a, c, t, g, unknown or other
  misc_feature (397)..(397): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatccaaccctaacaagtggtggcaacaaactatgcacagtaagttcgaggcaggtcacatacgaccagggacacgtaccatcacgcacacgtaccctacgacgtaggacgtctaggaggacgagggtctaggaagtacctcgtacggaacgaccgtaccgggcggttagttacttacggtgtagacggtaggacgacgagttaagttacgttgttttaggngttagttacgtcggaggttctacgggctcggtcgggtaccgaacggtaccgacggtaccgtacccgtcgtaccgtacgcgtcccgtacccgaacgaccggaccgtcgtccgtcccttacccgccgtccctacccttaccacgtaacgacgtcccacgtcggtacgggacgtcgacggcgcccgtcggactccggacgtcgtaccggtaacgtacctaccgttcgcgtaccgtcgtcgtacgtggcgtggcggtacgg

SEQ ID NO: 129072 - DNA, 703 bp, Homo sapiens
  misc_feature: GYAE6OF01APN3Y.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacgaagggcttgagtggatgggatggataccaaccctaacaatgggtggacaacaaactatgcaacagtagttcgagggcagggtcaccatgaccgagggaccacgtccatcagcacgacgaccctagtagtacggagtcgtacgaggcgagcgtagaaggacttacgagacgacgtcggtcgtagtactacgtcggtcgacgaggacgagtaaggtactttaacggttagttttaggacggtttaggttaaacggtccggtaagttagtacggtacgttcgggtaacgggaccgtaacgggaccgtacgggtcctaccgttcctaccgtcacgtcccctacgaacgaccggcctagtcccgtccctcccgaccgtcctaccctccgacgaacgtcgtacccgacctcgggtacgggacctacccggacgtccggtccggtcggaccgtcggtccgtaccgggtaaaccgtccggttaaccttccgttaccccggacgttaacccgttccgggaccctttacgggaccggacggtcggtaaccggtaccggg

SEQ ID NO: 129073 - DNA, 669 bp, Homo sapiens
  misc_feature: GYAE6OF01CE805.45.78.H01.1.454.CMB.1.raw
  modified_base (188)..(188): a, c, t, g, unknown or other
  misc_feature (188)..(188): n is a, c, g, or t
  modified_base (287)..(287): a, c, t, g, unknown or other
  misc_feature (287)..(287): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggccccaggacaagggcttgagtggatgggatggatcaaccctaanaatggtggcacaaactatgcacagaagtttcagggcagggtcaccatgaccagggacacgtccatcagcacagcctacatggagctgagcaggctgagntctgacgacaccggcgtgtattactggtcgacggaggacggacgaagggtaatttacggttagtttttagggaaggtttgggtttaacgtttcggggtaacgggttagtacgggtaccggttcggtacgggggacccgaaaggggtaccctacgggttccgaacccgttcctcccgtacgaccgtccctacccgaaccgaacgggcccctagttccggtcctttcccaccgtcggccctaccccttcccaccgaacgcgcccgtacccgtcgggtcggggactacggaccggcccggtcccgtgggtcctccgtccgttggtaccgaacggtacccttaccgttcccgtacgacgtccgtacgtcgtcggcgggccgggtcg

SEQ ID NO: 129074 - DNA, 603 bp, Homo sapiens
  misc_feature: GYAE6OF01DWIAC.45.78.H01.1.454.CMB.1.raw
  modified_base (285)..(285): a, c, t, g, unknown or other
  misc_feature (285)..(285): n is a, c, g, or t
  modified_base (352)..(352): a, c, t, g, unknown or other
  misc_feature (352)..(352): n is a, c, g, or t
  modified_base (457)..(457): a, c, t, g, unknown or other
  misc_feature (457)..(457): n is a, c, g, or t
tcagacgcgatcgacacgaccggtgctcgatttagtgtgagtagtttgggtttgggggagagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtggggcctcagtgaaggtctccgtgcaagcttctggataccaccttcaccgctactatataacnctgggtgcgacgacggcccctggacgaagggtcttggagtgggatgggatggatacaaaccctaaanaagtggtacggcaacaaactatcgacaacaagtaagtttcgagggtacagggtccaacctagtagaccgaagggaccaccgtcaatcagaccagacgcctaacanggacgcgaggacgacgaggccgtagaagtactacgtacggaccgacggaccggtaccggttggttaaccttaacgttgggtacggaccgggtaaggaacgggtacccgtaagggttaaactttacgggttaaggtttttacggggg

SEQ ID NO: 129075 - DNA, 811 bp, Homo sapiens
  misc_feature: GYAE6OF01EEV36.45.78.H01.1.454.CMB.1.raw
  modified_base (260)..(260): a, c, t, g, unknown or other
  misc_feature (260)..(260): n is a, c, g, or t
tcagacgcgatcgacacgaccggtgctcgatttagtgtgagtagtttgggtttgggggagagcatcacccagcaaccacatctgtcctctagagaatcccctgagagctccgttcctcaccatggactggacctggaggatcctcttcttggtggcagcagccacaggacgcccactcccaggtgcagctggtgcagtcgtgggctgaggtgaagagccgtcgggcctagagtggacggtctccgtgacgaaggtcttcnggtactacctccttcgaccggtctactatactacgacgtgggtcgacgacgtaccgggccccgtaggaaccgtaaggggtcttagggaacggttgggacggtaggggaacgtaggtaacctaacccgaaacccgttaacggtaaacggttcggggacggtaactaaaccgtaaaacgttcgtacggacctaacgtaaacggttaaacggttttacgggaaccggggtaacgggtaaccgggttaacctaacccgtaacggtaccgggtaaaccccgggtaaacggggacccgttaaacccgtacccgttaaagaccccggtaaacggacccctaaacggtacctaaccccgttaacggttaaggtaccgggtacgtccggtaagggaacgtacgggtaacgggtacgttaacggaacgttacgtaaccggtaacggacccgggtaaccggtaccggggtttcggtaacgtttacgttacgggttcggaacggtacggacgggttaaccgaggtttaaacggtaacgtttacgggttttaggtttaaggggg

SEQ ID NO: 129076 - DNA, 806 bp, Homo sapiens
  misc_feature: GYAE6OF01C2QP1.45.78.H01.1.454.CMB.1.raw
tcagacgcgatcgacacgaccggtgctcgatttagtgtgagtagtttggggtttgggggagtcagacccagtcaggacacagcatggacatggacgggtccccgctcagcctccgtggggctcctgctgctctggcctcccgaggtcgaccaaatggtacgacactaccaagactcgaacccctacgttcccttccccttaccccacccgttcgtctcgctactcgtaggtaggagacaggacgtaccaaccatccgtacgtcgggcccggacctaggtcgaaggtaagttaagtttaacggtaacgttcgggttcggtccgttaggtaactcgaagaccgaaacggaaaccggaacgggaacctacccgtacgcctccgtcgtacttacgaagttaacgcttagttacgttaaggttaaggaacggtcggactagtacgtaggtcgaggcgagtaggtcgtagtcggacggaactaagtactacactactacactacgtacacgctacgccgtagcctacggtaccgtagtactttagtttactttacgtaacctttacgttaaccgttaccgaaccgtaacttaacgttaagttacgtttaacggttaaacgttttaccggtttaaccggttacccgggttaccggggttaaaccggtaccggggaaaccggggttaaccggtaaaagggttaaccgtaaaacccggtaaagggtaaacccgtagggtttacgggtccgacccggttaaaccctacggttaacccctggtttaaccccgttcgttaacccgtttacctacccgg

SEQ ID NO: 129077 - DNA, 889 bp, Homo sapiens
  misc_feature: GYAE6OF01ARWT4.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacgacggcccctggacgaagggtcttgaggtggagtgggatggactacaaacccttaacaagttcgggtgacaactaaaacgtgtcgacacaggtaagtttcgaggggctagggtcaccagtacgaccgagggaccaccggttccagtacacgcaacacggtcctaactacgtagggacgtccgtaggacgaccggtaggacgtaggaaggtaccttacggtacgaaaccggtacgacggttcccgttagttaccgtttaaggtcgggcgacgggtaggaacgtacgtaaagggttacgtttaacggttgttttagggacgggttttagggttaaacgttccggggtaaccggttaggttaccgggtaccggggttacgggaccggggtaacccgtaacggggtacccgtaccggttaccgtacccgttcccgttacccggtaccgtaccggtacccccgttaccccggtaacccgggtaaacccgggcccccgtttaccggtacccccgggtttacccccgtttaccccccgggtacccggtaccccccgtaacccccggttacccccggttaaccgaaaccccgggtaaccgtcccccggttaaccggttcccggggtaaccgggtacccggaccggtaaccgggggtcccccgtacccggggtccggtcccgtacggtccgttcggaacggtaccgtacgttaccgtccgacgtcgttccgtacgtcgtacgcggtccggtagcggg

SEQ ID NO: 129078 - DNA, 699 bp, Homo sapiens
  misc_feature: GYAE6OF01CKY1K.45.78.H01.1.454.CMB.1.raw
  modified_base (187)..(187): a, c, t, g, unknown or other
  misc_feature (187)..(187): n is a, c, g, or t
  modified_base (444)..(444): a, c, t, g, unknown or other
  misc_feature (444)..(444): n is a, c, g, or t
  modified_base (662)..(662): a, c, t, g, unknown or other
  misc_feature (662)..(662): n is a, c, g, or t
  modified_base (664)..(664): a, c, t, g, unknown or other
  misc_feature (664)..(664): n is a, c, g, or t
  modified_base (689)..(689): a, c, t, g, unknown or other
  misc_feature (689)..(689): n is a, c, g, or t
tcagacgcgatcgacacgaccggtgctcgatttagtgtgagtagtttgggtttgggggagtcagacccagtcaggacacagcatggacatgagggtccccgctcagctcgtgggctcctgctgctctggctcccaggtcgccaaagtgtgacatccagatcgaccagtcctcctcccaccctgtctnctatctgtaggagagagacgtccacactcgtactcggccggcagtcagtagtatagtacgtggtcgctaggtactcgagacgaacgaacgaacgggaacctaccctagaccttccgagtcctaactagtacgactagttacgttaggttaaggtacggtccggtacctatcgtaaaggttccgaacggcggtagagggtacgtacgtcgtacgggtaacaacggttacttaccctacctccgtaccctaaccggtanacccggacgtcgtaccggtaccctggacccttacgccgttaagtacttttacggtacgttttaaccgttaactttaacccttttacggttaacctaccggtaacctaaacgtatttacgtagtaacccgttttaggtttaccgtacgggtttaccgacccgggtagaaacccgggtagtaaacgggtagaaacctaacggtaacgtacgtcgggtacncnccgtactcgttagttccttccgttntcccttaccg

SEQ ID NO: 129079 - DNA, 596 bp, Homo sapiens
  misc_feature: GYAE6OF01B1JR0.45.78.H01.1.454.CMB.1.raw
  modified_base (292)..(292): a, c, t, g, unknown or other
  misc_feature (292)..(292): n is a, c, g, or t
  modified_base (524)..(524): a, c, t, g, unknown or other
  misc_feature (524)..(524): n is a, c, g, or t
  modified_base (529)..(529): a, c, t, g, unknown or other
  misc_feature (529)..(529): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaaactatgacacagaagtttcgagggcaggtcaccatgaccgagggacaccgtccatcagcacagcctacagtggagctgagcaggctgagntcgtgacgacgaccggcgtagtagttacgtgtgcgagagcaaggtaattacgtagtttttggagttggttacgttcgggacgttagtggtacggtcgtcggggacgaacgggaccgacggtccgaccgtctccctcacgccctccaccgacggccctacgtccgtcccttccccgtcgcccctccctccctaccgaacgcgcctaccgtcgcggggccacgcgccgtcccgnggccncgtcgtcggaccgacggtactacccgttccgcgtacgtccgtcgtcgtcggacggcggtcgtacggg

SEQ ID NO: 129080 - DNA, 617 bp, Homo sapiens
  misc_feature: GYAE6OF01ALU34.45.78.H01.1.454.CMB.1.raw
  modified_base (459)..(459): a, c, t, g, unknown or other
  misc_feature (459)..(459): n is a, c, g, or t
tcagacgcgatcgacacgaccggtgctcgatttagtgtgagtagtttgggtttggggctgaggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgtattttggagtggttagttcggacggtatggacgtcgtggggccaacgggaccacggtcaccgtctcctacgacgtccctaccgaccgaacgggcccctagtcccggtcccttcccccgnggtcccaccccgtcctcccaacgccgacctacccgtcggtcggggacccacgaccggccggcccgttcggggcctcggcccgttagggtaccgtaacgggtacccttaacccgttcccgtaccgtacgttcccggtccgttccgtcgggtacccgggg

SEQ ID NO: 129081 - DNA, 719 bp, Homo sapiens
  misc_feature: GYAE6OF01BZS2K.45.78.H01.1.454.CMB.1.raw
tcagacgcgatcgacacgaccggtgctcgatttagtgtgagtagttttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcaggtcaccatgaccaggacacgtccatcagcacagcctacagtggacgtctaggagcgtaggctggagatactcggaacgacgaccggtccgtagttacttacgtggtgcggaggtaggacgtaaggtaaacgtttacgttagtttttagggtaggtttggtttaacggttcgggtaacggttagtacgggtacggttcggtacggggtaccgaacgggtacccgtacggtcctacccgtaccgtcccgtaccgaccgtacccgtccccgaaaccggaacccgggtccccgtaccggttccccgggttccccgtttcccccccggtcggtacccctacccccgtaccctacccgaaccgacgtaccccgtacccgtccgggtaccggggccaacccgacggtcccggcccggtcgggccttcggtccggtacggtaccgacggtaccttaccttccgtcgacgtccgtacgtcgtaggcggtcggcggtacggg

SEQ ID NO: 129082 - DNA, 707 bp, Homo sapiens
  misc_feature: GYAE6OF01CG0IC.45.78.H01.1.454.CMB.1.raw
  modified_base (380)..(380): a, c, t, g, unknown or other
  misc_feature (380)..(380): n is a, c, g, or t
  modified_base (526)..(526): a, c, t, g, unknown or other
  misc_feature (526)..(526): n is a, c, g, or t
tcagacgcgatcgacacgaccggtgctcgatttagtgtgagtagtttgggtttggggacccagcaaccacatctgtcctctagagaatcccctgagagctccgttcctcaccatggactggacctggaggatcctcttcttggtggcagcagccacaggacgcccactcccaggtgcagctggtgcagtcgtggggctgaggtgaagaagccgtggggcctcagtgaaggtctcctgcaggcttctggatactccttcaccggctactatactacacgtgggtcgccggacaccggcccctaggacgaagggtcttggagtgggtagtagggagtggactaccaaaccctaaacgaagtgggtacggacaacaaacgtanacgactaacgagtaacggttcgagggacgaagggtcccaacgtagtacgaaccggaacgggaaccaaccggtacctaacgtcaacgaccctaaccgaacgtaccccgttaaacgtacggtacgggtaaccgacgttagggaaccgngggtaacggtcggtaacgtaacgtcgttaccggacggaacccggtaaccgaccgggttaccgtacggtttaattaccggtagggttacggacggaaggtagggaacgttaaacgggttaaagttttacgttagggtttttacggtaagggtttacggtttaggtttaacggggtaaccggg

SEQ ID NO: 129083 - DNA, 738 bp, Homo sapiens
  misc_feature: GYAE6OF01AKI8F.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcaggggtcaccagtgaccaggacacgtccatcagcacagcctacatggagctgacgcaggctgagatctcgacggacaccggccgtgtacttacgtgtgcgaggaggacaggtaattacgtattttggagttgggttacttcgggacggtagtggtacggtcgtcggggaccgaagggtacccacgggtaccacccggtctcccgtcacgcccgtccccaaccgtacgggacccctaggtccccggttacccttcccccggtcggaccctccccccttacccgtacccgaaacggtaccgtcctaacccggttccggtaccggggggacccaccggtaccgggtccccgggtaccccggtccgggggtccgttccgggtacccggttaacgggttaccggaaaccggggttacccctttaaaccggttttccccctaaacggtttccggttaaccccgtacggggtttaccccgtaggggtacccggggtcccgggggtcccgttaaccgggggg

SEQ ID NO: 129084 - DNA, 964 bp, Homo sapiens
  misc_feature: GYAE6OF01C24R6.45.78.H01.1.454.CMB.1.raw
tcagacgcgatcgacacgaccggtgctcgatttagtgtgagtagtttgggtttgggggagtcagacccagtcaggacacagcatggacatgagggtccccgctcagctccgtggggctcctgctgctctggctcccaggtgccaaatgtgacatccagatgacccagtctccttccacctgtctgctatctgtaggagacagagtcaccatccacgttcgaccggccagtcaggtagtatacgtacgtggtaggccgtaggtactcgtaggaccgaagaaaccgacgggaaaccgtacccctaagtcctcctacgtaccgttactagtaacggacacgttacgttaaggtttagaaacggtccggggtaccaacgtaccgtaaggttacgacgtcggtacgtaagggttcggtaacgttacccggtagggtaaccgtaacggttaacctttacccgtaacgttacccgttaacccgtaaaccccgtaacgtttaaccccgggaaccgttaaccccgggttaacccggaaccccggtaccggttaccccccgggaaaacggttcccggttaaaccggttaacgtttaaccgggttttaaacggtttttttacccgtaaaaccccggtttaaaccgtttttttaaaacccgttaaaccgggttttaaacccggtaaccccgtttaaaaaccggtttaaacgggtttaaacgtttaacgggtttaaaaccgggtttttaaacgtttttaccgggtttaaaccccggggtttaaccgggttttaacccgggggtaaccccgggttaaaaaccgggggttaaaaccccggtttaaagggggtaaaccggttaaaaaccggttaacccgggaaaaaaccgtttaaggttccggggttaaaccgtaccggtaccgtaaaccgtacccgttaaagtttcccgtttaacggttcccgtttaccgtaaccccgg

SEQ ID NO: 129085 - DNA, 767 bp, Homo sapiens
  misc_feature: GYAE6OF01AO5UB.45.78.H01.1.454.CMB.1.raw
  modified_base (193)..(193): a, c, t, g, unknown or other
  misc_feature (193)..(193): n is a, c, g, or t
  modified_base (213)..(213): a, c, t, g, unknown or other
  misc_feature (213)..(213): n is a, c, g, or t
  modified_base (342)..(342): a, c, t, g, unknown or other
  misc_feature (342)..(342): n is a, c, g, or t
  modified_base (741)..(741): a, c, t, g, unknown or other
  misc_feature (741)..(741): n is a, c, g, or t
  modified_base (759)..(759): a, c, t, g, unknown or other
  misc_feature (759)..(759): n is a, c, g, or t
tcagacgcgatcgacacgaccggtgctcgatttagtgtgagtagtttgggtttggggtgaagaagcctgggcctcagtgaaggtctcctgcaaggcttctggatacaccttcaccggctactatatacactgggtgcgacacggcccctggacaagggtcttgaggtggatgggatggactccaaaccctaanaagtgggtgacaacaaactntcgacacaaggtaacgttcgacgggctacgggtaccaaccagtacgaccggacgggacctaccgtaccactacgacgaccaaccgacgtaccctaacgagttggaacgtccgtaggacggccggacggngtacggaacgtacgtaccggtaacggaccgaccggaccggttccggttagttaacgttcgtagtccggaagtagggaacggtacgtaaaggttaactttacggtttaggttttacggaggggtttagtttacggtacgggtacgttaggtacggggtcgttaccggggtacgggtaacccggaaagggccccgttaagggtacccgtaacccgggttccttaccccgaattcccccggtccgtaaccccgaaccgggaacccggttacccgtcccgttccccggttacccttcccggccgtaacccctcccggtaccctacgacgtcgccctacggtcggcggtcacggccgtccggcgcggtcgcgtccgtacggactcggtacctacggttcacgtntcggcgttgacggtcggngtgaacgg

SEQ ID NO: 129086 - DNA, 691 bp, Homo sapiens
  misc_feature: GYAE6OF01DHLG7.45.78.H01.1.454.CMB.1.raw
  modified_base (258)..(258): a, c, t, g, unknown or other
  misc_feature (258)..(258): n is a, c, g, or t
  modified_base (338)..(338): a, c, t, g, unknown or other
  misc_feature (338)..(338): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggactggagatcctcttcttggtggcagcagccacgaggacgcccactcccaggtgcagctggtgcagtctggggctgaggtagaagaagccgtggggcctcgagtggaaggtctcctgcgaaggtcttcgnggataccaccttcgaccggtctacgtatatactagtggtgcgtacgacggccctggacgaaggcttggagtgagtggganaggatacaacctaagaactgggtagacaacgaaaactatagacacgtaagtaagtttacgacggggtaacgtaggggtaccaaccgtagtacggaacccggaagggtacccgtaaccgtacgtaaactaccgacgaaccgaaccgaaccgtaaccgtaccgaagtacgggaacgtcgtacggaacggacgtaccgggacgtaggaacgtacgtacgtacggaaccggaaccgtacccgggtccgttaacggttaacgttaccgtttaaggggtacgttaaacggaggggaaacggtacgggtaaaacggttaagtttaaacccgggtttaggtttacggggtttaaacggggg

SEQ ID NO: 129087 - DNA, 725 bp, Homo sapiens
  misc_feature: GYAE6OF01DZRXG.45.78.H01.1.454.CMB.1.raw
tcagacgcgatcgacacgaccggtgctcgatttagtgtgagtagtttgggtttgggggagcatcacccagcaaccacatctgtcctctagagaatcccctgagagctccgttcctcaccatggactggacctgggaggatcctcttcttggtggcagcagccacaggagcccactcccaggtgcagctggtgcagtcgtggggctggagggtgaaggaagccgtggggcctcagtggaacggtctcctgcaaggcttcgtggataccaccttcaccggctatatatacacgtgggtgcgacgacggtcccctagggacgaagggtcgttaggagtggtagtgggatagggagtaccaaccgtaaacgtagtaggacggaccaaacgtaaactatacgacaacgtaacggtaagtttacggacggggtacgaacggggttaccaacgaacgtacgaaccggtacggggaaccgtaaccgtaccgtacctacggacgacctaaccggacgtccctaagtcggtaggacggtacgttaggaaccgggtcggaacggtacgacggtaagtccggtacgtaaccggaaccggaaccggttacccgggtaccgggtttaacgttccgtttaacggtccgggtagggaaccggtaacggggtaacggggtaccgtaaaaggggtttaaccggttttacgggtttaaacggtttttaggggggtttaaacggg

SEQ ID NO: 129088 - DNA, 697 bp, Homo sapiens
  misc_feature: GYAE6OF01EOQNK.45.78.H01.1.454.CMB.1.raw
  modified_base (187)..(187): a, c, t, g, unknown or other
  misc_feature (187)..(187): n is a, c, g, or t
  modified_base (251)..(251): a, c, t, g, unknown or other
  misc_feature (251)..(251): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctanaatggtggcaacaaactatgcacagtaagtttcaggcagggtcaccatcgaccaggcacgtcancagcacagacctacaatggagctgagcgaggctggataacgtcgaggaaccaccgcggacccgttgtaacttacgtgtacggcgtaggacggcaagggttaattacggttaagttttggaagttaggttagttacgggtacggttagtcggtaacgttcgtacggggtacctaaacggggaccctacgggtacccgtacccgtccgtcctaccgtacgtcccgtacccgaacccggtaacggtcccgtaccgttacccggttccccttccccggtaccgtcccgtaccccttacccgtaccgtaaccgaacgccgtaccgtaccggtacggggaccacgtacggcccggtccgtcgggtcgtccgcgtacggtacgtaacgtaccgtaccgttcccgtacggtacgttcccggtacgttcgtaagtccgggtcggtccggtacggg

SEQ ID NO: 129089 - DNA, 667 bp, Homo sapiens
  misc_feature: GYAE6OF01BQ5DA.45.78.H01.1.454.CMB.1.raw
  modified_base (155)..(155): a, c, t, g, unknown or other
  misc_feature (155)..(155): n is a, c, g, or t
  modified_base (189)..(189): a, c, t, g, unknown or other
  misc_feature (189)..(189): n is a, c, g, or t
  modified_base (202)..(202): a, c, t, g, unknown or other
  misc_feature (202)..(202): n is a, c, g, or t
  modified_base (492)..(492): a, c, t, g, unknown or other
  misc_feature (492)..(492): n is a, c, g, or t
  modified_base (504)..(504): a, c, t, g, unknown or other
  misc_feature (504)..(504): n is a, c, g, or t
tcagacgcgatcgacacgaccggtgctcgatttagtgtgagtagtttgggtttgggagagcatcacccagcaaccacatctgtcctctagagaactcccctgagagctccgttcctcaccatggactcggacctggaggactcctcgttcttggngcagcacgccacgaggcgcccactcccgaggtcncagcgtggtcgcnggtcgtgggactggagggtagaacgacggtccggtcgggtcctacgtaggtaggaacggttcctccgagacgtaacggttccttacggtacggtactaaccgtaccgttacggaccggtactaactaatacgtacgtacgtgggtcgaccgacgtacggcccgtaggaaccgaggtctagacggtggagtcggatgactaccgaactagacgtgacgacaacggaactgacgtacaagtagtaacgtgaacgggtctacgggactacgacgtacgtacggaacggtaccncgactagacganaccgtacacgtacgtacgaggtgaacgtgaacggaggacgtaggacgttagacgtacgcgacggtaccgacggtaccgtacggttattacgtacggtcccggttagaaccggttaaggacgtaacgttaaggtttaaccgttaacgggtttgttaaaccgggg

SEQ ID NO: 129090 - DNA, 718 bp, Homo sapiens
  misc_feature: GYAE6OF01BH7T3.45.78.H01.1.454.CMB.1.raw
  modified_base (207)..(207): a, c, t, g, unknown or other
  misc_feature (207)..(207): n is a, c, g, or t
  modified_base (212)..(212): a, c, t, g, unknown or other
  misc_feature (212)..(212): n is a, c, g, or t
  modified_base (265)..(265): a, c, t, g, unknown or other
  misc_feature (265)..(265): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatgggtgacactaaactntgcanagtaagttcgagggcgtaggtccaccagtcgaccgagggacaccgtccatcancacagcctacagtggagctagaggcgaaggccttaggagtagtcgtacggaaccggaccgaccgggtccgttagttacttacggttggacgtcgggaaggacgacgtaaggttaagttaaccgttagttttcgggagtttggttacgttacgggtagttagtcggtacgttacggtacgggggacaacggggtaccgtccggtacccgtaccgtcctacccgtcgaccgtccctaaccccgaaccggaccggtaccctaacggttacccgttcccccttccccggtccggaccccttaccccgtccctaacccggaacgtaccgccccgtacggttccggaccgggggtaccaacgccgggtacccgtccggtaccggcttaccggcgttacggaccgtaacggtccttaccttcgtcgtaccgtcgtaccgtcgtaggcggccggtgaccgg

SEQ ID NO: 129091 - DNA, 939 bp, Homo sapiens
  misc_feature: GYAE6OF01CKU7H.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatactaccttcgaccgctactatatacacgtgggtgcgacgacggcccgtggacgaaggtcgttagaggtggtagtgggtagtaggatacctaaaccctaaacaagttgggtggaccaacaaactagtcgacaacgagtaacgttacggacgggcgacgggtaccaccgagtaccgaaccggacggacctaccgtacctactaccgacgaccacgaaccgtacctaacgtaacggtcgggacgtacggttaacggaccggacggtacggtacggtacggtaacgaccgttaccggtaaccggaacccggtaccggtaaccggggttccgttaacgtttaacggttacggttcgggtacgggaaccgggtaaggacgggtaaacggtaagggttttaaaacgttttacggtttaacggtttttacggggttaagttttacgggttaacgggttacggggtaacggttacggttacggggtacggttcggggtacgggtaaccggtaaaccggtaccgtacccgggttacctaccggttcccttaccgccgtacgtaccccctaacggtaaccggacccgaccgttccggttacccggttacccccgttcccggacccgtaccccgttacccgtacccgttaaccggtaaacggtacccgtccggtacccgggttaccgggtcccggggtaacctaccgggaaccggtcccgggtacgggtccggtccgttaccgggtccggttaccggaacgggttacccgttacttaacccggtcgttaccggtacccgttacgggtcccgttagggaccggttccggtcggggtccggtaaccgg

SEQ ID NO: 129092 - DNA, 763 bp, Homo sapiens
  misc_feature: GYAE6OF01B8228.45.78.H01.1.454.CMB.1.raw
tcagacgcgatcgacacgaccggtgctcgatttagtgtgagtagtttgggtttgggggagagcatcacccagcaaccacatctgtcctctagagaatcccctgagagctccgttcctcaccatggactgaccgtggaggactcctcttcgttggtggcagcagccaacgaggacgcccacctcccgaggtgcgagcgtggtgcgagtcggtggggctggagggtagaaagaaggccggtacggggcctagaggtaggtacggtcctcgtacgacgtaggtcttcgtaggtactacctaccgttaccgaccggtacttaacttagtactaccgtacggtgggtacgaccgacggtaccggcccggtaaggaaccgtaacgggtctaggaggtggaggtggagtaggactaacctaaccgtaagtagtcggggtacgacctaaagtaactagtacgacgtaaacggtaagttacgggttaacgagggtacggaccggtacccgaacgtaacgtaccggaaaccggttaccgggaaccgtacccgtaacgactaccggaccgtaaccggaaactacccggtacctaacgacggtacggaacggtaccgtacgggacgacggtaccgaggtagtaaccggtactacggaccgggttaaaacccgccgtttaaaccgggtcggtttaacccttagggtaccggtaggttggaccggtaaggggtaacgtagaaacggtttttaaggtaacgttttggggtttaacggg

SEQ ID NO: 129093 - DNA, 581 bp, Homo sapiens
  misc_feature: GYAE6OF01E32PH.45.78.H01.1.454.CMB.1.raw
  modified_base (254)..(254): a, c, t, g, unknown or other
  misc_feature (254)..(254): n is a, c, g, or t
  modified_base (353)..(353): a, c, t, g, unknown or other
  misc_feature (353)..(353): n is a, c, g, or t
  modified_base (372)..(372): a, c, t, g, unknown or other
  misc_feature (372)..(372): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctccgtgcaaggtcttcgnggataccaccttcaccggtctactatactacacgtgggtgcgacgacggcccctggacgaagggcttggagtggagtgggatggactaccaaacctaanagtggaggacaacaaactncgcaacagtaagttcgagggcgagggtcaccgatcgacgaggaccacgtacatcgacgaccacgaccgacctaacacgtaggacgcgtggaacgcgacggtactaggacgtagttaccgagaaccggaccgaccgggcgttaaggttacttagtagggtgacggtaggacggacgtaagggttaaattcggtttagttttgggtaaggg

SEQ ID NO: 129094 - DNA, 631 bp, Homo sapiens
  misc_feature: GYAE6OF01BYNI2.45.78.H01.1.454.CMB.1.raw
tcagacgcgatcgacacgaccggtgctcgatttagtgtgagtagtttgggtttggggagagcatcacccagcaaccacatctgtcctctagagaatcccctgagagctccgttcctcaccatggactggacctggaggatcctcttcttggtggcagcagccacaggacgcccactcccaggtgcagctggtgcagtctggggctgaggtgaagagccgtgggcctcagtgaaggtctcctgacaaggtcttcgtgatacaccttcaccggctactatactacacgtgggtcgccgacgacggcccctggacgaagggtcttaggagtgggatgggatggactaccaacctaacgaagtggtacgacaacaaactagtagacaagagtaacgtttcgaagggtacgtagggtaccaaccgtagtacggaaccgaagggtaccaccgtaccagtaccgaaggtaccaaccgacgtacccgtaacgacgtacggacgtcgtaggacggaccgtacgggcttacgagtactcgtacggacgtaccgaccggtaccgttacggttacttacgtggtacggacggtaacgggacggtacgtaagggttaactttaagggttaggtttttaacgggg

SEQ ID NO: 129095 - DNA, 694 bp, Homo sapiens
  misc_feature: GYAE6OF01C3QLQ.45.78.H01.1.454.CMB.1.raw
  modified_base (137)..(137): a, c, t, g, unknown or other
  misc_feature (137)..(137): n is a, c, g, or t
  modified_base (187)..(187): a, c, t, g, unknown or other
  misc_feature (187)..(187): n is a, c, g, or t
  modified_base (203)..(203): a, c, t, g, unknown or other
  misc_feature (203)..(203): n is a, c, g, or t
  modified_base (281)..(281): a, c, t, g, unknown or other
  misc_feature (281)..(281): n is a, c, g, or t
  modified_base (360)..(360): a, c, t, g, unknown or other
  misc_feature (360)..(360): n is a, c, g, or t
  modified_base (434)..(434): a, c, t, g, unknown or other
  misc_feature (434)..(434): n is a, c, g, or t
  modified_base (449)..(449): a, c, t, g, unknown or other
  misc_feature (449)..(449): n is a, c, g, or t
  modified_base (567)..(567): a, c, t, g, unknown or other
  misc_feature (567)..(567): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtncgacaggccctggacaagggcttgagtggatgggatggatcaaccctaanaatggtgcacaaatangacacagaagtttcagggacagggtcaccagtcgaccagggacacgtccatcagacacacgcctaacagtggaagtcncggaacgacaacggactcgactactcgtacgaaccgacgaccggaccttaagttttacttacgtgtacgaggtaaggtnttcggtttacgggtgtcgtttcggttttccttttggaacgtcggttgggaccgtacgggaaccggtggtacccncgtacttccgttccncgacgtccctacacccggaacgggtccctcggttacccggttcccctttccccgcggacccctaccccttacccgtaccgaaacgtccgaccctacccgtcgggtacggggcgtaacnccggggcccggtcccggtacgggtcctcggtcccggtacggtaaccgaaacgttcctaccgtttccgtacgtctccgggttcgtccgtaggggccgcggggttcacgggagaacgggtccaagtacg

SEQ ID NO: 129096 - DNA, 689 bp, Homo sapiens
  misc_feature: GYAE6OF01C2I44.45.78.H01.1.454.CMB.1.raw
  modified_base (141)..(141): a, c, t, g, unknown or other
  misc_feature (141)..(141): n is a, c, g, or t
  modified_base (166)..(166): a, c, t, g, unknown or other
  misc_feature (166)..(166): n is a, c, g, or t
  modified_base (260)..(260): a, c, t, g, unknown or other
  misc_feature (260)..(260): n is a, c, g, or t
  modified_base (411)..(411): a, c, t, g, unknown or other
  misc_feature (411)..(411): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggcctcccaggtnccaaatgtgacatccagatgacccngtctcccttccacctgtctgcatctgtaggagacagacgtcaccatcctacgttggccgggccagtcagagtatagtagtggttgcctggtacncacgcaacgaaacgagggaaccacctaagcctctgcctatatagctatcttaagttaggaaagtcgggtacctatacgtaacgttcgagtcggtactaggtcggacttcggtagggtaactaggtaacttcgtaccttacgtacctaaccnctacgacgtacccacggtccctagccgtaacgtccgtacggtatttcggttacttttacgaaccgtttaaactttacgtttaaccgtacgaaccctaaaacgtaggtttaacttaggttaaacgtttcgttttaacgttacggttacccggtttaccgggaaccgtaaggggtaacccgtaaaaggggtacgtaaacggtaaaccgtaaaccggtaagttacggtcggttacgtacgaccctagttaaccgttccttacgttactttcccgttacccg

SEQ ID NO: 129097 - DNA, 764 bp, Homo sapiens
  misc_feature: GYAE6OF01BYO1X.45.78.H01.1.454.CMB.1.raw
tcagacgcgatcgacacgaccggtgctcgatttagtgtgagtagtttgggtttggggtgaagaagccgtggggcctcagtgaaggtctcctgcaaggcttctggatacaccttcaccggctactatatacactgggtgcgacaggcccctggacaaggcttgagtggatgggatggatcaacctaacaatggtggcaacaaactatgacacagtaagtttcgaggcagggtcaccagtcgacgaggacacgtccatcagcacgagcctacacgtggagcgtagagcgaggcgtgagactctaggaccgaccgacggccgttagtacgttaccgtgtcgacggaaggacggacgaacgggtaattacggttaagtttttgggaaggttgggtttaagttacgggtaaggtaaggtcggtacggtcggttacggggaaccgtaaacggggaccgtacgggttacccaccggttcttcccgtacgaccgtaccccgtacccgaaacccgaacgggacccctaacgttcccggttacccttaccccgcccgggtaccctacccccgtacccttaaccgaaacgtaccgtcccgtaacccggttcggtaaccgggggccaacccggtacggaccccggtaccggtcggtacccggttcggtaccccgtcgggttaaacccggaaacggttacccttacccggttccccgtaacggtaccggttacccggtccggttaccggagtaccggggtccgggtcgtaaccgggg

SEQ ID NO: 129098 - DNA, 550 bp, Homo sapiens
  misc_feature: GYAE6OF01B8RKV.45.78.H01.1.454.CMB.1.raw
  modified_base (376)..(376): a, c, t, g, unknown or other
  misc_feature (376)..(376): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtcctccttccaccctgtctgcatctgtaggagacagagtcaccatcacttgccgggccagtcagagtattagtaactggttgcctgtatcagcaagaaaccgaggaaacgcccctaagcctctgctctataaggcatctagttagaaagtcgggtaccatcaaggttcagcggacagtggatcgagggacagaatcactctcaccatcancagctgcagcctgatgtatttgacttaattatctacacaactagtattagtacttaagtttacgttacgtaccggttacggaccgaaagggaccgtaaagggtagaaaacgtacgaaaaccggacgttaggcgactacgaccgaaccttagttaccttcggttcttccggtacc

SEQ ID NO: 129099 - DNA, 564 bp, Homo sapiens
  misc_feature: GYAE6OF01EPUSH.45.78.H01.1.454.CMB.1.raw
  modified_base (559)..(559): a, c, t, g, unknown or other
  misc_feature (559)..(559): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacgacggccgtgtattactgtgcgagaggcgaggtaattacgtagttttggagttggttagttcggacggtagtggacgtcgtgggccgaagggaccgacggtcgaccgtctcctcacgcctccaccgacgggccacgtccgtcctcccctgccaccctccaccacgcgccaccgtcgcggggcacgacgccggcccgtgggccgtcgtccgtcggtacgaacggtacctaccttccgtcgactccgtcgtcgtgcggtccgggngtcgg

SEQ ID NO: 129100 - DNA, 785 bp, Homo sapiens
  misc_feature: GYAE6OF01CHHZY.45.78.H01.1.454.CMB.1.raw
  modified_base (263)..(263): a, c, t, g, unknown or other
  misc_feature (263)..(263): n is a, c, g, or t
tcagacgcgatcgacacgaccggtgctcgatttagtgtgagtagtttgggtttgggggagtcagacccagtcaggacacagcatggacatggacgggtccccgctcagcctccgtggggctcctgctgctctggctcccgaggtcgaccaatgtgaactactaccgaggactaccgacccgtattcccttcccttcccgacctgtcctgtaccattcgtaggtaggagacgagactaccacatccgtacgtcggaccggtacngtacagtacttaagtacgtacgtaggttcgtacgtagtagtacagacgaacgaaaccggaacggaacctaccgtactccgtctacgtacctagtaacgtagtactaaccgtttaacggttaaggtttaaacggaacgggttcggtaacccgtaagttaccgaaacgggttcgaccggggaccggtacggtaggtaacggttacaacgggggtaaccggtaaagttaaccgtaaccggtttacctaaccgtttaaccgacctaaccggtaactacggactaaccgccgtaaccgtacgacgtacgtacgttgtaacgtttagtttactttaaccgtactttaactttaccgtaaccgtactaacgaacgttagttagttaaggttacgtttaagttccgttaccgttaacggtaccggtaccggtaaacgggaacgttacggaaacgtaagtaaccgtaacgtaaggtcgtacggtacgtacgaccgttactacgttacctttcgttaaccgtccgttacccg

SEQ ID NO: 129101 - DNA, 837 bp, Homo sapiens
  misc_feature: GYAE6OF01EVB54.45.78.H01.1.454.CMB.1.raw
  modified_base (181)..(181): a, c, t, g, unknown or other
  misc_feature (181)..(181): n is a, c, g, or t
  modified_base (200)..(200): a, c, t, g, unknown or other
  misc_feature (200)..(200): n is a, c, g, or t
tcagacgcgatcgacacgaccggtgctcgatttagtgtgagtagtttgggttgggggagcatcacccagcaaccacatctgtcctctagagaactccctgagagcctccgttcctcaccagtcggactcggacctggagtactccttcttcgttggtcggacaggcacgccacgaggaccncccacctcccgaggtcgcncggctgggtcacgtaggtccggtggggctaggaggtacgaaacggtcggtccggtcgggcctagtacggtacggaacggttcctaccggtagacgtaacggtccgtttagacggtaacctaaccctacccgtttccgaaccggtaaccttaacttaataccgttaaccgcggttacggggtacgacccgaacggtaccccggtacccggtacgggaaacgtaacggggtccgttagggaccggttgggtaacggtgggttaacgtaccgggttaacctaaacccggtaaacctaaacgtacggttacgggccgtaaacgtaactaaacgtactacgaaccgtaaacgttaaaccgggtttagaccgggtaacgggtaccgtacgtaccgtaacgtacgacggtaccggtacgaaccgtacgtaccgactacgacgtcaacggtacctactacggaacgttacggcgttacggacggacgtaacggtcgttaggacgtacgtacggtaccaacgtaccggaaccgggtccgtaacgttaccggttagttaccgggaggttaccggaacgggtacggaaaccgttaccgggtaaagggtttacggtttaacgggttttggttaagggggtttaaaccgg

SEQ ID NO: 129102 - DNA, 845 bp, Homo sapiens
  misc_feature: GYAE6OF01C7YUE.45.78.H01.1.454.CMB.1.raw
tcagacgcgatcgacacgaccggtgctcgatttagtgtgagtagtttgggtttggggacccagcaaccacatctgtcctctagagaatcccctgagagctccgttcctcaccatggactggacctggaggatcctctttcttggtggcagcagccacgaggacgcccactcccaggtgcagctggtgcagtcgtggggctgagggtagaaggaacgtccgtggggccctcgtaggtaggaacggtctcctggcaaggtcttctggactaccgtaccttccgaaccggtctaacttaacgttaactacgacgtgggtcgacgacgaccggtcccgtaggaaccgtaacgggtccgttaggaggtagggaacggttggggactacgggtaataccctaaaaccccgtaaacgtaaagtgggtacggaaccctaaaccaaaaacgttagtacgaaccgtaaacgtaacggtaaacggtttcgacgggggtacgtaacggggtcccaaaacgacggttaacggaaccgtaaccgggaacctaacccggttacccagtaccgaaccggtaaccaaaccgaccggtaccctaaacgtacggtacggtacgacggttacgaacgtccggaacggtccaaggtacgtaccgtaccgtaacggaacccgtaaccggttacccggggtaccggtttacgtaacgtttaccggtcggttaaacgggtacccgggtaagggaacgggtaacgtaaacgggtttaaaaaccgtttaccggggtttttaaggttttttaaaggggggtttacggttttaaacggggtttaaggggtttaacccgggggtttaaacgggg

SEQ ID NO: 129103 - DNA, 882 bp, Homo sapiens
  misc_feature: GYAE6OF01EXWIJ.45.78.H01.1.454.CMB.1.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctctttcgttggttgcagcagccacgaggacgcccactcccgaggtgcagcgtggtcgcgtagtcgtgggctaggaggtagaagacgccgtcgggcctacgagtagacggtctccgtgacgtaacggtccttcgtacggtactaccgtacccgtaccggtaccggtacttaaccttaataaccgtaccgtacggtaggggtacggaccgtaccgggtacccggtaccccggtaggggtaaaccggtacggggttaccgtttaggggaacggttagggtagggttacggggtaagttacgggtaacctaaacccgtaaaaccccgtaaggtaaacgggttacggggtaccggaaacctaaaccgtaaaaccgttcgtacggaacgtaaacggtaaagggtttaacgtacgggaacgggtaccgggttaacggtaccaaccggtaacgtacgggtaaccccggaacggggaaacccttaccggtaaccctagtaacccgtaacgacccgtaaaccgtaacccgtacgtaaacgggtcgtaacgggaaccgtcgtacggaacggaccggtaacgtcggtaaagtaacgtacggttacggtaaccgggaaacccgtaaccgggttacccggttaacggtttaacgtttaacggttaccggtacggtacgggaaaccggtagggtaccggtaaaccgggttaaggtttaaggtttaaccggggtttttgtttaacggggtaaacggg

SEQ ID NO: 129104 - DNA, 660 bp, Homo sapiens
  misc_feature: GYAE6OF01BOQTT.45.78.H01.1.454.CMB.1.raw
  modified_base (287)..(287): a, c, t, g, unknown or other
  misc_feature (287)..(287): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaacctaacaatggtgcaacaaactatgcacaagtaagtttcgagggcagggtacaccatcgaccgagggaccacgtaccatcgacgacacacgaccctacagtggacncgtaggcgacaggctagaagtactcaggaccgacgaccggtccgttatacttcgtgtgacgaggagactaaggtatttacgttagtttggagttgttagtacggacgtagtcgtacggtcgtacgggaccgagggaccgtacggtccaccgtctcctaccgcgtacccgtacccacggacgcccgtacgtcccgtaccctttccccgtcgtccccaccctccgtacccgaacgtaccgcccgtaccgtaccggcgggtacctacggccgcccggtcccgtcggtccgtcgtccggtacgtacgaccggtaccttaccgttccgtaccggtccgtaccggtcgttacgccggaccgggtccgggtcgtacgggg

SEQ ID NO: 129105 - DNA, 696 bp, Homo sapiens
  misc_feature: GYAE6OF01DOZW2.45.78.H01.1.454.CMB.1.raw
  modified_base (311)..(311): a, c, t, g, unknown or other
  misc_feature (311)..(311): n is a, c, g, or t
  modified_base (369)..(369): a, c, t, g, unknown or other
  misc_feature (369)..(369): n is a, c, g, or t
  modified_base (666)..(666): a, c, t, g, unknown or other
  misc_feature (666)..(666): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggagactcctcttcttggtggcagcagcccacgaggacgcccacctcccgaggtgcagcgtggtcgcagtcgtgggctggaggtgaaggacgccgtcggggcctcgagtggacggtctccgtgacgtacggtcttcgaggtactaccgtaccttccgaccggtcttaactataactacncggtggtacgcgaccgaccggcccgtaggacgaacgggtcttggaggtggagtagggngtacgactaccaaaccgtagaagtaggtacgaacctaactaaacgtagtcgacaggtaagtacgttacggagggtcgaacgggtaccaaccgacgtaccggacggaacggaccctacgtacctactaccgagaccgacctaaccgacccgttacgaaggttcggacgtaccgtaggacgtaccggaggtacgtaacggcgttaaacgtccgtaacggaaccggaccggtacccggtagtttacgttaacgttccgggttaggtacccggaggtacgggaacgtggtaaaacgggttntttaaacgggtttgtttacgggttaacggg

SEQ ID NO: 129106 - DNA, 772 bp, Homo sapiens
  misc_feature: GYAE6OF01E36HK.45.78.H01.1.454.CMB.1.raw
  modified_base (280)..(280): a, c, t, g, unknown or other
  misc_feature (280)..(280): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggagtgggatggatccaaaccctaacaatggtaggcaacaaactatcgcacagtaagtttcgagggcagggtcaccagtcgaccgagggacacgtcatacacgcacgacgcctanagtggacgcgtaggacgcgaggtctacggagtatccgtagaccgacgtaccggtccgttagttactttacgtagtgaccggaggaggcgtaagtaagtttacggttagtttttagggaggtttacggttaacggttacgggtacggtaggtcgggtaacggtttacgggtcggggtaaccaaacggggtaccgtaccgggtaccgtacccgtacgtccctaccgtacgtccccgacccgtaaccggaacccggggacccctaaccggttcccgtttccccgttccccgtacccggtaccctaccccttaccccgtacaaccggtaccgtaccgaccccgttgggtacggggaacctaccggaccggtcccgggttacccggtccggtacggttcccgtaccggcggttaaacccgccggttaacccttaacccgttccgtaaccgtcggtacccgtccggttacggccgggacgggtccgggcggtaccggg

SEQ ID NO: 129107 - DNA, 804 bp, Homo sapiens
  misc_feature: GYAE6OF01CC7CV.45.78.H01.1.454.CMB.1.raw
tcagacgcgatcgacacgaccggtgctcgatttagtgtgagtagtttgggtttgggggagtcagacccagtcaggacacagcatggacatgagggtccccgctcagctccgtggggcctcctgctgctctggcctccgaggtcgacctaaagttgtagaccatccgagatcgacccagttcctcccttccacctgtcgtcgactatctaggaggagacgacgtacaccaacctactccgtacgttcggaccggtccagtacgaagttagttaagttaacgtttaacgtgggttacggtccgttggtactacgacggaacgaaacggaaaccggaaacgggtaaccctaccccggtaacgtccgttaccgtacgtaccttaacgtaaacgttacggaccttaaggttttaacgttaaggtttaaacgggtaaacggttacgggtacccttaaaggtaccgttaaggtcggaacggtcggtacgtaggtacggtagtaggaacggtactaacgtaccgttaactccgtaaccctaacgactacgtcgacgtaccgtacgtcgtacgccggtaaccttccgtaggtaacgtttacggttaactttaccgttaactttaaacctttacgttaacgtaccgtaaaccgttaacgttagttaacgttaataaccgttttacgggtttaactaccgggtttaacgtaccgggtaacgaacgggaacggtaaacgtaaacgaaacgtaacgtaacgtaaggttcggtaccagttccaacgttactaccgttattcgttaccttcgttacccg

SEQ ID NO: 129108 - DNA, 701 bp, Homo sapiens
  misc_feature: GYAE6OF01D3QNS.45.78.H01.1.454.CMB.1.raw
tcagacgcgatcgacacgaccggtgctcgatttagtgtgagtagtttgggtttggggacccagcaaccacatctgtcctctagagaatcccctgagagctccgttcctcaccatggactggacctggaggatcctcttcttggtggcagcagccacaggagtcccactcccaggtgcagcctggtgcagttcgtggggctggaggtagaaggaacgccgtggggcctcgagtaggaaggtcctcctgactaaggtcgttcgtggacttacctaccgttccaccggctacgtatactacacgtgggtacgacgaccgacggtccccgtaggaacgtaacggggtctttcggaggtcggagtgggactaggactaccgaaaccctaagtaaggtggtacgacaacgtaaacgtagtcgacaacgtaaggtacgttacgagggtactacggtaccacgtagtacggaaccgtaacggaccgtaccgtctaacgtcgacgacgacacgtacctagtagtcggatacgtagagctaggtgtagaacgtactacgtcggaacgtacgtaccgggtacgttacgttaacgttacgtggtaccgggacgtaagggtacggtaccggtaaaggggttaacctttaaggggttttaaccgttttaggggtaaaggttttacggtttaacgggtttaccggggttaacgggg

SEQ ID NO: 129109 - DNA, 752 bp, Homo sapiens
  misc_feature: GYAE6OF01EEB4Z.45.78.H01.1.454.CMB.1.raw
tcagacgcgatcgacacgaccggtgctcgatttagtgtgagtagtttgggtttggggagagcatcacccagcaaccacatctgtcctctagagaatcccctgagagctccgttcctcaccatggactggacctggaggatcctcttcttggtggcagcacgccacgaggacgccccactcccgaggtgcagcgtggtgcgagtcgtggggctggaggtagaagaacgccggtcgggcctcgaggtagaacggttcctccgtgacgaaggttcttcgtaggaactacctaccgttccgaaccggtccttaacttaattaacgtaccgtacggttggggacgtccggaaccgaccggtccccgtagggaacggaacgggtcgttaggtaggtagggacgggtgggtaggtacggtaactaaccccgtaaaacccgtaaagtaacggttcggggtacgaacgtaaacgtaaaccgtagtacgaccgaaacggtaacggttaacggtttacggacgggtacggtacggtaccaaccgtaggtaccggaaacggacggaccgaaccgttacgactaccacgaaccacgtaccgtacccgtagtaacgggcggacgtacggtaggaccggtcggaacggttcgaagggtactaacggtccgtaacggacccgtaccgggtaccggttacgttgtttaacgtccggtaggtcgggacggaagtcggtaaggtacggttaaattgggttaggtttacggg

SEQ ID NO: 129110 - DNA, 765 bp, Homo sapiens
  misc_feature: GYAE6OF01C0YKO.45.78.H01.1.454.CMB.1.raw
tcagacgcgatcgacacgaccggtgctcgatttagtgtgagtagtttgggtttgggggagtcagacccagtcaggacacagcatggacatgagggtcccccgctcagctcctggggctcctgctgctctggcctcccagggtcgaccaaagtgtgactatccagatcgacccagttcctcccttcccacctgtctgctacgtgtggtaggagacagacgtccacctactcgtacgttcggcccgggcctagtcgaaggtagttaagttaacggtacgtggttcggtcgttacggtatacgacgacgaacggaaaccgaacgggaaaccgacccgtaacgcctctcgtacctacgtagtacgactagttacgttaaggttacggtaaggtcggtacctagtaacgtacggtcgacggtcggagtaggtagtacgtacggtaggaactagttactctacctacctaccacctacgtacgacgacgtacgcctagccgtacgtcgtagtacgttcgtttacgtttacgaactttaacggtttacctaccggtaacccgtaaccttaaacgggtgtttaacgtacggtttaaagttttacgggttacggttacccggttaaccgggttaaccgggaaccgggtaaacgggtaaaccggtaaaggtaaccgggtaaaccgtaaccggtaaaaccggttagggttacgggtaaccgtccgtaacgacccgttaaccgttcttaccggtttaactccgttacttaccccggg

SEQ ID NO: 129111 - DNA, 828 bp, Homo sapiens
  misc_feature: GYAE6OF01CHPKL.45.78.H01.1.454.CMB.1.raw
  modified_base (210)..(210): a, c, t, g, unknown or other
  misc_feature (210)..(210): n is a, c, g, or t
tcagacgcgatcgacacgaccggtgctcgatttagtgtgagtagtttggggtttgggggagcatcacccagcaaaccacatctgtcctctagagaatcccctgagagctccgttcctcaccatggactggacctggaggactcctctttcttggtaggcagcagccacgaggacgcccactcccgaggtgcagtcgtggtgcgagtcggnggggctggaggtagaagacgtccggtgggcctagagtaggaggtcctcgtgcgacggtcttcgtagtactacaccgttaccgaccggtacctacttaatacttacgacggttcgggtcgaccggacgtaccgggtaccccggtaggaaccgtagggtacgttacgggagggttcgggaaggttagggggtaccttaagggtaacctaaccctaaacccggtaaacgtaacgggttacggaaccggaacctaacgtaaacttaggaacgaactaacggtaaaggttaaacggttccggaacgggtacggaaccgggtacccaacggtacggtaaccggtaaccgggaacccgggtaaccgtaaccggtacctaacgtaccgtaaccggacccgaacgtacccggtaaccctaacgtaacgggttaggtaacgtaccggtagggaccggtaggaccgggttaaacggtacgtaaacgggttaccgtacggtacggaaacccggtccgggacccgtttaccggtaacggtttaccggtacggttaggacggggacggtaaggaccgggtaaggttaaacgggtttagtttaagggttttaacggttaggggtttaacgggg

SEQ ID NO: 129112 - DNA, 586 bp, Homo sapiens
  misc_feature: GYAE6OF01A3RKJ.45.78.H01.1.454.CMB.1.raw
  modified_base (253)..(253): a, c, t, g, unknown or other
  misc_feature (253)..(253): n is a, c, g, or t
  modified_base (556)..(556): a, c, t, g, unknown or other
  misc_feature (556)..(556): n is a, c, g, or t
  modified_base (564)..(565): a, c, t, g, unknown or other
  misc_feature (564)..(565): n is a, c, g, or t
  modified_base (567)..(568): a, c, t, g, unknown or other
  misc_feature (567)..(568): n is a, c, g, or t
  modified_base (570)..(570): a, c, t, g, unknown or other
  misc_feature (570)..(570): n is a, c, g, or t
  modified_base (579)..(579): a, c, t, g, unknown or other
  misc_feature (579)..(579): n is a, c, g, or t
  modified_base (581)..(581): a, c, t, g, unknown or other
  misc_feature (581)..(581): n is a, c, g, or t
  modified_base (583)..(583): a, c, t, g, unknown or other
  misc_feature (583)..(583): n is a, c, g, or t
  modified_base (585)..(585): a, c, t, g, unknown or other
  misc_feature (585)..(585): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagccccactcccaggtgcagctggtgcagtcgtggggctggaggtgaagagccgtgggcctcgagtgaaggtctctgcaaggcttcnggatacaccttcaccggtctactagtactacgacgtgggtcgcgacgcggccccgtaggacgaagggtcttaggagtggtagtgggatgggactaccgaaaccctaaagtaacgtgggtacggactaaacgtaaactagtcgaactaacgaagttaacggtttacgagggaccgtagggtaccaacgtagtacgaccgaacgggactaccgtacaagtacgacgaccaacgacgtacctaacgacgtacggacgtcgtacggacggcgggtcgtacgggacgaacgggtccgagtacgtaggntcagacgnngnngnatgctagcngngngng

SEQ ID NO: 129113 - DNA, 725 bp, Homo sapiens
  misc_feature: GYAE6OF01AV9MC.45.78.H01.1.454.CMB.1.raw
tcagacgcgatcgacacgaccggtgctcgatttagtgtgagtagtttgggtttgggggagtcagacccagtcaggacacagcatggacatgagggtccccgctcagctccgtggggctcctgctgctctggcctccgaggtgaccaaatgtgacatccagatcgaccctagtcctcccttccaccctgtctgctatcgtggtaggagacgagagtaccacatcctacgtcggccggacagtcagtagtatagtacgtggtcgccgtagtactacagacaagaaaccggaggaaacctacccgaagtcctaccgtgaccttacgtaagtaacggcttaagtacgttaaaggttaacggtaaacgggttccgggtaccctaacgttaccggtaaacggttcgaggtcggacgtaggtacggtaacgtcgtagggaactaaggttaacttccgacttccaacctaccgtacttacgacgtaccgtacggccttagacgtacggtaccgttagtaactttacggttaacttttacggaacctttaaccgtttagtaaccgtacgaacctaaagtacggttaataacgttaacgtttaacggttacgttaccggttacggggtacccgaaacggtaaacgggacgtaaaggttaacgaaactaccggaaagttaggtcggtacggacgtaccgacgtacctacgttaaccgttcttacccgttactcccg

SEQ ID NO: 129114 - DNA, 784 bp, Homo sapiens
  misc_feature: GYAE6OF01EBIJM.45.78.H01.1.454.CMB.1.raw
  modified_base (219)..(219): a, c, t, g, unknown or other
  misc_feature (219)..(219): n is a, c, g, or t
  modified_base (773)..(773): a, c, t, g, unknown or other
  misc_feature (773)..(773): n is a, c, g, or t
tcagacgcgatcgacacgaccggtgctcgatttagtgtgagtagtttgggtttggggtgaagaagcctggggcctcagtgaaggtctcctgcaaggcttcgtggatacaccttcaccggctactatatacacgtgggtcgcgacacggccccgtggacgaaggtcttgagtggagtgggatggactaccaaacctaacaagtggtcgacaacaaactgngacaagtagtaggttcgagggcgtaacggtcaacctgtacgaccgagggaaccaccgtaccatacaacgacacgtacgacctacaggtaggacgacgtgacggaccgagggtcctaggaactcgtacggaacggccgtaaaccggtccgggtcttagttactcggttagtcgggacgtaaaggacgtaacgagggttttaaccgttaagtttaggtttaggacgggttttaagggttaacggttaccgggttacgttaaagggtttccgggtaccggtcgggacccggggtaaccgaaacggggtaccctacgggttaccctaccggtccctaccgtacccgtcgtacccctaaccgaaccgaccggtaccctaccggtcccgttcccgtaacccgccacccgtaccctccgaccgacgccgaaccgtaccgtcggtccgggacgaccggtccgcccggttcccggaggtccgttccgggaccgttacgtaaccgaccggtttacttccgtacccgttcgtcgtacccggtcggtacgccgggtaggcccgggnggtaacccggg

SEQ ID NO: 129115 - DNA, 795 bp, Homo sapiens
  misc_feature: GYAE6OF01BK4ND.45.78.H01.1.454.CMB.1.raw
tcagacgcgatcgacacgaccggtgctcgatttagtgtgagtagtttgggtttggggtgaagaagccgtggggcctcagtgaaggtctcctgcaaggcttctggatacaccttcaccggctactatatacactgggtgcgacacggcccctggacaagggcttgagtggatgggatggatcaacctaacaagtggtggcaacaaactatgcacagtaagtttcgagggcagggtcaccatacgaccgaggaccacgtccgatcagcacagccctaacgagtggacgctaggagcgaggcgtagagtacgtactaccggaaccgaccgaccggtccggttattaacgtttacgtgggtacgacggaaaggtagggaccgtaaagggttaaactttaacggttagtttttagggaaacggtttggtttaacgttaccggggtaaggtttagtacggggtaccggttcggggttacggggacccggtaaacggggtaccccgaccgggttaccgtacccgttcctacccgtccgaaccgtcccctacccgaacccggaccggtaccctaccggttccccgggttccccttcccccgtacggacccccttacccccttacccgacccgtaaaccgccgtaacccgtaccccggttccgggtaccgggaccaacccggtcgggccccggtccggttcgggacccgttcggtcccgtacgggtaccgtaaacgggtccctttaacccgtccggtaccgtacggtccggccggtacgggcgggtccgtcgggtacggaccgg

SEQ ID NO: 129116 - DNA, 701 bp, Homo sapiens
  misc_feature: GYAE6OF01CQFMF.45.78.H01.1.454.CMB.1.raw
  modified_base (135)..(135): a, c, t, g, unknown or other
  misc_feature (135)..(135): n is a, c, g, or t
  modified_base (140)..(140): a, c, t, g, unknown or other
  misc_feature (140)..(140): n is a, c, g, or t
  modified_base (191)..(191): a, c, t, g, unknown or other
  misc_feature (191)..(191): n is a, c, g, or t
  modified_base (211)..(211): a, c, t, g, unknown or other
  misc_feature (211)..(211): n is a, c, g, or t
  modified_base (241)..(241): a, c, t, g, unknown or other
  misc_feature (241)..(241): n is a, c, g, or t
  modified_base (277)..(277): a, c, t, g, unknown or other
  misc_feature (277)..(277): n is a, c, g, or t
  modified_base (615)..(615): a, c, t, g, unknown or other
  misc_feature (615)..(615): n is a, c, g, or t
  modified_base (693)..(693): a, c, t, g, unknown or other
  misc_feature (693)..(693): n is a, c, g, or t
tcagacgcgatcgacacgaccggtgctcgatttagtgtgagtagtttgggtttggggtgaagaagcctgggcctcagtgaaggtctcctgcaaggcttctggatacaccttcaccgctactatatacacgtgggncgacncggcccctggacgaaggcttgagtggagtgggatggataccaaaccctaanagtggtagacaacaaactancgacagagtaagttcgagggcgaggtccanagtcgacgaggactacgccatcgagcagtcgactanagaggacgtgcgagcgacggcgagagtacgtcgagacgaccgtacggtcgttagtactgtgacgcggaagacggtataaggtaagtttcggttaaggtttaggggactttagggttacgtaaccggggttaaggtgtacggggacgtttcggggaacgggttacccgaacgggaccgttactacccggtacccgtcgtaccgtacccgacggtacccaccggtaaccgaccggttacccgcgttacccggtcccctaccccgtacggtcccctaacccgtaccgtacgaaccgcgacccgttaccggcggtaccggggacctccgcggcccgtacggngtaccggccgtcgggacgtacgtaccggtaacccttctaccggttcgagttcccgaggtccctagggcgtccggggtnaaccgggg

SEQ ID NO: 129117 - DNA, 873 bp, Homo sapiens
  misc_feature: GYAE6OF01AY9VK.45.78.H01.1.454.CMB.1.raw
  modified_base (199)..(199): a, c, t, g, unknown or other
  misc_feature (199)..(199): n is a, c, g, or t
tcagacgcgatcgacacgaccggtgctcgatttagtgtgagtagtttgggtttgggacccagcaaccacatctgtcctctagagaatcccctgagagctccgttcctcaccatggactcggacctggaggatcctcttcgttggtggcagcagcccacacggacgccccacctccccgaggtcgaccaggcgtgggtcnccgaggtccggtgggggcgtaggtagggtacggaaaggaacggcccggtcgggggccctacggtaaggtggtaaacgggtccctccgtaggaccgaacggtccgtttacgtaggtaacttaaccctacccttaccggacccggtccttaacttaattaacctaaccgtaccggtggggtcgacccggaaccgtacccggtccccgtaggggaaccgtaaggggtccgttaggaacggttgggtaacggtggggtaacgttagggaacctaacccgtaaaccctaaacgaaggtacgggtaccgaaactaaccgtaaacgtagttacggaacctaacggtaagttaaccggtaggtaacgggacggtaacgtacccaaacggtacgttaaccggaacggaaccgggtaacccgaccgtaacgacgtaccacggaacctaccgaaccgtactaaccggtaagtcggaacgtacggtaccgaaggaccgtaggtaccgtaacggagtacgtacccgtaacggacccgggtaacccgttaccgggtaccggttacgttaaccgtacgggtttacggaacggtaggaaccgggtagggtaaaccggaaacgtttagggttaccgttttaagggtttaacgggtagggttttaccggttaagggttaacggtaaccgggg

SEQ ID NO: 129118 - DNA, 790 bp, Homo sapiens
  misc_feature: GYAE6OF01AWZQT.45.78.H01.1.454.CMB.1.raw
  modified_base (192)..(192): a, c, t, g, unknown or other
  misc_feature (192)..(192): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtgcagcagccagaggacgcccactcccgaggtcgcagctggncagtcgtggggctggaggtagaagagccgtaggggcctacgaggtgaacggtctccgtggactagggtcttcgaggactaccacccttcgaccggtctactactagtaccgtcggtagggtcgaccgtaccgaccgggtccccgtagggaacgtacggggtctttacgggaacgggtttccgggaagttacggggtattaacgggtaccttaacccgtaaaccccgttaaagaacggttaggggtacccgggtacctaaaaccggtaaaacgttacggtacgacccgttaaacgtaacggtttaacgttccggaacggggttcaaccggggttaccaacggtacgtaccgaaccggacgggtaccacggttaccgacgtaccgacgtaccgactaccgaccttacggacgtcggtaccgacggttccggagttaccggaccgggtaagtacggaacgttaccgtacgggtaaccggtacccggacggttacccgggtaccggtttaacgtaacgttttccggagggtaccaaggggtaacggtcgggtaaacccggttaggttaaccgttttcggggttacggtttgggttaacgggg

SEQ ID NO: 129119 - DNA, 667 bp, Homo sapiens
  misc_feature: GYAE6OF01E5D4K.45.78.H01.1.454.CMB.1.raw
  modified_base (253)..(253): a, c, t, g, unknown or other
  misc_feature (253)..(253): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagagcctggggcctcagtgaaggtctccgtgcaaggcttcgnggactacaccttcaccggctactatactacacgtgggtcgcgacgacgcccgtggacaagggtcttggagtggagtgggatggactaccaaacctaacgaagtgggtacggacaaactaaactcgacgacaaccgaaggttaaacgtttcggaaggggtccgtaacgggggttacccaaccgtaagtccggaaccgaacggggaacctaccgtaccacgtaccacgaccaacgtaccgaccctaaccgaggttacgggacgtacggtacggacgggaccgggacggtccggacggtaacgggtaccgtacggtaaccgtaacggtaacgtaccggtaccggtagttacgttaggtcggttacggaccggaggtaccggtacgtaagggtaacttacggttggtttacggtaggg

SEQ ID NO: 129120 - DNA, 712 bp, Homo sapiens
  misc_feature: GYAE6OF01DI4EG.45.78.H01.1.454.CMB.1.raw
  modified_base (162)..(162): a, c, t, g, unknown or other
  misc_feature (162)..(162): n is a, c, g, or t
  modified_base (170)..(170): a, c, t, g, unknown or other
  misc_feature (170)..(170): n is a, c, g, or t
  modified_base (208)..(208): a, c, t, g, unknown or other
  misc_feature (208)..(208): n is a, c, g, or t
  modified_base (300)..(300): a, c, t, g, unknown or other
  misc_feature (300)..(300): n is a, c, g, or t
  modified_base (311)..(311): a, c, t, g, unknown or other
  misc_feature (311)..(311): n is a, c, g, or t
tcagacgcgatcgacacgaccggtgctcgatttagtgtgagtagtttgggtttggggagtcagacccagtcaggacacagcatggacatgagggtccccgctcagctcctggggctcctgctgctctggcctcccgaggtcgaccaaatgtgacatccaagntcgacccngttcctccttacccaccctgtcctgcatctgtaggganacgagtagtccaaccactactacgtcgcccgggcacgacagtagtatacgtacgtggttcgctggactcgagaccaagaaacgaaggaaccncctagccttcntctacgtagaacgctaattacgttaaggtttaacggaacgggttcggacccctagtaacgttacggtcgacgcggtacgtagggtagaccgtcggtaggtaaacaacggttaactcgttacctcctaacctacctcgtaccgacgtaccgacgtaccgtcggacctaccggtaccgtacgttaacggttacgttttaccgtaaccggttaactttaaccgtactaacccgtaacgtaacccgttagtaattaacgttaagttaacgtttcgttaccgttaccggtaaccggtaaccgtaagggaaccggttaaacggtaaacgtaaaccgtaaaccgtaaaacggtcgtaacggtcggtctaaccgacgtactactcttcgttcttaccttcgttaccccg

SEQ ID NO: 129121 - DNA, 721 bp, Homo sapiens
  misc_feature: GYAE6OF01CDUGY.45.78.H01.1.454.CMB.1.raw
  modified_base (265)..(265): a, c, t, g, unknown or other
  misc_feature (265)..(265): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttgggtggcagcacgccacgaggacgccccactcccgaggtgcgagctggtgctaggtcgtgggctggaggtagaagacgccggtacgggcctgagtgacggtctcagacgagtcttgngaactaccgtacctcgaccgtctactatactactcggtggtcgacgaccgtaccggcccgtaggaaccgtacggtcttaggagtacggtcggtagggactacggtaacacccgtaaaaccgtagtacggtcggtaccgactaaactaaacgttagacgacgtaacgtaaggttaccgttcggaacggtacgtaccgggtacctaacgtacggtaccggaaccggtacgggtaaccccacggttaaccctagtacccggaacgtccccgaaagtccgacccgtaatacgggtaggaaccgtgtacggacaccgggtagtacgtaggaaccttcgtaacgtaccggaccggtaccggttccggtacggttactaacggttccggttacggagggtacccggtaggaaggtaccggttaaaaggtttaccgttttagggtttagggtttaggtaccggg

SEQ ID NO: 129122 - DNA, 676 bp, Homo sapiens
  misc_feature: GYAE6OF01ASFO9.45.78.H01.1.454.CMB.1.raw
  modified_base (554)..(554): a, c, t, g, unknown or other
  misc_feature (554)..(554): n is a, c, g, or t
  modified_base (569)..(569): a, c, t, g, unknown or other
  misc_feature (569)..(569): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacgaggacgcccactcccaggtcgcagcgtggtcgcgagtcgtggggctggaggtgaagacgccgtcgggcctcgagtgaacggtctccgtgacgaacggtcttacgtaggtactaccgaccgttccaccggtactaactacgtactaccagtcggtcgccgtacgaccggtccctaggaacgtacggtcgttggaggtcggaagtcgggtaataggtaactacccgaaaccgtaagacgttacgggtcgaacctaacgtaaacgtctacgtaaccgaacgtaacggttaacgttacgacggggtacgtacgggtacaccgtacgtaacggaaccgtaacgggactaccgtaccaacgtacgacgtacccagtacgtcaacgtggtacggacncggtaacgacgacgnggtacgagaacgtgtacgtacgacgtaccggacgtcgtagttacttccggagggcgtaacggtagaacggtaactaacggttagttaacggtttagttggtaacggg

SEQ ID NO: 129123 - DNA, 713 bp, Homo sapiens
  misc_feature: GYAE6OF01BCNWG.45.78.H01.1.454.CMB.1.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggactcctctttcgttggtcggcagcacgccacgaggacgacccacctcccgaggtcgcgagtcgtgggtcgccgaggtcggtggggctggaggtagaagaacggtccggtcggggcctacgtaggtacggaacggttcctccgtggacgaacggtcttcgtaggtaactacctaccgttcgaccggcttactagtaacgtaacctacggtagggtacgaccggaccgaccggtccccggtaggaaccggtaacgggtaccgttaggtagggtagggtacgttaggggtagtacgggtaactaccctaaaccgtaacgtaacgtcgggacggaacctaaacgtaaacgtacgtacgaccaacgtaaggtacgttacggacgggtacgtacgtaccacgtacgacggaaccgtacggacgaaccgtacgacgtacgacgacctacgacctaccgtaacgacggtagaccggtcacgggtacgaccgtaggtcgaaggagttaccgacgacgacggtacgccgttcgtacgtacgtagtacggcgagtagacgtcgaacgtaagttggttagtcggtagg

SEQ ID NO: 129124 - DNA, 833 bp, Homo sapiens
  misc_feature: GYAE6OF01A85MJ.45.78.H01.1.454.CMB.1.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacgaggacgcccacctcccaggtgccagcgttggtgcgtacgtcggtggggctaggaggttacggaaaggaacggtcccgtacggggggccctaccgtaagggtacgggtaacggttccgttacccgtacggtacggtaaacgggtcctttacgtacgggtaacttacccgtaaccttaccgacccggtacttaacgtatactacgtacgtgggtcgacgtaccgaccggtcccgaggaaccgtaaggtctacgggtaggtaggacggttagggagttaggtactaaccaacctaagacgtacgggtacgtaactaacgtaaacgtacgtcgtaacgtaacaacggttaacgtttacgggaacgggtacggacgggtacccacgtacggaaccggaaccgggtaaacggaccccggtaacggtccctaactaccggaacgacccgaaccgtaaccgtacccgtaacgagtacgggaaccgttacgggaaggaaccggaggttaacgggtaccgttagggtaaccggttacgacccgggttagaacccgggaaccgttccgggtaacccgtttagggttaaaccggttaggttacggttaaccggaaccggtaggaaacgggtacgtaacggtttaaaccgttaggttttacgggtttagggttaaaccgggg

SEQ ID NO: 129125 - DNA, 603 bp, Homo sapiens
  misc_feature: GYAE6OF01A9LIP.45.78.H01.1.454.CMB.1.raw
  modified_base (200)..(200): a, c, t, g, unknown or other
  misc_feature (200)..(200): n is a, c, g, or t
  modified_base (205)..(205): a, c, t, g, unknown or other
  misc_feature (205)..(205): n is a, c, g, or t
  modified_base (282)..(282): a, c, t, g, unknown or other
  misc_feature (282)..(282): n is a, c, g, or t
  modified_base (389)..(389): a, c, t, g, unknown or other
  misc_feature (389)..(389): n is a, c, g, or t
  modified_base (402)..(402): a, c, t, g, unknown or other
  misc_feature (402)..(402): n is a, c, g, or t
  modified_base (443)..(443): a, c, t, g, unknown or other
  misc_feature (443)..(443): n is a, c, g, or t
  modified_base (556)..(556): a, c, t, g, unknown or other
  misc_feature (556)..(556): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatcgacccagtctcccttccaccctgtctgcatctggtagganacagntcaccatcacgttggcccggcagtcagagttattagtaacgtggttgcctggtatcagcaacgaaacgagggaaacncccgtaagctcctgctatagacggcatacttagttaacgaacggtcgggtaccagtacaaggttcaggcggactaggtggatcgaggacagtactcacttcgacacntaccagcacgtcngactagccgtgtatagtttctttacgaacttaattactacnctaaccaaactggttaactgttaacttacggtttaccgttacggtaccggttaccggaacgaaacgggtaacgtaaaggaacggttaaacaaaccgtaacgtaacggttcggnggtcccttaaggaccctaaacgtctacgttacttcgttccctacccg

SEQ ID NO: 129126 - DNA, 707 bp, Homo sapiens
  misc_feature: GYAE6OF01EAOFB.45.78.H01.1.454.CMB.1.raw
tcagacgcgatcgacacgaccggtgctcgatttagtgtgagtagtttggggtttgggggagtcagacccagtcaggacacagcatggacatggacgggtcccccgctcagctcctggggcctcctgctgctcgtggcctcccgaggtcgaccaaagtgtgacatccgagatcgaccctagtccttcccttcctaccctgtactgctatctaggtaggacgacagactcaccataccgtacgttcggcccggacagtacagtagtaatttaggtaacgttgggttacggccttaggtataccgaggaaccgaacggaaaccggaaggaaacccgtacccctaagtcccttccgtcgtactagttaacgtaacggtactaacgttacgttaaggtttaacggaacggttacgggtacctaagtaccggtaacggttcgacggtcggtacgtagtggtacgtcgtacggactagtactctactcacactatacgacgagtccgacgtgaccgtacgctacgtagtacgtttacgttacgttaacctaacgtttctacgtacgtccctaaagtgtaacgtacgttagttttacgttaccgttacgggtaccgttaccggggaaccggtaaacggtaaacgggtaggtaaacgtaacggtaacctaaaggcggttacggcagtccaaccgtcttactagttctctggtaccc

SEQ ID NO: 129127 - DNA, 1034 bp, Homo sapiens
  misc_feature: GYAE6OF01C1QG6.45.78.H01.1.454.CMB.1.raw
tcagacgcgatcgacacgaccggtgctcgatttagtgtgagtagtttgggtttgggggagtcagacccagtcgaggacacagcatggacatgacgggtccccgctcagctccgtggggcctcctgctgctcgtggcctccgagggtcaccaattgagacctactccgagtacgtaccgaacctacgttcccttacccttcccgtacctgtccgtgtacctattcggtaggaaggacgaacaacggtacaccaacctacgtaccgtacgttcccggggaccggtacctacggcgtaaacggttaagtttaaacgtttaacgggttaacgggttacgggttttacccggtacccggtaaggtttaccaacggtaaccgaaaaccggaaaaccgggtaaaaacccggaaaccggggtaaaccccggttaacccccgtaaacgtacccccgtttacgtttaaccgtaaccgtttaaccgttaaagggtaaccggttaccgttaaaccggttttaacgggtttttaaaaacgggttaaacggtttaaaaccgggggtttcccggggtaaaaccccttaaggtttaaaccggttaaaccgggtaccggaccgggtttaacggtcggttaaacggggtttacggaaacggtttaccgggtaagggaaaaccttaagggtttaaacccctccgttaaccttaaccccggttaaacgaaaccctaaccggttaccgaaaccggtacccgtaccggttaaccccggacgtaacccgttaccggttacgttacggtaaacgtttttaggtttaaccggttaacttaaccgttaaccttaacgttaaccgtaaccgttaacgaacgttaaacgtttagtttaacgttaacgtttaccgttaaggtttaccgttaccgggtaacgaccgggttaaacgtaacggtaaccgggttaaaacgtaccgtaaacgtaaaaccgtaggtacggtacgtaaccggtacccaccgtaaccttacttccggttactccgtttacgttacccccgg

SEQ ID NO: 129128 - DNA, 644 bp, Homo sapiens
  misc_feature: GYAE6OF01A7I2O.45.78.H01.1.454.CMB.1.raw
  modified_base (513)..(513): a, c, t, g, unknown or other
  misc_feature (513)..(513): n is a, c, g, or t
  modified_base (525)..(525): a, c, t, g, unknown or other
  misc_feature (525)..(525): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacgaagggcttgagtggatgggatggatcaaccctacaatggtgcacaaactatgcacagaagtttcagggcagggtcaccatgaccgagggacacgtccatcagcacagcctaacagtggagccgtgagccgaggcgtgagtactcgtagaccgtaccgaccggccgttacgtacttacgtgtgacgagacggacgtaggaattacggtagttttgggagttggttacgttacgggacggttagtcggtacgtacgtcggggtaccgaacgggtacccacgggtacctaccgtccgaccgtcgacgtcccgtccaaccgtaccgggtacccagtccggtcccttccccgcgaccctacccnccgtaccaacgnaccgacctcggacgggtcacggaccggcgacccgtggccgtacgccgtagggtaccgaacggttcgtaccgttccgacgtaccgttccggtcgttcggtagccgggcgggtccgtcggg

SEQ ID NO: 129129 - DNA, 724 bp, Homo sapiens
  misc_feature: GYAE6OF01DFB2I.45.78.H01.1.454.CMB.1.raw
  modified_base (216)..(216): a, c, t, g, unknown or other
  misc_feature (216)..(216): n is a, c, g, or t
  modified_base (294)..(294): a, c, t, g, unknown or other
  misc_feature (294)..(294): n is a, c, g, or t
  modified_base (297)..(297): a, c, t, g, unknown or other
  misc_feature (297)..(297): n is a, c, g, or t
  modified_base (300)..(300): a, c, t, g, unknown or other
  misc_feature (300)..(300): n is a, c, g, or t
  modified_base (319)..(319): a, c, t, g, unknown or other
  misc_feature (319)..(319): n is a, c, g, or t
  modified_base (352)..(352): a, c, t, g, unknown or other
  misc_feature (352)..(352): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccgctactatatacactgggtgcgacacggcccctggaacaagggcttgaggtggagtgggatggataccaaaccctaacaagtgggtggacaactaaactntcgacaacgagtaagtttcgagggacgagggtaccaccatcgaccgagggaccaccgtccatcgagccacacgcctanagnggngcgtgacgcaggctagagntcgtagacgaacgcgccgttaggttacttacgnggtagcggaggacgacgtaaggtatttacggttagttttaggtagtttaggttcgtagggtacgtaggtcggtacgtcggacgggaccgaagggtccgtacggtccgtacccgtcctccgtaccgacgtcccctacgaacccgaacggtcccgtacgtttcccgtccccttccccgtaccgccccttacccctaccgtaccaacgccgtacccgtacgtccgggtacgggacccaccggcggtacccggtcccggtacgggcccgttcggtacccggtacggaccggttaaacggtaccctttaccccgttccgtaccggtaccgttacccggtcgttaacggccggtaccggggtcggttaccggaccggg

SEQ ID NO: 129130 - DNA, 689 bp, Homo sapiens
  misc_feature: GYAE6OF01DCUTK.45.78.H01.1.454.CMB.1.raw
  modified_base (473)..(473): a, c, t, g, unknown or other
  misc_feature (473)..(473): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgaccaaatgtgacatccagactcgacccagtcctccatcctacgtgtctgtcctcgtggtggagacagtagtaccaaccatccgtacgttcggccgggacgacgtcgaggtacagttgaactaattagtggtaggtctggtacacgaagaaaccaaaacggaagggtaaacgttacgtaacggttcgttacggtctagtgtctcgtactacttaacgtttacgtacgggtttcccggggtccctcgtacgtacttcgacggtcggacgtgggtacgggtcgtacggtacctacgttcttaccgacctctaccactactacgaacgtacgtccgngcctacggtcctaaggacgtagttcgtaacctacgttaacgttactagtacccgtaacgttaacggttaccgtttacgggtccgttccgtccgttacgttccgggttaccgggagggaaccggtacgtagggtcggaatacgaaaccggtaaagtcgtggtaccggctaccggacccaagtcgttccttcgtctttaccctccgttcccgtacccg

SEQ ID NO: 129131 - DNA, 816 bp, Homo sapiens
  misc_feature: GYAE6OF01DW9AT.45.78.H01.1.454.CMB.1.raw
  modified_base (217)..(217): a, c, t, g, unknown or other
  misc_feature (217)..(217): n is a, c, g, or t
  modified_base (233)..(233): a, c, t, g, unknown or other
  misc_feature (233)..(233): n is a, c, g, or t
tcagacgcgatcgacacgaccggtgctcgatttagtgtgagtagtttgggtttgggggagtcagacccagtcaggacacagcatggacatggacgggtccccgctcagctccgtggggctcctgctgctcgtggcctcccgaggtcgaccaattgtcgacactccaagagtacgaccctaggtccttcccttacccctacccgttcgtcctgacctnttaccgtaggtagganacggagacgtacaaccctataccgtacgttccggcccgggtacctaggttaccaaggtaagtttacgttaaacgttacggttcgggttgtccgttaggtactacgagaccgtaaacgaaaccgtaaccgggaacctaccgtagtccctacgtcgtactacgtaagtacgctaacgttcgttaaggttaacggaaacggttccgggtaacctacgtaacgtaacggtaccgacggtaccggacgttacgggtacgtacgttaggtaacgggtaaactagttaacccgtctaacctcccgaaccgtaacctacgtaccaacgccctaaacgttccgacgacttaccggtactacggttacgttaggtttactttaccggaactttttaaacccgttacttacgtaaccgaaccttagttaaacgttagttaagtttaacgtttaccgggttaacggtccgttaccgggtaaacccgtacgggttaacgggaaacccgtaggttaaaccggaaaccttacgggaaacgttacgagggttcaccgtacccgtaccgaacttagtaccttcgttcccgttactacccg

SEQ ID NO: 129132 - DNA, 683 bp, Homo sapiens
  misc_feature: GYAE6OF01B6G5K.45.78.H01.1.454.CMB.1.raw
  modified_base (343)..(343): a, c, t, g, unknown or other
  misc_feature (343)..(343): n is a, c, g, or t
tcagacgcgatcgacacgaccggtgctcgatttagtgtgagtagtttgggtttggggctgaggtgaagaagcctggggcctcagtgaaggtctcctgcaaggcttctggatacaccttcaccggctactatatacactgggtgcgacaggcccctggacaagggcttgagtggatgggatggatacaaccctaacaatggtggcacaaactatgacacagaagtttcgagggcagggtcaccatcgaccgagggacacgtccatcagcacagccctacatggagctgagcgaggctgagatcgtgacgacacggtccgtgtacttacgtgtgcgaggacgganaggtaaagtttaacgtgttttagggagtttcgggtttagttccgggtaaggttcgtagggtcggtacgggtcgggggtaccgaacggggtacccgacggttcccgaaccgttcctcccgtaccgacgtccccgtaccgacccggacgggacccctacggtcccggtcccttcccccggtcggtcccctacccctccgtccgaacgtccgcccgtacccgttcgggcgggccgtaaccggacggcccggtacccggtcgggaccgtccggtcgtacgggacctaagggtacccttaccgttcccgtacgacccgtcggtcccgttggcccgggtaacgggg

SEQ ID NO: 129133 - DNA, 761 bp, Homo sapiens
  misc_feature: GYAE6OF01AX7H7.45.78.H01.1.454.CMB.1.raw
  modified_base (222)..(222): a, c, t, g, unknown or other
  misc_feature (222)..(222): n is a, c, g, or t
  modified_base (566)..(566): a, c, t, g, unknown or other
  misc_feature (566)..(566): n is a, c, g, or t
tcagacgcgatcgacacgaccggtgctcgatttagtgtgagtagtttgggtttgggggagcatcacccagcaaccacatctgtcctctagagaactcccctgagagctccgttcctcaccatggactggacctgggaggatcctcttcgttggtggcagcagccacgaggacgcccactcccgaggtgacgacgtcgtggtgcgtaggttcggtcgggggtntggagggtagaaggaacggtccggtcggggtacctacggtaggtacggtaacggtcctcgtgacgtacggtctttacgtaggtactaccgtacctaccggaccgtactaactatactacgtcggtacgggtacgaccggtacggaccggtacccggtggtaaaccggtacgggttcgtaacgggtaggtaagggacggtaggggtaactaggaacctacctaaccggtaaacgtacggtagggtacgaactaacctaaagtgtacgaactacgtaaggttacggtacgcgggtacggacgtacctacgtagtaccgacgggacgtacgaccgtactaccgaacncgtaaccacgtacccgtacgtaacgtggtaaccggtaggtacggtacgaacgggacgtacggtaggtaccgtaagggtacttaccgggacgaaccggtccgggtaccgttacggttaggttcgtagggtggtacgggaggtaccggaggttaacggtaaggttaccggtttaaggtttgggttaaggtttagggg

SEQ ID NO: 129134 - DNA, 925 bp, Homo sapiens
  misc_feature: GYAE6OF01BL58U.45.78.H01.1.454.CMB.1.raw
  modified_base (102)..(102): a, c, t, g, unknown or other
  misc_feature (102)..(102): n is a, c, g, or t
  modified_base (151)..(151): a, c, t, g, unknown or other
  misc_feature (151)..(151): n is a, c, g, or t
  modified_base (444)..(444): a, c, t, g, unknown or other
  misc_feature (444)..(444): n is a, c, g, or t
tcagacgcgatcgacacgaccggtgctcgatttagtgtgagtagtttgggtttgggggagtcagacccagtcaggacacagcatggacatgagggtccccgntcagctcctggggctcctgctgctctggcctccaggtgaccaaatgtanacatccagactcgaccctagttcctcccttcccacccgttgtccgtagactagttccgttagggtaagggaacaacggaaggtaccgtaccaaccgtattaccggtaccgttccgggcccggggtacctaacggttaccgaaggttaaagtttacgttaacgttaacggttgggttacggtaccgttaggttaactccgaacgtacgtaaaaccggaaaaccggaaggggtaaaacccctccccgtaaacggtcccttaccggtacgtaccgttaacgtaaggtaaaccggtnttaacgttaacgttaaggttaacggaaaggttccgggtaccctaagtacggttaggttccgaggtcgtaacgtaggtacggtatacgggtacggaactaacggttaactacccggtacttaccgtacccgaacgttaccgactaacggaccgtacccgtacgtaacccggctaccggtaccgttagttaaaccgtttggttaacgtttaccaaacgtttaacgtttaaccggttactaaccgtaaaccgtaacgttagggttaaacttacgttaacggttttaacggtttaaccgttaccccggggtaccgttaaccgggaacccgggttaaaacggtaccgggttaaaaccggtaaacggttaaaaccgttaaccggttaaaacgggtaccgttttggggaaaccgttacctaaaccggtacccccgttaagttacccggtttaaccggttcccttcctttaacccgggttaaccccccg

SEQ ID NO: 129135 - DNA, 865 bp, Homo sapiens
  misc_feature: GYAE6OF01D9IFZ.45.78.H01.1.454.CMB.1.raw
tcagacgcgatcgacacgaccggtgctcgatttagtgtgagtagtttgggtttgggggagtcagacccagtcaggacacagcatggacatgagggtccccgctcagctccgtgggctcctgctgctctcggcctcccgaggtgaccaaatgtgacatccagatcgaccctagttccttccttccctacccttgtcctgacctatcgtaggtaggagacgagtacgtcaacctactccgtacgttccgggcccgggacctaggtacgaaggttagttaacgtttaacggttaaccggttgggttaccgtaccgttagggttactacgaacggaccggtaaaacgaaaccggaacgggtaacccgtacccctaaggtcccttaccgtactacgtttacgtaaacgtaaccggtactactttacgtttaacgggtttaacgggaaccgggttaccggggtaacctaacgtaaccggttaacggtaccgagggaccggtacgtacgggtacggtacgtccggtaagggaacctaacggttaacttacccgtacttaccgtaacccgactacgttccgaacgaccgaccgtccgtacacgttacgcgttagttagttaccgtttatttaccgaactttactttacgtaccgtaaccgttaacgtaaacgttagtaacgttacggtttaaccgttttacggtttaaccggttcccggtaacccggttaacggggaacccggggtaacggtaaacgggtaagggttaaaccggttaaaacccaacgggtaaaacgtttggtaccgggtacgtaccgttaccacccgttaaaccgttggttaacctttccggtttaacctccccggttaaccc

SEQ ID NO: 129136 - DNA, 697 bp, Homo sapiens
  misc_feature: GYAE6OF01EWBIN.45.78.H01.1.454.CMB.1.raw
  modified_base (106)..(106): a, c, t, g, unknown or other
  misc_feature (106)..(106): n is a, c, g, or t
  modified_base (175)..(175): a, c, t, g, unknown or other
  misc_feature (175)..(175): n is a, c, g, or t
  modified_base (211)..(211): a, c, t, g, unknown or other
  misc_feature (211)..(211): n is a, c, g, or t
  modified_base (687)..(687): a, c, t, g, unknown or other
  misc_feature (687)..(687): n is a, c, g, or t
tcagacgcgatcgacacgaccggtgctcgatttagtgtgagtagtttgggtttgggggagtcagacccagtcaggacacgagcatggaacagtgagggtcccccgntcagctcgtggggcctccgtgctgctctggctccaggtcgacgaatgtgacactccagatccgaccgtntcctcccttccacctgtcctgctactcgtagaaggngtacgagtacgtacacctatccgtacgtacggccgtacgacgtagaacgttagttcttaaggttaccggttggtcggtcgaggttacacgacgacgtaagaacggaggaacctacccgagtcgactcgtagtcgtaagtacgcttaacgtacgttaaggttaacgacggttaccgggaacctgtaaaccggttgacctacggacggacgtaaggttcgtaagtacgggtaaggaacgttaacgacttttacccacctaccgtaccaacgtataccgtaacgtacctaccgtccgtcgacgtataccgtagtagttaccttagttactaccttacgtttacctagtacgtacacgtaagttcgtagttaacgttacgttaccgttcgtaccggtaacgaccggtaaacggtgtaaagtaccgggtaactaaggtaccgttagacggtcggactaggacttactacgtacgttacttntcccgtaccg

SEQ ID NO: 129137 - DNA, 933 bp, Homo sapiens
  misc_feature: GYAE6OF01BT6H5.45.78.H01.1.454.CMB.1.raw
  modified_base (208)..(208): a, c, t, g, unknown or other
  misc_feature (208)..(208): n is a, c, g, or t
  modified_base (285)..(285): a, c, t, g, unknown or other
  misc_feature (285)..(285): n is a, c, g, or t
tcagacgcgatcgacacgaccggtgctcgatttagtgtgagtagtttgggtttgggtgaagaagcctgggcctcagtgaaggtctcctgcaaggcttctggatacacccttcaccggctactatatacactgggtgcgacacggccccctggacgaagggcttgagtgatggggatggatcaaccctaacaagtggtgcaacaaactntgcacagtaagttcgaggcaggtcacctatacgacctagtcggacacgtacactcagcacacgcctacagtacgganctaggaggtaccgagggccgttaggacgtaagtccgtacggaaaccggtaaccgacccggggttacccggtttagttaaaccgtttaccgttgggttacggaccgggtaacgggacggaccggtaaaggtaaagttttaacgggttttaagtttttagggggtaaggtttacgggttttaacggttcgggggttaaaccgggtttaacggttcggggttaacccgggttcggttacccgggggggacctaaaaaccgggggggaaccccgtacccgggttacccgtacccggttccccgttaccccggttacccgtacccggtaccccgtaacccccgtaacccggaaaccccgggtccccgtaaccggtttccccggtttacccccgtttcccccccggtacccggtaccccgtaccccccccgtaccgtaaccccgtaacggtaaccccgcccgttaaccccgggttacccgggtacggggaccccgtaaccgggtacccgggtccccgggtccccgggtgggtcccgttacccgggtccgttaaccgggtaacggttaaccgggttaacccggttcccgtttacccgtcggttaacccgttccgggttaccgttaccggtcgggtccgggccggggttaacccgg

SEQ ID NO: 129138 - DNA, 854 bp, Homo sapiens
  misc_feature: GYAE6OF01EV2EM.45.78.H01.1.454.CMB.1.raw
  modified_base (212)..(212): a, c, t, g, unknown or other
  misc_feature (212)..(212): n is a, c, g, or t
tcagacgcgatcgacacgaccggtgctcgatttagtgtgagtagtttgggtttggggctgaggtgaagaagccgtggggcctcagtgaaggtctcctgcaaggcttctggatacaccttcgaccggactactatactacacgtgggtcgcgacgacggcccctaggaacgaagggtcttggaggtaggagtgggatggactacaaccctaanagtgggtcgacaaacaaactagtacgactaacgaaggttaacgtttacggaccggggtacgtaacgggttaccaaccgacgtaacggaaccggaacgggtacctaacccggtctacgtacgacgaccgaaccgtaacgtaccctaacgtaggtacggacgtacggtacggacgaccggaggtacgtaaggaacgttacgtcgtaccggaccgtaaccgccggtacgttagttacgtacgtggtcggacgaggtacgagtaacgttagttaacggtttgttaggtacgtttacggttaggtaacgggtacggttaacggtcgggtaacggtccgggtaacgggaacccggtaacggaacccggtaccgggttcctaacccgggtccctaccgtaccggaacccttccggaacccgtaccggaaccggcccgttaaccgtccccggttaccccgtcccgtaacccgccccttacccgtacccgtaccgtaaccgtccgtacccggtacccgttcggggccggaaccgtcggacccgggttcccggaccgggtccggtaccgttacccgggtcgttaacccgggtacgtaaacccggttcccgtaacgttcccgtcggtacgtccggtacggtcggaggtccggg

SEQ ID NO: 129139 - DNA, 772 bp, Homo sapiens
  misc_feature: GYAE6OF01ATHDE.45.78.H01.1.454.CMB.1.raw
  modified_base (628)..(628): a, c, t, g, unknown or other
  misc_feature (628)..(628): n is a, c, g, or t
  modified_base (724)..(724): a, c, t, g, unknown or other
  misc_feature (724)..(724): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggcctcccaggtgccaaatgtgactactccagatcgaccctagtcctccttcccaccctcggtctgctatctaggtaggagacaggactaccaccactcctacgttcggcccgggcctacgtcgaagtagttaacgttaagtaacgttcgggttggccgtagggttactacgaacgacgtaaacggaaaacccgtaaggggaaaacccgtacccccgtaaaggtcctcccgtgtaccttaccgttaagacggtacctacgttacgtttaaggtttaacggaacggggttccgggtacccctaagttccggtaaacggtccgaggtccggtaaggtaggtacggtaacgtcgggtaagggaacgtaagttaacttacccgtacgttaccctaaccaacctactacccgatccgtccggtaccgtaggctaacccggtactggtaatttgttacgtttacctaacttactttacttaaccgcctaaccgtaatacgttaagnttaacggttacgttcggttaaccgccggttacggaacggtaacccggtaacgtaaggtaaacgtaaacgtaaccgtaaacggtaacggttggaccnccgtacaccgttacctacccgttagttacccttccgtccgttaacccg

SEQ ID NO: 129140 - DNA, 780 bp, Homo sapiens
  misc_feature: GYAE6OF01D2AY7.45.78.H01.1.454.CMB.1.raw
  modified_base (271)..(271): a, c, t, g, unknown or other
  misc_feature (271)..(271): n is a, c, g, or t
  modified_base (725)..(725): a, c, t, g, unknown or other
  misc_feature (725)..(725): n is a, c, g, or t
tcagacgcgatcgacacgaccggtgctcgatttagtgtgagtagtttgggtttgggggagtcagacccagtcaggacacagcaatggacagtggacgggtcccccgctcagctccgtgggcctcctggctgctcgtggcctaccgagtcgaccaaatgtacgactactaccgaaggtactaccgaaccctacgttaccttccccttccccgtaacccgttgtctcggtacctagttcgtaggtaggaacgtacgagacgttaccaacctanaccgttaacgtccggaccgacttagacaaggtaacttattaaaggtacgttcggtcgtccgttaagtactacgaagtaacgaaacggaacgaaacggtaaccgtaccccgtaaagtccgtactaccgtacgtaacgttaacgtaccgtaataacgtacgtttaagtaaacggtacggtcggaacctagtcgtaaagtcgacggacgtgaacgtaggtactcggtaaggtaacctaagtaacttccgaccgttaacctacggaacctacgtaaccggtacgtaccgttaccgaccgtacggtaccgtaccgtaccggtaattacggtttaaacgtttaaccgttacggttaaacccttaaaccggtttactaaccgggactaaccgtaagttacgtagttaacgtacgttagttaccgtacgacgttacgaacgacgtaaagacggtacgtaaanacggtaaaccttgccgtagcgtaccataacttgaccttacgttccgtagtacccg

SEQ ID NO: 129141 - DNA, 743 bp, Homo sapiens
  misc_feature: GYAE6OF01CGTL7.45.78.H01.1.454.CMB.1.raw
tcagacgcgatcgacacgaccggtgctcgatttagtgtgagtagtttggggtttgggggagcatcacccagcaaccacatctgtcctctagagaactcccctgagagctccgttcctcaccatggactggacctggaggactcctcttcgttgggtggcagcacgccagacggacgcctacgtccgaggtcgcgagcgttggtgcgtagtcggtgggcgtaggtagggtagaaaggacgccggtcgggcctacgtaggtaggacggttccctccggtacggacgtaacggtctttacgtcggtaacttaccgtaccgtttaccgaccggttacttaaccttacgtacgtacgtacggtcgggtcggacggtaccgcggtcccgacggtaacggacgggtgttcggagggtggaggtgggagtacgactaccgtaaaccgtaagtaacgtcggtacgaacctaaacgtaacttaggacgaacgtacggaaagggtttacggtacggacgggtacggtacggaccaacgtacgacgaacgacggtactaccgacacgactacgactacacgactagacggtcgaagtcgagaccgtacggacgtcgaacgtagacgtacgtaccggtaaccgaccggttaccggtccgtttaagttacccgtaggggttaccgaagggacggtaaccgggtacggtaaacggttacgggtttaggtttaacggttcggtttaagggttacccggg

SEQ ID NO: 129142 - DNA, 713 bp, Homo sapiens
  misc_feature: GYAE6OF01DXN8E.45.78.H01.1.454.CMB.1.raw
  modified_base (296)..(296): a, c, t, g, unknown or other
  misc_feature (296)..(296): n is a, c, g, or t
tcagacgcgatcgacacgaccggtgctcgatttagtgtgagtagtttggggtttgggggagtcagacccagtcaggacacagcatggacatgagggtccccgctcagctccgtggggctcctgctgctctggcctcccagggtgaccaaatggtgacatccagatcgacccagttccttcccttcccaccctgtcctgcattcgtaggtaggagacgagacgtaccaccactcctaccgttcggcccgggccagtacgagtagttaagttagtaacgttgggttcggcgtggtacncagacgaacgaaacgacgggaaacctcccgtacgcctcgtgctagtagaacggtctattagttaaggttaaggaacgggttcgggtacctagtacgtaacggtcgacggcggactaggtggacgttcggagggaactagtaacttcaccttccacaccatcgacgcaccgtccgtagtcccgtagtctacgtagttacgttatttacgtaacttaactttagttaccacgtaactaagtacttagtagttaacgttttaggttaccgttaaccgggtaccggtttaccgggaaccggaaacggggttaaaccgtaaaggggtaacgtaaaacgtaaccggtaaaacggtacggttccggtacggtaccgtacgaaccccttagttaccgtttccgttaccttcgttcccttacccgg

SEQ ID NO: 129143 - DNA, 787 bp, Homo sapiens
  misc_feature: GYAE6OF01C7J2X.45.78.H01.1.454.CMB.1.raw
  modified_base (315)..(315): a, c, t, g, unknown or other
  misc_feature (315)..(315): n is a, c, g, or t
tcagacgcgatcgacacgaccggtgctcgatttagtgtgagtagtttgggttgggggagtcagacccagtcaggacacagcatggacatgacgggtccccgctcagctccgtggggctcctgctgctcgtggcctcccgaggtgtaccaaagttgtcgactactaccgaagtatacgaccctactccttccctaccctacccgtgtctcgtctacttcgtaggtaaggagaacgaggtactaccacctactctacgttacggaccggcacgtacgagtaagtacgttagtacggttcggttcgcgtagtacgtanacgacgaaacggaaacgaacggaaccgtacccgaacgtccgtaccgtgacctagtacgtaacggtcttaagtacgtttaacggttaacggtaacggtaccggtaccgtaagtacgtaacggttcgagtcgtaccgtagtagggtacgtacgtaggtcggaaacttacggtaactaccgtacgtacctaccgtactaacgccaaccgactaccgacgtacggcgttaccggacttaagtacggtttaactttacggtttaacgtaaccctttaagtttaccctagtaacccgaagtttaactaaggttttacaaaggtttaaccgtttacggttaaaccgtttaccggtaacgggaccgtaaacggggtaacgttaaaccggaaacgggttagtaaaaacccgtacggtaaaacggtacggttggttacccgtacgaaccgtacccgtatttcgacctttggttcctaacccg

SEQ ID NO: 129144 - DNA, 920 bp, Homo sapiens
  misc_feature: GYAE6OF01C2VOX.45.78.H01.1.454.CMB.1.raw
  modified_base (195)..(195): a, c, t, g, unknown or other
  misc_feature (195)..(195): n is a, c, g, or t
  modified_base (203)..(203): a, c, t, g, unknown or other
  misc_feature (203)..(203): n is a, c, g, or t
  modified_base (216)..(216): a, c, t, g, unknown or other
  misc_feature (216)..(216): n is a, c, g, or t
  modified_base (282)..(282): a, c, t, g, unknown or other
  misc_feature (282)..(282): n is a, c, g, or t
  modified_base (292)..(292): a, c, t, g, unknown or other
  misc_feature (292)..(292): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctaggacaagggtcttggagtggagtgggatggataccaaaccctaanaagtgggngacaactaaactntgacaacgagtaagtttcgaagggcgtagggtcaccatcgaccgagggacacgtcatcgagaccanacgacctaanagtaggacgcgttaggacgcgtacggactaggaagtactacgtccggaacggtacgtaaccgggtcggttaagttacttaccggtggtacgaccgggaaggtacggaacgtaaggttaactttaaggtttcggtttttaaggggaaggttttacggtttaaacggttaccggggtaaacgggtttaggaccggggtttaaccgggtcggggttaaaccggggaccggtaaaacgggtcccgtaacgggttacccgtaacccgttcccgttaacccgtccggtaacgtacccccggttaaaccccggtaaccgggtaaacccgggtaccccgttaacccggtttccccgggttacccccgtttacccccggtacccgggtacccccttaccccttacccgttaacccgaacggtacccgtacccgttaaccggggttcggggtaacccgggacctaccgggtacccgggtacccggttacccggtccgggtaacccggttcccggtacccgggttaaacggaacccggggtaaaccgttcctttaaaccccggtttcccgaacggtttaccggaccgggttcccggttaacgggcggggttaacccgggccgggttacggtaaccgggg

SEQ ID NO: 129145 - DNA, 873 bp, Homo sapiens
  misc_feature: GYAE6OF01DQG7J.45.78.H01.1.454.CMB.1.raw
tcagacgcgatcgacacgaccggtgctcgatttagtgtgagtagtttgggtttgggggagcatcacccagcaaccacgatctgtcctctagagaactcccctgagagctccgttcctcaccatggactggacctggaggatcctcttcttggtggcagcagccacgaggagccccaacgtcccagggtgcagcctgggtgcagtccgtggggctggaggtagaaggaacgccgtcgggggccttcgaggtgtaaaggtcctcgtgcgtaaggtcttacgcggtaatacccgaacccgtttaccggacccgggtaccgtaaccttacgttccctaccgtacggttggggtacgtacccgaaccgacggggccccccttaggggaacctaaggggtcctttagggaggtagggtacgtggggatacgggactacctaacccgaacgtaagtcggggtacgacgaaacctaaacgttactacgaacctagtaacggtaacggtttacggaacggggtacggtaacgggttaccgaaccgtaacgtacggaaccggaacggggaacccttacccgtacgtaaacgtccgaacggaccaacccggtaaccgaacccttaacggaacgttacgggaaccgttacggtacgggtaacgtaccgtaaaggttacccgtaccggaaaccttagttaccggaaacgggtaaccccggtaacccgtaaacccggttacccggtttaaagtttttaaacccggtttaacggttaccggttacgggttaaaccgggtacggggttaacggttttacccggggttttaaacccgggttcgggtttaaccggttttaccccgggtttttccggttttaaacccggggg

SEQ ID NO: 129146 - DNA, 892 bp, Homo sapiens
  misc_feature: GYAE6OF01DBQAX.45.78.H01.1.454.CMB.1.raw
  modified_base (887)..(887): a, c, t, g, unknown or other
  misc_feature (887)..(887): n is a, c, g, or t
tcagacgcgatcgacacgaccggtgctcgatttagtgtgagtagtttgggtttggggtgaaagaagcctggggcctcagtggaaggtctcctgcaaggcttctggatacaccttcaccggctactatatacacgtgggtgcgacacggccccgtggacaaggggtcttggagtggagtaggggaagagtcatcgaccaagtacgttgaataccaggccacgacctacgcctacgaagtaaacttcccgaacgggaacccagtaccaacctagtttaacgttcggacgaacctaccaactacccgaaccgaccaacaccgtaccctaacgagtcggaacgttcgaaggaaggaacgtccgtaggaaggttacgtttacggaaaccgacgtacccggtaccttttaagttttttactttccggtaggtacgggtacgggtaacggtacgggttccggtccccgggttaacggggccggttaccgttttaccgttaaccgtacgggtttaacccgggcggggtaacccggaaccgggaaccccgtcggtccccgtacccgttcgtccccttacgacccggtacccttacccgaaccggacccgggccccttacgttccccggttaccccgtttccccccgtccgggttaccccaacccccgtttacccgacccgtaaccggtacccggaccccttaccggtaccggggtaacccggggcccgaaccgggtacccggggtcccgggtccccggttccggggtacccgtacgggtccccttacggggtaaccgtaccgggttaaccctttaccccgttcccgtaacggttcccgaccggtcgggtagtaccggtacgggccgggtacgtacgggaccgacggtaggcttagngtacg

SEQ ID NO: 129147 - DNA, 768 bp, Homo sapiens
  misc_feature: GYAE6OF01AFCGE.45.78.H01.1.454.CMB.1.raw
  modified_base (289)..(289): a, c, t, g, unknown or other
  misc_feature (289)..(289): n is a, c, g, or t
  modified_base (504)..(504): a, c, t, g, unknown or other
  misc_feature (504)..(504): n is a, c, g, or t
tcagacgcgatcgacacgaccggtgctcgatttagtgtgagtagtttgggtttggggtgaagaagcctggggcctcagtgaaggtctcctgcaagcttctggatacaccttcaccggctactatatacactgggtgcgacaggccccctggacgaagggcttgagtggatgggatggatcaaccctaacaatggtggcaacaaactatgcacagaagtttcaggcagggtcaccatgaccagggacacgtccatcagcacagcctacagtggagctgagcgaggctganactcgtacgacgacgaccggtccgttgttaacttacgtggtcgcggaggacggacgtaaggtaaactttaacggtttaagtttttggggtaaggtttagggtttacggtttacggggtaacgggtttaggttaggggtaccgggtttaccgggtacggggggtacccgaaacgggggtaccccgtaacgggtcccgtacccgtccctcccgtacnccggtccctacccaaccggaccgggccctacggtccccgttacccctttcccccgacggtccccctaccccgttccgtaacccgaacggtaccctaccccgtacccggttccgggtacggggggcccacgggaccggtccccgggtacccggtcgggccgttccggcccggttaccgggtaccgtaaacgggttacccttacccgttcccgtaccggtcgtttccggtcccgttagtaccgggccgggtcggggcgtaccgggg

SEQ ID NO: 129148 - DNA, 536 bp, Homo sapiens
  misc_feature: GYAE6OF02I7UL6.45.78.H01.1.454.CMB.1.raw
  modified_base (513)..(513): a, c, t, g, unknown or other
  misc_feature (513)..(513): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgagcgtgagatctgacgacacggccgtgtattactgtgcgagaggcaggattacgatttttggagtggttattcggacggtatggacgtcgtggggccaagggaccacggtcaccgtctcctcagcctccaccaacgggcccactcggtccttccccgtcggccaccctcctccaacgacgccacctctcgggggcacgagcggccctgggctgcctggtcaaggactacttccncgatcgcgtctgagcgggctcgg

SEQ ID NO: 129149 - DNA, 167 bp, Homo sapiens
  misc_feature: GYAE6OF02JCWCL.45.78.H01.1.454.CMB.1.raw
  modified_base (167)..(167): a, c, t, g, unknown or other
  misc_feature (167)..(167): n is a, c, g, or t
tcagacgcgatcgacacgaccggtgctcgatttagtgtgagtagtttggttgggaagaggaagactgacggtccccaggagttcaggtgctgggcacagcggccctgggctgcctggtcaggactacttcctcgatcgcgtctgagcgggctggcaaggcgcatagn

SEQ ID NO: 129150 - DNA, 524 bp, Homo sapiens
  misc_feature: GYAE6OF02I7GBN.45.78.H01.1.454.CMB.1.raw
tcagacgcgatcgacacgaccggtgctcgatttagtgtgagtagtttgggtttgggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgatttttggagtggttattcggacggtatggacgtctggggcctaagggaccacggtcaccgtctcctcagcctccaccaagggcccatcggtcttcccctggcaccctcctccagcgcacctctggggcacagcggccctgggctgcctggtcaaggactacgttcctcgatcgcgtctgacgcgggctcgg

SEQ ID NO: 129151 - DNA, 175 bp, Homo sapiens
  misc_feature: GYAE6OF02HX67D.45.78.H01.1.454.CMB.1.raw
  modified_base (174)..(175): a, c, t, g, unknown or other
  misc_feature (174)..(175): n is a, c, g, or t
tcagacgcgatcgacacgaccggtgctcgatttagtgtgagtagtttgggtttgggggaagaggaagactgacggtccccccaggagttcaggtgctgggcacagcggccctgggctgcctggtcaaggactacttcctcgatcgcgtctgagcgggctggcaaggcgcatagnn

SEQ ID NO: 129152 - DNA, 543 bp, Homo sapiens
  misc_feature: GYAE6OF02I3H8H.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgatttttggagtggttattcggacgtatggacgtctggggccaagggaccacggtcaccgtctcctcacgcctccaccaagggcccatccggtccttccccctggccaccctcctccaacgacgccaccctcgtcgggggccacgacgccggccctgggcctcgcctggtccgaaggcctacgttcctcgatcgcgtctgacgcggctcgg

SEQ ID NO: 129153 - DNA, 503 bp, Homo sapiens
  misc_feature: GYAE6OF02HUU08.45.78.H01.1.454.CMB.1.raw
tcagacgcgatcgacacgaccggtgctcgatttagtgtgagtagtttgggtttggggacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcacatgaccagggacacgtccatcagcacagcctacatggagccgagcaggctgagatctgacgacacggcgtgtattactgtgcgagaggcaggaattacgattttggagttggttattcggtaggtagg

SEQ ID NO: 129154 - DNA, 546 bp, Homo sapiens
  misc_feature: GYAE6OF02GDG1J.45.78.H01.1.454.CMB.1.raw
tcagacgcgatcgacacgaccggtgctcgatttagtgtgagtagtttgggtttggggctgaggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgagcgtgagatctgacgacacggccgtgtattactgtgcgagaggcaggaattacgattttggagtggttattcggacggtatggacgtcgtggggccaaggggaccacggtcaccgtctcctcagcctccaccaacgggcccatccggtcttcccccgtggccaccctcctcccaagacgccacccgtcgtcgggggccacgacgccggccctgggctcggccctggtccaaggcctacttcctcgatccgcgtctgacgg

SEQ ID NO: 129155 - DNA, 537 bp, Homo sapiens
  misc_feature: GYAE6OF02F0QFC.45.78.H01.1.454.CMB.1.raw
tcagacgcgatcgacacgaccggtgctcgattagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgatttttggagtggttattggacggtatggacgtctggggccaagggaccacgggtcaccgtctcctcacgcctccaccaagggcccatccggtcttccccctggccacccgtcctccaagacgccacctcgtgggggcacgacgcggccctgggcctgcctggtcaaggactacgttcctcgatcgcgtctggacgcgggctcgg

SEQ ID NO: 129156 - DNA, 173 bp, Homo sapiens
  misc_feature: GYAE6OF02GNGN4.45.78.H01.1.454.CMB.1.raw
  modified_base (172)..(173): a, c, t, g, unknown or other
  misc_feature (172)..(173): n is a, c, g, or t
tcagacgcgatcgacacgaccggtgctcgatttagtgtgagtagtttgggtttggggaagaggaagactgacggtcccccaggagttcaggtgctgggcacagcggccctgggctgcctggtcaaggactacttcctcgatcgcgtctgagcgggctggcaaggcgcatagnn

SEQ ID NO: 129157 - DNA, 497 bp, Homo sapiens
  misc_feature: GYAE6OF02IN9Y9.45.78.H01.1.454.CMB.1.raw
  modified_base (347)..(347): a, c, t, g, unknown or other
  misc_feature (347)..(347): n is a, c, g, or t
tcagacgcgatcgacacgaccggtgctcgatttagtgtgagtagtttgggtttggggagagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggcttgagtggatgggatggatcaacctacaatggtgcanaaactatgcacagaagtttcagggcagggtcaccatgaccagggacacgtccatcagcacagcctacatggagctgagcaggctgagatctgacgacacggccgtgtaattactggtgcggagaggcagggaatttacggattttacggg

SEQ ID NO: 129158 - DNA, 544 bp, Homo sapiens
  misc_feature: GYAE6OF02GQDFQ.45.78.H01.1.454.CMB.1.raw
  modified_base (539)..(539): a, c, t, g, unknown or other
  misc_feature (539)..(539): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggattacgatttttggagtggttattcgggacggtatggacgtctggggccaagggaccacggtcaccgtctcctcagcctccaccaagggcccagtccggtcttccccctcggccaccctcctccaacgacgccaccctccgtgggggccacgacgccggccctgggcctgcctggtcaaggacctacttccctcgatcgcgtctggagcgggntcggg

SEQ ID NO: 129159 - DNA, 500 bp, Homo sapiens
  misc_feature: GYAE6OF02IR20V.45.78.H01.1.454.CMB.1.raw
  modified_base (340)..(340): a, c, t, g, unknown or other
  misc_feature (340)..(340): n is a, c, g, or t
  modified_base (421)..(421): a, c, t, g, unknown or other
  misc_feature (421)..(421): n is a, c, g, or t
  modified_base (438)..(438): a, c, t, g, unknown or other
  misc_feature (438)..(438): n is a, c, g, or t
tcagacgcgatcgacacgaccggtgctcgatttagtgtgagtagtttgggtttgggggagagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggcttgagtggatgggatggatcaaccctaanaatggtggcacaaactatgcacagaagtttcagggcagggtcacatgaccaggacacgtcatcagcacagcctacatgganctagagcaggctgaganctagacgacacggccgtagtattacgtgtgcgaggaggcgaaggaattacgtagttttaggg

SEQ ID NO: 129160 - DNA, 618 bp, Homo sapiens
  misc_feature: GYAE6OF02IKP77.45.78.H01.1.454.CMB.1.raw
  modified_base (344)..(344): a, c, t, g, unknown or other
  misc_feature (344)..(344): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccggccagtcagagtatagtaactggttggcctggtatcagcagaaaccagggaaagccctaagctcctgctctataaggcatctagtttagaaagtggggtcccatcaaggttcagcggcagtgggntggtagagaagtatactactcaccactacacacgacgacctcgtcgacgaccgtcgtagtacgtagtttagtttcgaacctttaactttaactttacgtaccgtaaccctaaactagttaacgtaagttaacgtttaagtttaacgttacggttaccgggttaccggaacgggtaaaccggtaaccggtaagggtaacgtaacgtaaaccggaaaacgttaacggtaggtacgtacgtcgaacctacgtaccttacgtctttcctacttacccg

SEQ ID NO: 129161 - DNA, 572 bp, Homo sapiens
  misc_feature: GYAE6OF02JVEIF.45.78.H01.1.454.CMB.1.raw
  modified_base (365)..(365): a, c, t, g, unknown or other
  misc_feature (365)..(365): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgattttggagtggttatcggacgtatggacgtntggggccaaggggaccacggtcaccgtctcctcacgcctccgaccaagggcccatcggtcttcccctggccaccctcctccaagacgccgacctccgtcgggggcaccgacgccggcccgtgggcctcggcccgtcggtccgaacgggtaccttaccgttcccgtcgtacgtccggtacgtccgttcggacggtccgggcttacggg

SEQ ID NO: 129162 - DNA, 544 bp, Homo sapiens
  misc_feature: GYAE6OF02ITMZ7.45.78.H01.1.454.CMB.1.raw
  modified_base (521)..(521): a, c, t, g, unknown or other
  misc_feature (521)..(521): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgatttttggagtggttattcggacggtatggacgtcgtggggccaaggggaccacggtcaccgtctcctcagcctccaccaacgggcccagtccggtccttccccgtggccaccctcctccaacgcgcaccgtcgtggggccacgacgcggccctgggctcgcctggtccaacggtctacgttcctcgntccgcgtcgtgacgcgggctcgg

SEQ ID NO: 129163 - DNA, 511 bp, Homo sapiens
  misc_feature: GYAE6OF02GOIHH.45.78.H01.1.454.CMB.1.raw
  modified_base (485)..(485): a, c, t, g, unknown or other
  misc_feature (485)..(485): n is a, c, g, or t
  modified_base (503)..(503): a, c, t, g, unknown or other
  misc_feature (503)..(503): n is a, c, g, or t
  modified_base (508)..(508): a, c, t, g, unknown or other
  misc_feature (508)..(508): n is a, c, g, or t
tcagacgcgatcgacacgaccggtgctcgatttagtgtgagtagtttgggtttgggggagtcagacccagtcaggacacagcatggacatgagggtccccgctcagctccgtggggctcctgctgctctggctcccaggtgccaaatgtgacatccagatgacccagtctccttccaccctgtctgcatctgtaggagacagagtcaccatcacttgccgggccagtcagagtattagtaactggttggcctggtatcagcaagaaaccagggaaagcccctaagctcctgctctataaggcatctagtttagaagtgggtccatcaagttcagcggcagtggatcgtgggacagaattcactctcaccatcagcagcctgcagcctgatgtattttgactaactttattactgacctaacagttatagattagttattcgtacgttcgaccgaagggtacgaagtagaatacgaaacgactagnggtctgaccactatcgtnttctntac

SEQ ID NO: 129164 - DNA, 501 bp, Homo sapiens
  misc_feature: GYAE6OF02HQP6Y.45.78.H01.1.454.CMB.1.raw
  modified_base (498)..(498): a, c, t, g, unknown or other
  misc_feature (498)..(498): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtaactggttggcctggtatcagcagaaaccagggaaagcccctaaagctacctgctctataaggcatctagtttagaaagtggggtccatcaaggttcagcggcagtgatctggacagaatcactctcacatcagcagcctgcagcctgatgatttgctaacttattactgaccaacagtatagatagttattacgacgttcggaccaagggaccaaggtgaaattacgaaacgaactggtagcgtagcacatctgtcttntac

SEQ ID NO: 129165 - DNA, 591 bp, Homo sapiens
  misc_feature: GYAE6OF02IX8A2.45.78.H01.1.454.CMB.1.raw
  modified_base (322)..(322): a, c, t, g, unknown or other
  misc_feature (322)..(322): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacaacgtccatcagcacagcctacatggagctgagcgaggctgagatctgacgacacggccgtgtactactgtgcgagnggcaggaattacgatttggagtggtatcggacgtagtggtacgtgtggggccaagggaccgacggtcaccgtctcgtcacgcctaccaccgaacgggcccagtccggtcctccccgtcggacctaccctccgtccaagtacgccaccgtcgtcggggccacgacgccggacccgtgggcctcggtcccgtgggtaccgaacgggtaccttaccgttcccgtaccggacgtcccgtccggttccgtacggaccggtccggggtctcgggg

SEQ ID NO: 129166 - DNA, 521 bp, Homo sapiens
  misc_feature: GYAE6OF02F5J05.45.78.H01.1.454.CMB.1.raw
  modified_base (518)..(518): a, c, t, g, unknown or other
  misc_feature (518)..(518): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtaactggttggcctggtatcagcagaaaccagggaaagcccctaagctcctgctctataaggcatctagtttagaagtggggtcccatcaaggttcagcggcagtggatcgtgggacagaattcactctcaccatcagcagcctgcagcctgatgtatttgactaactttattacctgacctaactagtatagtattagttattcgtacgtttcggaccgtaagggaccgaagggtggaaatacgaaaacgtaactggtaggctggcacatctcgttcttntac

SEQ ID NO: 129167 - DNA, 174 bp, Homo sapiens; identical to SEQ ID NO: 128744
  misc_feature: GYAE6OF02GOOGI.45.78.H01.1.454.CMB.1.raw
  modified_base (173)..(174): a, c, t, g, unknown or other
  misc_feature (173)..(174): n is a, c, g, or t

SEQ ID NO: 129168 - DNA, 505 bp, Homo sapiens
  misc_feature: GYAE6OF02IA5K9.45.78.H01.1.454.CMB.1.raw
  modified_base (501)..(501): a, c, t, g, unknown or other
  misc_feature (501)..(501): n is a, c, g, or t
tcagacgcgatcgacacgaccggtgctcgatttagtgtgagtagtttgggtttgggggagtcagacccagtcaggacacagcatggacatgagggtcccgctcagctcctggggctcctgctgctctggctcccaggtgccaaatgtgacatccagatgacccagtctccttccaccctgtctgcatctgtaggagacagagtcaccatcacttgccgggcagtcagagtattagtaactggttggcctggtatcagcagaaaccagggaaagccctaagctctgctctataagcatctagtttagaaagtgggccatcaaggttcagcgcagtggatcgtgggacagattcactctcacatcagcagcctgcagctgatgtatttgactaacttattactgacaactagtatagatagttattcgacgttcggacaagggacctaaggtagaaacttacgaaacgtaactggtacggtctgacaccattctgttaccttntacc

SEQ ID NO: 129169 - DNA, 175 bp, Homo sapiens; identical to SEQ ID NO: 129151
  misc_feature: GYAE6OF02G26VD.45.78.H01.1.454.CMB.1.raw
  modified_base (174)..(175): a, c, t, g, unknown or other
  misc_feature (174)..(175): n is a, c, g, or t

SEQ ID NO: 129170 - DNA, 501 bp, Homo sapiens
  misc_feature: GYAE6OF02H2XGZ.45.78.H01.1.454.CMB.1.raw
  modified_base (287)..(287): a, c, t, g, unknown or other
  misc_feature (287)..(287): n is a, c, g, or t
  modified_base (337)..(337): a, c, t, g, unknown or other
  misc_feature (337)..(337): n is a, c, g, or t
  modified_base (413)..(413): a, c, t, g, unknown or other
  misc_feature (413)..(413): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtncgacaggcccctggacaagggcttgagtggatgggatggatcaacctaanaatggtggcacaaactatgcacagaagttcagggcagggtcaccatgacagggacacgtccatcagcacagcctanatggagctagagcgaggctagagatcgtgacgacgacggcgtgtaacttactgtgcgagaggcaggtaagttacgtattttggtaagg

SEQ ID NO: 129171 - DNA, 511 bp, Homo sapiens
  misc_feature: GYAE6OF02ILC28.45.78.H01.1.454.CMB.1.raw
tcagacgcgatcgacacgaccggtgctcgatttagtgtgagtagtttgggtttgggggagagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgacacagaagtttcagggcagggtcaccatgacagggacacgtcatcagcacacgcctacatggagctgagcgaggtctagagagtcgtagacgacgacggccgtgtacttacgtgtgacgaggacggcgaggtaacttacggtagttttggg

SEQ ID NO: 129172 - DNA, 557 bp, Homo sapiens
  misc_feature: GYAE6OF02IXPZX.45.78.H01.1.454.CMB.1.raw
  modified_base (483)..(483): a, c, t, g, unknown or other
  misc_feature (483)..(483): n is a, c, g, or t
  modified_base (552)..(552): a, c, t, g, unknown or other
  misc_feature (552)..(552): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgatttttggagtggttattcggacggtatggacgtcgtggggccaagggaccacggtcaccgtctcctcacgcctccaccaagggccccatccggtccttccccctggcccaccctccctcccaacgcgccaccgtcgtcgggggcaccgngccggccctgggcctgccgtcggtcaacggtacctacgttcctcgacttcgcgttctggacggccgggntcggg

SEQ ID NO: 129173 - DNA, 549 bp, Homo sapiens
  misc_feature: GYAE6OF02ISTS0.45.78.H01.1.454.CMB.1.raw
  modified_base (330)..(330): a, c, t, g, unknown or other
  misc_feature (330)..(330): n is a, c, g, or t
  modified_base (340)..(340): a, c, t, g, unknown or other
  misc_feature (340)..(340): n is a, c, g, or t
tcagacgcgatcgacacgaccggtgctcgatttagtgtgagtagtttgggtttggggacccagcaaccacatctgtcctctagagaatcccctgagagctccgttcctcaccatggactggacctggaggatcctcttcttggtggcagcagccacaggagcccactcccaggtgcggctggtgcagtctggggctgaggtgaagaagcctggggcctcagtgaaggtctcctgcaaggcttctggatacaccttcaccggctactatatacactgggtgcgacaggcccctggacaagggcttgagtggatgggatggatcaacctaanaatggtgcanaaactatgcacagagtttcagggcagggtcacatgaccaggacacgtcactacacgcacacgacctacataggagcgtagagcgaggcgtagacccccgatacgtgacgacgacggccgttagtagttacgtgtggcggaaggacggacgaaggtaagttacggttacgttttagggtaggttaggtttagtttacgggtaggttacgg

SEQ ID NO: 129174 - DNA, 577 bp, Homo sapiens
  misc_feature: GYAE6OF02FUS2K.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtggtattactgtgcgagaggcaggattacgattttggagtggttattcggacggtatggacgtctggggccaagggaccacgggtcaccggtctccctcagcctccaccaacgggcccatccggtaccttcccccgtggccaccccgtcctccaacgacgccaaccctcgtcgggggcctaccgacgccggcccgtggggcctcggcccgtggtaccgaagggaccttaccgttccctcgactccggcgttccgtcgacggtccgggctacggg

SEQ ID NO: 129175 - DNA, 513 bp, Homo sapiens
  misc_feature: GYAE6OF02HRTMB.45.78.H01.1.454.CMB.1.raw
  modified_base (197)..(197): a, c, t, g, unknown or other
  misc_feature (197)..(197): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtagganacagagtcaccatcacttgccgggcagtcagagtattagtaactggttggcctggtatcagcagaaaccagggaaagcccctaagctcctgctctataaggcatctagtttagaagtgggtcccatcaagttcagcgcagtgatctggacagattcactctcacatcagcagcctgcagcctgatgatttgactaacttattactgaccaacagtactagtaatagttattcgtacgttcggacgaacgggtaccaaggtaggaaatacgaaaacgactggtacggactagctacattccgtagttcttactaacg

SEQ ID NO: 129176 - DNA, 753 bp, Homo sapiens
  misc_feature: GYAE6OF02FRNC2.45.78.H01.1.454.CMB.1.raw
tcagacgcgatcgacacgaccggtgctcgatttagtgtgagtagtttgggttgggtgaagaagctgggcctcagtgaaggtctcctgcaaggcttactggatacaccttcgaaccggtctactatatacactgggtcgcggacgaggtcccctggactaagggcttggagtggatgggatggaatcaaccctacgaatggtggcaacgaaacgtattcgactacgaaggtaacgtttcgagggctagggtcaccgatcgaccgagggacacgtccatcagccacagcctacgtgtcggagccgtggacgcgaggtctaggaggactcggtcgacgtaacgtacggccgttgtagttacgaggtcgacgtaggagggacaacggtaactttacgagtttttacgggagtttaggttaactttccgggaacggttacggtggaccggttacgtcgggggacccctaaaggggacccaaccgggggtcctacccggttccgtcccgttccgacgggtacccttacccgaaccgtaacgggtccccaacggttccgggttcccttcccccgtcggaccctaaccccgtcctacccgaacggacggtacccgtacccgttccgggtacggggaccgtaccgtaccggacccggtcccgttacggggcccgtacgtccccgtaccgggtaccgtaacccggaacgttacccgtccgttaccgacggtccgccggttacgcggacggtacgggcgtcggg

SEQ ID NO: 129177 - DNA, 512 bp, Homo sapiens
  misc_feature: GYAE6OF02F8DP2.45.78.H01.1.454.CMB.1.raw
  modified_base (442)..(442): a, c, t, g, unknown or other
  misc_feature (442)..(442): n is a, c, g, or t
  modified_base (448)..(448): a, c, t, g, unknown or other
  misc_feature (448)..(448): n is a, c, g, or t
tcagacgcgatcgacacgaccggtgctcgatttagtgtgagtagtttgggtttgggggagagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagcctggggcctcagtgaaggtctcctgcaaggcttctggatacaccttcaccggctactatatacactgggtgcgacaggcccctggacaagggcttgagtggatgggatggatcaaccctaacaatggtggcacaaaactatgcacagaagtttcagggcagggtcacatgacaggacacgtcatcagcacagcctacatggagccgtagagcgaggctgagatcngacganaccggcgtgtattacgtgtcgacgacggaggaccgaagggtaacttacggtagtttttacgggg

SEQ ID NO: 129178 - DNA, 624 bp, Homo sapiens
  misc_feature: GYAE6OF02IU13T.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgaggatctgacgacacggccgtgtatactgtgcgagagcaggaattacgattttggagtggttattcggacggtagtggacgtcgtggggccaaggggccaacgggtccaaccggtcctaccgtcgacggcctcccgaccgaacgggtccccatccggtccttacccccgtggccctacccctccgtacccaacggtacgcctacccgtcgtacgggggcctaccgacggccggcccgtcggggaccttccggaccgtcgggtaccgaacgggtaccttaacccgttcctaccggtacgttcccggccggttacctcgggacggtccgggtccttacgggg

SEQ ID NO: 129179 - DNA, 503 bp, Homo sapiens
  misc_feature: GYAE6OF02G4TWB.45.78.H01.1.454.CMB.1.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcaacaaactatagcacagaagtttcgagggcagggtcaccatgaccagggacacgtcatcagcacagcctacatggagctggagcgaggctagagactctagacgacacggccgtgtattactgtgcgagaggcaggattacgtagttttggtacgg

SEQ ID NO: 129180 - DNA, 621 bp, Homo sapiens
  misc_feature: GYAE6OF02HNCWS.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgattttggagtggttattcggacggtatggacgtcgtggggccaagggaccacggtcaccgtctcctcagcctccaccaacgggcccatccggtcttccccctggccaccctcctccaacgacgccaccctccgtcgggggccacgacgccgggcccctggggccgtggcccgtttggggtacccgtaaacggggtacccttaaaccgttttccccgttacccggtaacgttcccgggtcccggttacccgttcgggtaaccgggtaccggggggcccgttaccggggg

SEQ ID NO: 129181 - DNA, 514 bp, Homo sapiens
  misc_feature: GYAE6OF02HI56R.45.78.H01.1.454.CMB.1.raw
  modified_base (400)..(400): a, c, t, g, unknown or other
  misc_feature (400)..(400): n is a, c, g, or t
  modified_base (431)..(431): a, c, t, g, unknown or other
  misc_feature (431)..(431): n is a, c, g, or t
  modified_base (441)..(441): a, c, t, g, unknown or other
  misc_feature (441)..(441): n is a, c, g, or t
  modified_base (449)..(449): a, c, t, g, unknown or other
  misc_feature (449)..(449): n is a, c, g, or t
  modified_base (494)..(494): a, c, t, g, unknown or other
  misc_feature (494)..(494): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgattttggagtggttattcggacggtatggacgtctggggccaagggaccacggtcaccgtctcctcngcctccaccaggcccatcgcttcccctgccncctcctcagncacctcgngggcacacgcggcctgggctgcctggtcaaggactacttcctcgntcgcgtctgcgcgggctcgg

SEQ ID NO: 129182 - DNA, 674 bp, Homo sapiens
  misc_feature: GYAE6OF02FFXOE.45.78.H01.1.454.CMB.1.raw
  modified_base (151)..(151): a, c, t, g, unknown or other
  misc_feature (151)..(151): n is a, c, g, or t
  modified_base (257)..(257): a, c, t, g, unknown or other
  misc_feature (257)..(257): n is a, c, g, or t
  modified_base (629)..(629): a, c, t, g, unknown or other
  misc_feature (629)..(629): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggnggcagcagccacaggacgcccactcccaggtgcagctggtgcagtcgtggggctggaggtgaagagccgtggggcctcgagtgacggtctcctgcaaggctttcgnggactacacccttcaccggtctactatactacgacgtggtcgacgacgacggcccctaggaacctaagggtctttaggacggtggagtagggactcggaactaccgaaaccgtaagaagtcgggagaccaactaaactagtacgacctaacgtaacggttaacgttacggacgggtaccgtaacggggtaccaacgtagtaccggaaccggacggtaccgtaccgtactaacgacgacggacccaacgaccgtaaccctacgtacgtacgggaccgtcggtacgacgggtaccgaacggttcgaaggaccggtacctacgtaacggaccgtacgtaccgtacgttacgtaacgttacggacggtcggaacgnggtaacgtacgtaacggttacgtttacggttagtttagggtacgg

SEQ ID NO: 129183 - DNA, 532 bp, Homo sapiens
  misc_feature: GYAE6OF02F4XUX.45.78.H01.1.454.CMB.1.raw
  modified_base (528)..(528): a, c, t, g, unknown or other
  misc_feature (528)..(528): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgatttttggagtggttattcggacggtatggacgtctggggccaagggaccacggtcaccgtctcctcagcctccaccaacgggcccatccggtcttccccctggccaccctcctccaacgcgccacctctcgggggcacgacgcggccctgggctgcctggtcaaggctacgtcctcgactcgcgtctgagcggntcgg

SEQ ID NO: 129184 - DNA, 696 bp, Homo sapiens
  misc_feature: GYAE6OF02J0RK1.45.78.H01.1.454.CMB.1.raw
  modified_base (286)..(286): a, c, t, g, unknown or other
  misc_feature (286)..(286): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcagctgagntctgacgacacggccgtgtattacgtgtgcgagaggcaggaattacgtattttggagttggttattcggacggtagtggacgtcgtacggggtaccgaacggggaccgtacgggtcaacccggttccgtacccgtcgaccgtccctcccgtaaccgaacggggtccccagtacccgggttcctttccccccgtggtccctacccctcccgtaccctaacgacggtacccaacccgttccggtccggggggtaccaccggacgggcccggtaacccggtcggggtaccgttaccggtcccggttcgggtacccggtaaacgggtacccgtttaacccgttccccgttaccggtacgttcccgggtaccgttcccggtacggtaccgggtaccggggtccgttacccggggg

SEQ ID NO: 129185 - DNA, 663 bp, Homo sapiens
  misc_feature: GYAE6OF02H7RE6.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggcgactatctccactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcagactgacatctgacgacacggcctatttatactgtgcgagatggttacggtgtcttgtttccgttttgacgtacgtggggccacgggaaccctggtcacctatcctcctcacgccctacccacccgaacgggcccctaacgttcccggttccctttccccccgtcgggtcccctacccccgttccctacccgaaacggtacgcccgtaacccgtccggtacggggggcctaaccgaccgggcccggtaccccggtggggtccttccgggtcccgtcgggttaaccgtaacgggtacccttacccgttcccgttaccggacgttcccggccgttaccgtcggacggtccggggtcgtcgggaccgaacgggtcccgacgtaacgg

SEQ ID NO: 129186 - DNA, 588 bp, Homo sapiens
  misc_feature: GYAE6OF02GVPGG.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgagctgagatctgacgacacggccgtgtattactgtgcgagaggcaggaatacgattttggagtggttatcggacgtagtggacgtcgtgggccaagggaccacggtcaccgtctcctcagcctcaccgaagggcccagtccggtccttcccccgtcggcctacccctcctaccaacgacgccaacccgtcgtcgggggcctaccgacgtccgggccctaggggcctcggcccgtggtaccgaacgggtaccttaccgttccctaccgacttccggtccgtccgttcggacggtaccgggtcgtaccggg

SEQ ID NO: 129187 - DNA, 527 bp, Homo sapiens
  misc_feature: GYAE6OF02IVM68.45.78.H01.1.454.CMB.1.raw
  modified_base (523)..(523): a, c, t, g, unknown or other
  misc_feature (523)..(523): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgatttttggagtggttattcggacggtatggacgtctggggccaaggggaccacggtcaccgtctcctcagcctccacaacgggcccatcggtcttcccctggccaccctcctccagacgcacctctgggggcacacgcggccctgggctgcctggtcaaggactacttcctcgatcgcgtctgagcgggntcgg

SEQ ID NO: 129188 - DNA, 547 bp, Homo sapiens
  misc_feature: GYAE6OF02IX9QC.45.78.H01.1.454.CMB.1.raw
  modified_base (338)..(338): a, c, t, g, unknown or other
  misc_feature (338)..(338): n is a, c, g, or t
tcagacgcgatcgacacgaccggtgctcgatttagtgtgagtagtttgggtttggggagagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagagccgtgggcctcagtgaggtctcctgcaggcttctggatacaccttcaccggctactatatacactgggtgcgacgaggcccctggacaagggcttgagtggatgggatggatcaaccctaanaagtggtgcaacaaactatgcacagtaagtttcgaggcgagggtcacagtcgacagggacacggtacatcagccacacgcctacgactggagcgtagacgcgaggcgtacggaagattccgtagaccgtacgacgggtccgttaaggttacttacgtagtcggacggaagggacggacgtaagggtaatttacggtagtttttacgggg

SEQ ID NO: 129189 - DNA, 556 bp, Homo sapiens
  misc_feature: GYAE6OF02JNMYO.45.78.H01.1.454.CMB.1.raw
  modified_base (229)..(229): a, c, t, g, unknown or other
  misc_feature (229)..(229): n is a, c, g, or t
  modified_base (333)..(333): a, c, t, g, unknown or other
  misc_feature (333)..(333): n is a, c, g, or t
  modified_base (340)..(340): a, c, t, g, unknown or other
  misc_feature (340)..(340): n is a, c, g, or t
  modified_base (364)..(364): a, c, t, g, unknown or other
  misc_feature (364)..(364): n is a, c, g, or t
tcagacgcgatcgacacgaccggtgctcgatttagtgtgagtagtttgggtttgggggtaggtcagacccagtcaggacacagcatggacatgagggtcccgctcagctcctgggctcctgctgctctggctcccaggtgccaaatgtgacatccagatgacccagtctccttccaccctgtctgcatctgtaggagacagagtcaccatcacttgccgggcagtcagngtaattagtaactggttggcctggtatcagcagaaccaggaaagccctaagctcctgctctataaggctatctagtttagaaagtcgggtaccatacaaggttnagtcganagtgatctgggacagattcactcncaccatcagacacgctcgcagtcctagtatagtatttcgacttaacttactttactacgtaccaactagtattacgtattacgttattacgtacgtttcggaaccgtaacggtaacgaacgggttagtaacgtacgtaaacgaacgttaggtacggtacgtcgtacaccgtattacgtacgtcttactaccg

SEQ ID NO: 129190 - DNA, 669 bp, Homo sapiens
  misc_feature: GYAE6OF02I1H2Y.45.78.H01.1.454.CMB.1.raw
tcagacgcgatcgacacgaccggtgctcgatttagtgtgagtagtttgggttggggtggaagagcctaggggcctcagtgaaggtctcctgcaaggcttctggatacaccttcaccggctactatatacactgggtgcgacaggcccctggacaagggcttgagtggatgggatggatcaaccctaacaatggtggcacaaaactatgcacagaagtttcagggcagggtcaccatgaccagggacacgtccatcagcacagcctacatggagctgagcaggctgagatctgacgacgacggccgtgtattactgtgcgagaggcgaggaacttagtatttttaggagttggttagttcggtaacggtagtggtaacgtcgtggggacccgaaggggaccgaacggtccaaccggttccttcccgtacacgcccgttaccccaaccgaacgggcccctacgtccggtaccctttcccccgtcggaccctacccccttccctacccgaaccgacgaccctacctaccggtcgggggaccaaccgacggcccggtaccccggtgggtccgtacggtacccgttgggtacccgaaacggtaacccttaccgttacccgttccgtacgttaccgtccggttccgtcgggtaaccggtccggggtctaccgggg

SEQ ID NO: 129191 - DNA, 543 bp, Homo sapiens
  misc_feature: GYAE6OF02HRRUP.45.78.H01.1.454.CMB.1.raw
tcagacgcgatcgacacgaccggtgctcgattagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgattttggagtggttattcggacggtatggacgtctggggccaagggaccacggtcaccgtctcctcagcctccaccaacgggcccatccggtcttcccccgtggccaccctcctccaacgagccacctcgtgggggccacgcgccggccctgggcctgccgtggtccgaaggtacctacttcctcgactcgcgtcctgacgcgggctcggg

SEQ ID NO: 129192 - DNA, 561 bp, Homo sapiens
  misc_feature: GYAE6OF02FWI0L.45.78.H01.1.454.CMB.1.raw
  modified_base (556)..(556): a, c, t, g, unknown or other
  misc_feature (556)..(556): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgagcgtgagatctgacgacacggccgtgtattactgtgcgagaggcaggaattacgtattttggagtggttattcggacggtatggacgtcgtggggccaagggccacgggtcaccgtctcctcagcctccaccaacggcccatcggtcttccccgtgccaccctcctccacgacgccaccgtcgtcggggcaccgacgccggcccgtgggcctcgccgtggtccgaacggaccttaccgttccgtacgtacgtcgtccgtcgtcggacggccgggtntcggg

SEQ ID NO: 129193 - DNA, 574 bp, Homo sapiens
  misc_feature: GYAE6OF02FUJOG.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgatttttagggagttggttattcgggtacggtagtggaacgtctggggccaagggaccacggtcaccgtctcctcacgcctccaccgaaggcccatccggtcttcccccgtgggccacccctccctccctaagacgccaccttcgtcgggggccacgacgccggccctcgggcctgcccgtggtacgaaggtacctacgttcccgtacgagtccggcgtccgtgacggccgggtctaccggg

SEQ ID NO: 129194 - DNA, 545 bp, Homo sapiens
  misc_feature: GYAE6OF02IBX4G.45.78.H01.1.454.CMB.1.raw
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtaacgtggttggcctggtatcagcaagaaaccgaagggaacgccctaagcctactgctctataggcatctagttagaaggtcgggtaccagtacgtaaggttcaggcggcagtaggatcgtaggacagtactacactctacactatcagcacgcctgacacgtcctgactgtattttcgactaacgtttatacttcgaccaactagtatagattagttatcgtacgttcgacgaaggacaggtagaactacgaaacgtacgtaggtcggtactcggacctaacctagttacgtgtttcctagtacccg

SEQ ID NO: 129195 - DNA, 532 bp, Homo sapiens
  misc_feature: GYAE6OF02JHFYU.45.78.H01.1.454.CMB.1.raw
  modified_base (412)..(412): a, c, t, g, unknown or other
  misc_feature (412)..(412): n is a, c, g, or t
  modified_base (434)..(434): a, c, t, g, unknown or other
  misc_feature (434)..(434): n is a, c, g, or t
  modified_base (441)..(441): a, c, t, g, unknown or other
  misc_feature (441)..(441): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggttcagtctggggctgaggtgaagaagcctggggcctcagtgaaggtctcctgcaaggcttctggatacaccttcaccggctactatatacactgggtgcgacaggcccctggacaagggctgagtggagtgggatggatcaacctaacaagtggtggcacaaactatgacacagaagttcaggcaggtcacatgacgaggacacgtcatcagcacagacctanagtggagctagagcgacggcgngaacgtntcgtagacgacgacggtcgtagtacgttactggtcggacgtaggacggtacgagggtaactttacggtagtttttacgggagtttaacggg

SEQ ID NO: 129196 - DNA, 544 bp, Homo sapiens
  misc_feature: GYAE6OF02II9U7.45.78.H01.1.454.CMB.1.raw
  modified_base (412)..(412): a, c, t, g, unknown or other
  misc_feature (412)..(412): n is a, c, g, or t
  modified_base (443)..(443): a, c, t, g, unknown or other
  misc_feature (443)..(443): n is a, c, g, or t
  modified_base (458)..(458): a, c, t, g, unknown or other
  misc_feature (458)..(458): n is a, c, g, or t
  modified_base (477)..(477): a, c, t, g, unknown or other
  misc_feature (477)..(477): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgatttttggagtggttattcggacggtatgggacgtcgtgggggccaaggggaccacggtcaccgtctcctcagcctccnccaacgggcccatccggtcttcccctggccnccctcctccaagacncaccctcgtcggggcacgngcggccctgggctcgcctggtcaaggtacctacgttcctcgactcgcgtcctggacgcgggctcggg

SEQ ID NO: 129197 - DNA, 545 bp, Homo sapiens
  misc_feature: GYAE6OF02HS1YH.45.78.H01.1.454.CMB.1.raw
tcagacgcgatcgacacgaccggtgctcgatttagtgtgagtagtttgggtttgggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccggccagtcagagtattagtaactggttggcctggtatcagcagaaaccagggaaagccctaagctcctgctactataaggcatctagttagaaggtcgggtaccagtacaaggttcagcggctaggtgatcgtgggacagattcactctacaccatcagcagcctgcagctgatgtatttgacttaactttatactagaccaaatagtatacgaattaggtttacttcggtacgttccggaaccggtaaaggaaccgtaagggtacgaaagttacaaaacggtacgtaggtacgctacgcctactatccgttagtcttacactttcccg

SEQ ID NO: 129198 - DNA, 572 bp, Homo sapiens
  misc_feature: GYAE6OF02I1YRT.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaatacgattttggagtggttattcggacggtatggacgtctggggccaagggaccacggtcaccgtctcctcagcctccaccaagggcccatccggtccttccccgtcggccaccctccctccaacgacgccaccctcgtcgggggccacgacggccggccccgtcgggcctcgccgtggtaccgaacggtaccttaccgttccttccgagttccggaccgttcgtggacggccggggtctacggg

SEQ ID NO: 129199 - DNA, 502 bp, Homo sapiens
  misc_feature: GYAE6OF02FYZ82.45.78.H01.1.454.CMB.1.raw
  modified_base (410)..(410): a, c, t, g, unknown or other
  misc_feature (410)..(410): n is a, c, g, or t
  modified_base (417)..(417): a, c, t, g, unknown or other
  misc_feature (417)..(417): n is a, c, g, or t
  modified_base (423)..(423): a, c, t, g, unknown or other
  misc_feature (423)..(423): n is a, c, g, or t
tcagacgcgatcgacacgaccggtgctcgatttagtgtgagtagtttgggtttggggagagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacgaaactatgcacagaagtttcagggcagggtcaccatgacagggacacgtccatcagcanagcctanatgganctgagcaggctgagatctgacgacacggccgtgtaatttacgtgtgcgagacggacgaggaattacggtattttacggg

SEQ ID NO: 129200 - DNA, 559 bp, Homo sapiens
  misc_feature: GYAE6OF02G2PVK.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgatttttgggagttggttattcggacggtatggacgtcgtggggccaagggaccacggtcaccgtctcctcagcctccaccaacgggcccagtcggtccttccccgtcgccacccctcctaccaacgacgccacctcgtcggggccacgacgccggccctgggcctcgccgtcggtcgaacggtacctacttccgtccgagtccgcgtcctggacgcgggctacggg

SEQ ID NO: 129201 - DNA, 622 bp, Homo sapiens
  misc_feature: GYAE6OF02I8H6C.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgattttggagtggttattcggtacggtatggacgtcgtggggccaagggccacggtcaccgtctcctcacgcctccaccgaacgggccccaacgtccgggtccctttcccccgtgggtaccctaccccgttcccctacccgaaacggtacgccgaacccgttccggtcggggggcctaaccgaccgggccgggccccgtacggggcctcggtcccgtcgggttaccgaacgggtacccttacgttcccgtcgacgtccggtcgtccgtggacggtccgggtcgtacgggg

SEQ ID NO: 129202 - DNA, 739 bp, Homo sapiens
  misc_feature: GYAE6OF02H10Y9.45.78.H01.1.454.CMB.1.raw
tcagacgcgatcgacacgaccggtgctcgatttagtgtgagtagtttgggtttggggagagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtcctcgtgcgaaggtcttcgtggactaccaccttcgaccggtctactatatacacgtgggtcgacgacgacggtcccctagggaaccgaagggtctttaggacggttgggagttaggggagtagggaactaacctaaacccgtaaagtaaggttcgggtacggacctaaacctaaaacgttacgtacgaacctaaacgtaaggttaaacgtttacggaaggggtaccgtaacggggttacccaacccgtaaggttaaccggaaaccggaacgggtaaacctaacggttaaacacgtaccgaacgacccgaaacgacgtaacccttaacgaaggtacgggaacgtccgtaaggaacgaccgtaacgggtccgtaggacgtacttcgacggaaccgtaccggtaccggtaccggttaacgtttaacgttacgttacgggtacgtaacggaagggtacgggtacggtaaagggtttaaacgtttacggtttaacggtttttaagggg

SEQ ID NO: 129203 - DNA, 762 bp, Homo sapiens
  misc_feature: GYAE6OF02IIQF9.45.78.H01.1.454.CMB.1.raw
  modified_base (282)..(282): a, c, t, g, unknown or other
  misc_feature (282)..(282): n is a, c, g, or t
  modified_base (288)..(288): a, c, t, g, unknown or other
  misc_feature (288)..(288): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgagngtgagntctagacgacacggccgtgtatactgtgcgagaggcaggtaattacgtagttttggagttggttaagttcgggtaacggttagtcgggtacgttccgtagggggtacccgaaaggggtacccgacgggtaccgaaccggttccgtacccgtccgaacgtcccttacccgaaccgaaccggggtacccctaacgttcccgggttccctttaccccccgtcgggacccctaccccgttaccccgtacccgtaaacggtaccgacccgtaacccgttcccggttacggggggaccctaaccggaccgggtcccgggtaccccggttccggggtcccgttaccgggtcccggttacgggttaaccggtaaaccggggttaacccgtttaacccggtttaccccgttaccggttaaccgttacccgggtacccggtttccggtaccgggtacgggtacccggggtccggttaaccgggg

SEQ ID NO: 129204 - DNA, 566 bp, Homo sapiens
  misc_feature: GYAE6OF02H1NOE.45.78.H01.1.454.CMB.1.raw
  modified_base (323)..(323): a, c, t, g, unknown or other
  misc_feature (323)..(323): n is a, c, g, or t
  modified_base (561)..(561): a, c, t, g, unknown or other
  misc_feature (561)..(561): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgaggcgtgagatcctagacgacacggccgtgtatactgtgcgagnggcaggaatacgattttggagtggttatcggaggtatggacgtcgtggggccaagggaccacggtcaccgtctccctcgacgcctaccaccgaacgggcccagtcggtccttccccgtggccaccctctaccaagcgtccaccgtcgtcggggccacgcgccggccgtggcgtcgccgttggtacgaacggtccttacgtccgtacgtagtccgtacgtccgttaggcggtccgggtnacggg

SEQ ID NO: 129205 - DNA, 523 bp, Homo sapiens
  misc_feature: GYAE6OF02HZRGO.45.78.H01.1.454.CMB.1.raw
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtaactggttggcctggtatcagcagaaaccagggaaagcccctaagctcctgctctataaggcatctagtttagaaagtggggtcccatcaaggttcagcggcagtggatctgggacagaattcactctcaccatcagcagcctgcagcctgatgattttgactaacttacttctgccaagaacttgtagtttttattggtacgttcggacctaagggacgaaagggtagaaatacgaaacgaacgtggtaggctgaccacgtatcgtgtcttcactccttacccg

SEQ ID NO: 129206 - DNA, 576 bp, Homo sapiens
  misc_feature: GYAE6OF02GL4ZC.45.78.H01.1.454.CMB.1.raw
  modified_base (275)..(275): a, c, t, g, unknown or other
  misc_feature (275)..(275): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtaactggttggcctggtatcagcagaaaccagggaaanccctaagctcctgctctataaggcatctagtttagaaagtggggtacccatcaaggttcagcggcagtggatcgtggacagaattcactctcaccatcagcagcctgcagcctagatgattttgactaactttattactgttacctaactaacgtatttacctaatttaacccgtcggacttaagtttaccggaccgtaaaacggggaaccctaaggtccgtttacgaagtaacttaaccgaaaacggtaaccgttaggtagggacctacgggtaccaacccgtattccgttcgttacccg

SEQ ID NO: 129207 - DNA, 510 bp, Homo sapiens
  misc_feature: GYAE6OF02IUHLW.45.78.H01.1.454.CMB.1.raw
  modified_base (415)..(415): a, c, t, g, unknown or other
  misc_feature (415)..(415): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcgagggcagggtcacatgacagggacacgtccatcagcacagcctanactggagctagacgcgaggcgtagagactctagacgacgacggccgtagtacttactggtgcgagacggcgaggtaattacgtagttttggtagg

SEQ ID NO: 129208 - DNA, 600 bp, Homo sapiens
  misc_feature: GYAE6OF02I1BK5.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgattttggagttggttattcgggacggtatggacgtcgtggggccaagggccacgggtcaccgtctcctcacgcctccaccgaacgggcccagtccggtccttcccccgtggccctacccctccctcccaaacgcgcacccgtcgtcggggccacgacgccggccccgtgggccgtcggccgttcggtaccgaacgggtacccttaaccgttcccgttacggacttccggaccggttccgtacggacggtcccggggacgtaccgggg

SEQ ID NO: 129209 - DNA, 548 bp, Homo sapiens
  misc_feature: GYAE6OF02GI928.45.78.H01.1.454.CMB.1.raw
  modified_base (375)..(375): a, c, t, g, unknown or other
  misc_feature (375)..(375): n is a, c, g, or t
  modified_base (543)..(543): a, c, t, g, unknown or other
  misc_feature (543)..(543): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtaactggttggcctggtatcagcagaaaccagggaaagcccctaagctcctgctctataaggcatctagtttagaaagtggggtcccatcaaggttcagcggcagtggatcgtggacagaattcactctcaccatcancagcctgcagcctgatgtatttgactaactttattactacgaccaaatacgtattagtagttaagtttacgttacgtaccgtttaccgggaccgtaaagggtaaccgaagggtaggaaactaacgaaaacgtaacgtaggtagcgtacgcaacctatcgtcgttcttntaccg

SEQ ID NO: 129210 - DNA, 531 bp, Homo sapiens
  misc_feature: GYAE6OF02IXAOM.45.78.H01.1.454.CMB.1.raw
  modified_base (446)..(446): a, c, t, g, unknown or other
  misc_feature (446)..(446): n is a, c, g, or t
  modified_base (463)..(463): a, c, t, g, unknown or other
  misc_feature (463)..(463): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggacctgagcagtttgagatctgacgacacggctgtctatactgtgcgagagacggggggaggatatgcactaatgattatactgtgtgccatgggttgagctccgtggggccagggaaccctggtcaccgtctcctcacgcctcaccaagggcccagtccggtcctccccgtggccnccctgcctccgaggacncaccctccgagacgcacgaggccggccctgggcctcgccgtggtccaacgggcctacttccgcgtacg

SEQ ID NO: 129211 - DNA, 540 bp, Homo sapiens
  misc_feature: GYAE6OF02F9IVG.45.78.H01.1.454.CMB.1.raw
tcagacgcgatcgacacgaccggtgctcgatttagtgtgagtagtttgggtttggggacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggcttgagtggatgggatggatcgaacctaacaatggtggcacaaactatgcacagaagtttcgagggcagggtcaccgatgaccgagggacacgtcatacagcacagcctacatggagcgtgagcgaggcgtagagactcgtgacgaacgacggtaccgtgtattacgtggtcggcggaggacggacgaggtaagttacggtagtttttagggaggtttaggtttagttacgggtaacgg

SEQ ID NO: 129212 - DNA, 604 bp, Homo sapiens
  misc_feature: GYAE6OF02HQW9N.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgatttttggagttggttattcggacggttatgggacgtcgtggggccaaggggaccacgggtcaccgtctccgtcacgcctccaccgaacgggcccagtccggtcttccccctggccaccctcctccaacgcgccacctcgtcgggggcaccgacggccgggacccgtcggggcctcggcccgttcgggtaccgaaacgggtacccttaccgttcccgttacggacgttccggtccggttaccgttcggaacgggtccggggtcgtccgggg

SEQ ID NO: 129213 - DNA, 539 bp, Homo sapiens
  misc_feature: GYAE6OF02IZ90Q.45.78.H01.1.454.CMB.1.raw
  modified_base (401)..(401): a, c, t, g, unknown or other
  misc_feature (401)..(401): n is a, c, g, or t
  modified_base (454)..(454): a, c, t, g, unknown or other
  misc_feature (454)..(454): n is a, c, g, or t
tcagacgcgatcgacacgaccggtgctcgattagtgtgagtagtttgggtttggggtgaagaagcctggggcctcattgaaggtctcctgcaaggcttctggatacaccttcaccggctactatatacactgggtgcgacaggcccctggacaagggcttgagtggatgggatggatcaaaccctaacaatggtggcacaaactatgcacagaagtttcagggcagggtcaccatgaccagggacacgtccatcagcacagcctacatggagctgagcgaggctgagatctgacgcacggccgtgtatactgtgcgagaggcaggaattacgattttggagtggttattcggacggtatggacgtcgtggggccaagggaccacggtcgaccgtctcctcngcctccacaacgggccactccggtcttccccgtggccaccctcctccaagacnccacctcgtcggggcacgacgccggcccgtcgggctgcctggtcgaaggtactacttcctcgatcgcgtctgacggcgggctcgg

SEQ ID NO: 129214 - DNA, 619 bp, Homo sapiens
  misc_feature: GYAE6OF02IA8D0.45.78.H01.1.454.CMB.1.raw
  modified_base (310)..(310): a, c, t, g, unknown or other
  misc_feature (310)..(310): n is a, c, g, or t
tcagacgcgatcgacacgaccggtgctcgattagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagttcagggcagggtcaccatgaccagggacacgtccatcagcacagcctacatggagctgagcaggctgagatctgacgacgacggcgtgtattacngtgcgagaggcaggattacgtagttttggagttggttattcggacggttagtgggtcgtcgtgggggccaaggggaccacgggtcaccgtctcctcgacgccctccaccgaacgggcccagtccggttccttccccgtgcccacccctcctaccaacgcgcctaccgtcggtccgggggaccaccgacggcccggacccgtcgggccgtcggcccgttcgggtaccgtaaccgggtaccttacccgttccccggtacgtaccggttccggaccggttccgtcgggtacggtaccggggtcctacggggg

SEQ ID NO: 129215 - DNA, 568 bp, Homo sapiens
  misc_feature: GYAE6OF02FTTEA.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgattactgtgcgagaggcaggaattacgatttttggagtggttattcggacggtatggacgtctggggccaaggccacggtcaccgtctcctcacgcctccaccaacgggcccatccggtccttccccctggccacccctccctccaacgcgccaccctcgtcgggggccaccgacggccggcccgtcgggctcgcccgtcggtccgaacggaccttaccgttccctaccgtagtccgccgttcctggacgccggggcgtcggg

SEQ ID NO: 129216 - DNA, 533 bp, Homo sapiens
  misc_feature: GYAE6OF02IYJA5.45.78.H01.1.454.CMB.1.raw
  modified_base (198)..(198): a, c, t, g, unknown or other
  misc_feature (198)..(198): n is a, c, g, or t
  modified_base (338)..(338): a, c, t, g, unknown or other
  misc_feature (338)..(338): n is a, c, g, or t
  modified_base (514)..(514): a, c, t, g, unknown or other
  misc_feature (514)..(514): n is a, c, g, or t
tcagacgcgatcgacacgaccggtgctcgatttagtgtgagtagtttgggtttgggggagtcagacccagtcgggacacagcatggacatgagggtccccgctcagctcctggggctcctgctgctctggctcccaggtgccaaaatgtgacatccagatgacccagtctccttccaccctgtctgcatctgtagganacagagtcaccatcacttgccggccagtcagagtatagtaactggtggcctggtatcagcaagaaaccagggaaacgcccctaagctcctgctctataaggcatctagtttagaaagtgggtcccatcaaggtcagcggnagtggatctgggacagtaattcactctcacatcagcagcctgcagcctgtatgtattttacgaccttaactttatttactgtaccctaacgtagtactagtaattagttactcgtacgttcggaccgaaaggtaaccagggtagaactcgaaacgtacgtggtacgctgccacctntcgtgtcttcgacttcccg

SEQ ID NO: 129217 - DNA, 505 bp, Homo sapiens
  misc_feature: GYAE6OF02HKF78.45.78.H01.1.454.CMB.1.raw
  modified_base (414)..(414): a, c, t, g, unknown or other
  misc_feature (414)..(414): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggcttgagtggatgggatggatcaacctaacaatggtggcacaaactatgcacagaagtttcagggcagggtcacatgaccagggacacgtccatcagcacagcctanatggagctgagcgaggctgagatcgtgacgacacggccgtagtacttacgtgtgcgaggacggcaggtaattacggtagttttggtaacgg

SEQ ID NO: 129218 - DNA, 569 bp, Homo sapiens
  misc_feature: GYAE6OF02FMYKZ.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgaggcgtgagatctgacgacacggccgtgtattactgtgcgagaggcaggaattacgattttggagtggttattcggacggtatggacgtcgtggggccaaggggaccacggtcaccgtctcctcacgcctccaccaacgggcccacgtcggtccttccccgtcgcctaccctcctccaacgacgccacctcgtcgggggccacgacgccggcccgtcggccgtcgccgtgggtccgaacgggaccttaccgttccgtcgtacgtcgcgtcgtggacggcgggtcgtcggg

SEQ ID NO: 129219 - DNA, 619 bp, Homo sapiens
  misc_feature: GYAE6OF02HZDLX.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtatactgtgcgagaggcaggaattacgattttggagtggttattcgggacgttagtggtacgtcgtggggaccgaacgggaccgtacgggtccaccggtcctcctcgacgtccctcccaaccgaacgggccccagttccggtcccttcccccgtcggccctaccccgtccctaccaacggtacgacccacccgttcggtcgggggacccacgaccggccgggacccgtcgggccgttccggccgttcggtaccgaacggtaccttaccttcccgtacgacgttccgcggttctcggcggtccgggtcgtacggg

SEQ ID NO: 129220 - DNA, 524 bp, Homo sapiens
  misc_feature: GYAE6OF02FWR1M.45.78.H01.1.454.CMB.1.raw
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtaactggttggcctggtatcagcagaaaccagggaaagcccctaagctcctgctctataaggcatctagttagaaagtgggtccatcaaggttcagcgcagtgatctagggacagaattcactctcaccatcagcagcctgcagcctgatgtatttcgactaactttattactcgaccaactagtatagtattagttattcgacgtttccggactaagggaccaagggtacgaaagtacgaaacgtaacgtggtacggctaggaccactactctcgttctacgtacc

SEQ ID NO: 129221 - DNA, 522 bp, Homo sapiens
  misc_feature: GYAE6OF02FY7XR.45.78.H01.1.454.CMB.1.raw
  modified_base (287)..(287): a, c, t, g, unknown or other
  misc_feature (287)..(287): n is a, c, g, or t
  modified_base (337)..(337): a, c, t, g, unknown or other
  misc_feature (337)..(337): n is a, c, g, or t
  modified_base (354)..(354): a, c, t, g, unknown or other
  misc_feature (354)..(354): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactccccaggtgcagctggtgcagtctggggctgaggtgaagaagcctggggcctcagtgaaggtctctgcaaggcttctggatacaccttcaccggctactatatacactgggtncgacaggcccctggacaagggcttgagtggatgggatggatcaacctaanaagtggtgcacaaactntgcacagaagtttcagggacagggtcaccatagaccgagggacacgtccatcagcacacgcctacagtggagctagagcgaggcctgagatctagaccgacgacggccgtagtacttacgtgtcgacgtaggacggcgaaggtaacttacggttagttttggtaaggg

SEQ ID NO: 129222 - DNA, 514 bp, Homo sapiens
  misc_feature: GYAE6OF02GL0FK.45.78.H01.1.454.CMB.1.raw
  modified_base (338)..(338): a, c, t, g, unknown or other
  misc_feature (338)..(338): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggcttgagtggatgggatggatcaaccctaanaatggtggcacaaactatgcacagaagtttcagggcagggtcacatgacagggacacgtccatcagcacacgcctacatggagctgagcgaggctaggagactctgaccgacacgggtccgtgtaacttacgtgtagcgaaggacggcgaggtaatttacggtagttttggtaagg

SEQ ID NO: 129223 - DNA, 587 bp, Homo sapiens
  misc_feature: GYAE6OF02H1UKF.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtcatcagcacagcctacatggagctgagcaggctgagatctgacgacacggccgtgtattactgtgcgagaggcaggaattacgtatttttggagttggttattcggacggttagtggacgtcgtggggccaagggaccacggtcaccgtctcctcagcctccgaccaacgggcccagtccggtccttcccccgtggcccaccctcctacccacgacgccaccgtcgtcgggggcacgacgccggcccgtgggcctcgccgttcgggtccgaaacgggtaccttaaccgttcccgtaccgacgttccgccggttaccgtcggacggccgggcgtacggg

SEQ ID NO: 129224 - DNA, 588 bp, Homo sapiens
  misc_feature: GYAE6OF02G0NHS.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgaggctgagatctgacgacacggccgtgtattactgtgcgagaggcaggaatacgtattttggagtggttattcgggacggtagtggacgtcgtggggccaagggaccacggtcaccgtctcctcagccctccgaccgaacgggcccagtccggtccttccccgtggcccacccgtcctcccaagacgcctaccgtcgtcggggctacgacgccggccctgggcctcggccgttacgggtcgaaacgggtccttaacccgttccgtacccggtactccggccgttcgtcggacggccggggtctacgggg

SEQ ID NO: 129225 - DNA, 612 bp, Homo sapiens
  misc_feature: GYAE6OF02H7MDR.45.78.H01.1.454.CMB.1.raw
  modified_base (339)..(339): a, c, t, g, unknown or other
  misc_feature (339)..(339): n is a, c, g, or t
  modified_base (358)..(358): a, c, t, g, unknown or other
  misc_feature (358)..(358): n is a, c, g, or t
tcagacgcgatcgacacgaccggtgctcgatttagtgtgagtagtttgggtttggggacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggctcagtgaaggtctcctgcaaggcttcgtggatacaccttccaccggctaactatactacacgtgggtgcgacacggccctggacaagggtcttgagtggagtgggatggataccaaacctaanaagtggtggacacaaactngacacgaagtaacgttgacggcagggtcaacctagtacgacgagggacacggtacagtacacgacacgacgtacctacgagtacggagcgtagacgtacgaggtcgtaggacagtcgacgaacgaccggacggaccggttagtaacttacgtacggtcggtaacgtacgggaaggtaccgtaaaggttaacgtttaacggttacggtttttagggaacggttttagggtttaacggttaccggggttaacgggg

SEQ ID NO: 129226 - DNA, 563 bp, Homo sapiens
  misc_feature: GYAE6OF02HTS9A.45.78.H01.1.454.CMB.1.raw
tcagacgcgatcgacacgaccggtgctcgatttagtgtgagtagtttgggtttggggctgaggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgattttggagtggttattcgggaggtatggacgtctggggccgaagggaccacggtcaccgtctcctcagcctccaccaaggcccagtcggtccttcccctgccaccctcctaccaacgacgccacctcgtcgggggccacgacgccggcccgtgggacctcggccgtgggtccaaacgggtaccttaccgttcccgtcggtaactccggcgttcgtgtaacggg

SEQ ID NO: 129227 - DNA, 513 bp, Homo sapiens
  misc_feature: GYAE6OF02GYAIW.45.78.H01.1.454.CMB.1.raw
  modified_base (485)..(485): a, c, t, g, unknown or other
  misc_feature (485)..(485): n is a, c, g, or t
tcagacgcgatcgacacgaccggtgctcgatttagtgtgagtagtttgggtttggggagagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagcctggggcctcagtgaaggtctcctgcaaggcttctggatacaccttcaccggctactatatacactgggtgcgacaggcccctggacaagggcttgagtggatgggatggatcaacctaacaatggtggcacaaactatgcacagaagtttcagggcagggtcacatgacgaggacacgtacatcagcacagcctacgatggagctgagcgaggctgaggatcgtcgacgacgacggccgttagtactttacgtgtgcggagacggganaagggactttacggtatttttaacgggg

SEQ ID NO: 129228 - DNA, 548 bp, Homo sapiens
  misc_feature: GYAE6OF02G4DO5.45.78.H01.1.454.CMB.1.raw
  modified_base (364)..(364): a, c, t, g, unknown or other
  misc_feature (364)..(364): n is a, c, g, or t
  modified_base (446)..(446): a, c, t, g, unknown or other
  misc_feature (446)..(446): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacacggcccctggacaagggcttggagtggagtgggatggatacgaaccctaacaagtggtagacaacgaaactntgacaacagtaagtttcgagggcgagggtcacagtacgaaccgagggacacgtacatcagcacgacgcctaacagtaggacncgtgacgcgacggcgtagacgtacgtctagacgaccgtacgcggtacgtagttacgtgtcgacgaggacgacgaggtaacttacggttagtttaggtaacgg

SEQ ID NO: 129229 - DNA, 566 bp, Homo sapiens
  misc_feature: GYAE6OF02GM4C4.45.78.H01.1.454.CMB.1.raw
tcagacgcgatcgacacgaccggtgctcgatttagtgtgagtagtttgggtttggggctgaggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgattttggagtggttattggacggtatggacgtcgtggggccaaggggaccacggtcaccgtctcctcagcctccaccacgggcccactccggtcttccccctggccacccctcctccaacgacgccaccgtcgtcggggccacgacgccggcccgtcgggccgtcggtccgtcggttccgaacggtacctacgttcccgtcgtacgtcggccgttcgtcggtacggg

SEQ ID NO: 129230 - DNA, 567 bp, Homo sapiens
  misc_feature: GYAE6OF02G0FLS.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgattttggagttggttattcggacggtatggacgtctggggccaagggaccacggtcaccgtctcctcagcctccaccaacgggcccagtccggtccttcccctcggccaccctcctccaacgacgccacctccgtcgggggcacgacgccggccctcgggcctcggcctgggtaccgaacgggacctaccttcccgtccgacgttccgcgtcctggacggtcgggctaccgggg

SEQ ID NO: 129231 - DNA, 550 bp, Homo sapiens
  misc_feature: GYAE6OF02GVNAM.45.78.H01.1.454.CMB.1.raw
  modified_base (545)..(545): a, c, t, g, unknown or other
  misc_feature (545)..(545): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaatacgattttggagtggttattcggacggtagtggacgtcgtggggccaagggaccacggtcaccgtctcctcagcctccaccaacgggcccatccggtccttccccgtggccaccctcctccaacgacgccaccctcgcgggggccacgagccggcccgtgggcctggcctggtccaaggaccttacgtcctcgactcgcgtctcgacggtccgggntcggg

SEQ ID NO: 129232 - DNA, 606 bp, Homo sapiens
  misc_feature: GYAE6OF02GNGVS.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgattttggagtggttattcggacggtatggacgtcgtggggccaagggaccacgggtcaccgtctcctcacgcctccaccaacgggcccacgtccggtccttcccccgtcggccaccccttccctccaacgacgccacccgtcgtcgggggccacgacgccggcccgtcgggccgtacgcccgtcgggtaccgaacgggtacccttaccgttcccgttaccggtacgttcccgggtccggttccgtacggtacggtcccgggggcgtaccgggg

SEQ ID NO: 129233 - DNA, 666 bp, Homo sapiens
  misc_feature: GYAE6OF02F19SR.45.78.H01.1.454.CMB.1.raw
  modified_base (320)..(320): a, c, t, g, unknown or other
  misc_feature (320)..(320): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagnggcaggaattacgattttggagttggttagttcggtacggtagtgggacgtcgtggggtccgaaaggggtaccacggtcgaccgttctccgtcaggccctccaacccgaaacggggccccaacgtcccggtaccttccccccgtcgggccctacccctcccgtccaaacggacgtcccaacccgttccgttacgggggggacccaaccggtacgggaccccggtccccgttaggggcccgttcggtccccgttgggtacccgtaaacggggacccttaacccgtttcccgttaccggtaacgttcccgggcgttacccgttcggacggtacccggggccgtacggg

SEQ ID NO: 129234 - DNA, 529 bp, Homo sapiens
  misc_feature: GYAE6OF02ICLIU.45.78.H01.1.454.CMB.1.raw
  modified_base (337)..(337): a, c, t, g, unknown or other
  misc_feature (337)..(337): n is a, c, g, or t
  modified_base (496)..(496): a, c, t, g, unknown or other
  misc_feature (496)..(496): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggcttgagtggatgggatggatcaacctaanaagtggtgcacaaactatgcacagaagtttcgagggcagggtcacatcgaccagggaccacgtccaatcgacgcacagcctaacagtaggacgactggacgcgaggctagacgtatcgagaccgacgacggcgtagttaacttacgtggtacgcgaggnggacgaaggtagtttacggtagttttggtaagg

SEQ ID NO: 129235 - DNA, 646 bp, Homo sapiens
  misc_feature: GYAE6OF02GQOIO.45.78.H01.1.454.CMB.1.raw
  modified_base (294)..(294): a, c, t, g, unknown or other
  misc_feature (294)..(294): n is a, c, g, or t
tcagacgcgatcgacacgaccggtgctcgatttagtgtgagtagttggggttgggtggaagaagcctcggggacctcgagtgaaggtctcctggcaaggcttcgtcggatacaccttcaccggctacgtatactacactgggtgcgacaggcccctggacgaagggcttgagtggatgggatggatcaaccctaacaagtcggtcgcaccaaacctatgcacagtaagtttcagggcagggtcaaccatacgaccagggacctcggtccgatcgagacacagcctacagtgganctagagtcgagctagaacgaacgtacgtaggaaccgaccaacggtccgtagtacttacgtgtgacgagacgactaaggtaacgtacggtagttttacggagttaggttagttacgggtacggtagtagggtacgttcggtacggggaccgaacgggtaccgtaacggttactaccgtctaccgtcgacgccctaccgaccgaacggccctacgtccgtacctcccgtacgtcctaccctctaccaacgtcactaccgtcgacggcacgcgcgtccgtcggcctcgtccgtcggtaccggacggtaccgtacgtccgtacgtacgtccgacgtcgcggtacggcggtctacgg

SEQ ID NO: 129236 - DNA, 534 bp, Homo sapiens
  misc_feature: GYAE6OF02JBKVO.45.78.H01.1.454.CMB.1.raw
  modified_base (511)..(511): a, c, t, g, unknown or other
  misc_feature (511)..(511): n is a, c, g, or t
  modified_base (522)..(522): a, c, t, g, unknown or other
  misc_feature (522)..(522): n is a, c, g, or t
  modified_base (530)..(530): a, c, t, g, unknown or other
  misc_feature (530)..(530): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgattttggagttggttattcggacggtatggacgtcgtggggccaagggccacggtcaccgtctcctcagcctccacgaacggcccactcggtccttccccgtgcctaccctcctccaacgacgccacctcgtcggggcacgacgcgcccgtggctcgcctggcgaaggctacgttccncgctcgctcgngacgcggntcgg

SEQ ID NO: 129237 - DNA, 497 bp, Homo sapiens
  misc_feature: GYAE6OF02HFLB5.45.78.H01.1.454.CMB.1.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgacacagaagtttcgagggcagggtcaccatgaccagggacacgtccatcagcacacgcctacatggagctgagcaggctgagatctagacgacgacggcgtgtatactgtgcgagaggcaggtatacgtagtttggtagg

SEQ ID NO: 129238 - DNA, 593 bp, Homo sapiens
  misc_feature: GYAE6OF02FSS73.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgtattttgggagttggttagttacgggacggttagtggacgtcgtggggccgaagggaccgacggtccaccgtctcctcacgtccctccaccgacgggccctacgtccggtccttcccccgtggccctaccccgtcctactaacgacgcctacctcgtcggggccacgacgccggcccgtgggccgtcgccgtcggtacgaacggtacctacccgttcctcggtaccgtccggtcgtccgtggtacggtccgggcgtcggg

SEQ ID NO: 129239 - DNA, 567 bp, Homo sapiens
  misc_feature: GYAE6OF02GKY2R.45.78.H01.1.454.CMB.1.raw
  modified_base (340)..(340): a, c, t, g, unknown or other
  misc_feature (340)..(340): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacacgtgggtgcgacaggccctggacaagggcttggagtggatgggatggatccaaacctaanaagtggtaggcaacgaaactagtgacacagtaagtttcgagggcaggtcacatcgacagggacacgtccatcacgcacacgcctacgataggagcgtagacgacgacggtcgtaggaagacttcgtaggaccgaccgaccgggtaccgtagttaacgttaccgtacggtaggacgtaagggtacggacgtaaggtaacgtttacggttaggtttttagggtaacggg

SEQ ID NO: 129240 - DNA, 553 bp, Homo sapiens
  misc_feature: GYAE6OF02GZ5G1.45.78.H01.1.454.CMB.1.raw
  modified_base (423)..(423): a, c, t, g, unknown or other
  misc_feature (423)..(423): n is a, c, g, or t
tcagacgcgatcgacacgaccggtgctcgatttagtgtgagtagtttgggtttggggacccagcaaccacatctgtcctctagagaatcccctgagagctccgttcctcaccatggactggacctggaggatcctcttcttggtggcagcagccacagggagcccactcccaggtgcagctggtgcagtctggggctggaggtgaagaagccgtggggcctcgagtgaaggtctcctgcaaggcttcgtggatacaccttcaccggctactatatacactgggtgcgacaggcccctggacaagggcttgagtggagtgggatggatacgaaaccctaacaatgggtgacaacgaaactatgacacaagagttcaggcagggcacatagacgaggacacgtacatcgagcaacgacgcctaanacgtaggagctagacgcgaggctagagatcagacgaacacggccgtagtacttacgtgtacggacggagacggacaagggtaattacggttagttttagggagtttacgggtttaggtacggttaacggg

SEQ ID NO: 129241 - DNA, 527 bp, Homo sapiens
  misc_feature: GYAE6OF02IAVBI.45.78.H01.1.454.CMB.1.raw
  modified_base (198)..(198): a, c, t, g, unknown or other
  misc_feature (198)..(198): n is a, c, g, or t
  modified_base (352)..(352): a, c, t, g, unknown or other
  misc_feature (352)..(352): n is a, c, g, or t
  modified_base (372)..(372): a, c, t, g, unknown or other
  misc_feature (372)..(372): n is a, c, g, or t
  modified_base (405)..(405): a, c, t, g, unknown or other
  misc_feature (405)..(405): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtcctccttccaccctgtctgcatctgtagganacagagtcaccatcacttgccgggcagtcagagttattagtaactggttggcctggtatcagcagaaccagggaaacgcccctaagctcctgcctctataaggcatctagttaagaagtgggtcccatcaaggttcagcgcagtgatctggganaagtatcactctcacatcancagcctgacagcctgatgtatttgactaacttnttactgaccaacgagtatgaattagttattacgtacgttcggacgaacggaacgtaaggtacgtaaatccgaaaagtaaccttggtacggtctagcaacctagtacctgttctacgttaccg

SEQ ID NO: 129242 - DNA, 515 bp, Homo sapiens
  misc_feature: GYAE6OF02FTY20.45.78.H01.1.454.CMB.1.raw
tcagacgcgatcgacacgaccggtgctcgatttagtgtgagtagtttgggtttggggagagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccgaggacacgtaccatcagcacagcctacatggagctgagcgaggctagagacgtctagacgacacggaccgtggtaattacgtgtgtacggaggacggcgaagggtacttacgtagtttttacggg

SEQ ID NO: 129243 - DNA, 546 bp, Homo sapiens
  misc_feature: GYAE6OF02IQM8K.45.78.H01.1.454.CMB.1.raw
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtaactggttggcctggtatcagcagaaaccagggaaacgcccctaagctcctgctctataaggatctagttagaagtgggcccatcagttcagcgcagtgatcgtggacagaattcactctcacctatcgagcacgcctgcagcctgatgtacttttgaccttaactttacgttactcgacctaacagttaatgtaattagtttacgttcgtacgtttaccgggacctaagggaacctaagggtagaaactacgaaaccgtacgtggtacggtctacgacaccgtagttccttgtccttacattccccg

SEQ ID NO: 129244 - DNA, 576 bp, Homo sapiens
  misc_feature: GYAE6OF02GDPX2.45.78.H01.1.454.CMB.1.raw
  modified_base (345)..(345): a, c, t, g, unknown or other
  misc_feature (345)..(345): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacacgtgggtgcgacacggcccctggaccaaggggcttggagtggatgggatggatccaaaccctaanaagtgggtcggacaaccgtaaactatagacaacgtagtaacgtttcgagggcgacgggtcacatgaccgaagggacacgtacatcagaccaacacgaccttacacgtggacgctggacgcgaggctaggagtactacgtacgacgacgaccgggtcgtacggttacttacggtggtacggacggtaaggacggtacggaaggtaacgtttacggttagttttagggtacgg

SEQ ID NO: 129245 - DNA, 720 bp, Homo sapiens
  misc_feature: GYAE6OF02JNG2N.45.78.H01.1.454.CMB.1.raw
  modified_base (200)..(200): a, c, t, g, unknown or other
  misc_feature (200)..(200): n is a, c, g, or t
  modified_base (205)..(205): a, c, t, g, unknown or other
  misc_feature (205)..(205): n is a, c, g, or t
  modified_base (277)..(277): a, c, t, g, unknown or other
  misc_feature (277)..(277): n is a, c, g, or t
  modified_base (326)..(326): a, c, t, g, unknown or other
  misc_feature (326)..(326): n is a, c, g, or t
  modified_base (331)..(331): a, c, t, g, unknown or other
  misc_feature (331)..(331): n is a, c, g, or t
tcagacgcgatcgacacgaccggtgctcgatttagtgtgagtagttggtttggggtggtaagaagcctgggccgtcagtgaaggtctcctgcaaggcttctggatacaccttcaccggctactatatacactggtgcgacaggcccctggacaagggcttgagtggatggtatggatcaacctacaatggtgcacaactntgcanagaagttcagggcagggtcacgatgaccagggacacgtccatacagacctacgacgacctacactacggacncgtgacgcgacgcgtgagtactcgtgacgacgcgccgtatagtctgcgngacgnggcaggattacgagttttggacgttgtagtacggtgtagttaggacgttgtacggggctaacgggaccgtaccggtacgaaccgttcgtacccgtcaacggtccccgttacgaaccgtaaccgggtcccaacgtttccggtacccgtcccgtttccggacctacccgttccgtaacccgtacgaacgtccccgtaccgttacccgggtacgggggtacccaaccgtaaccggccggtaccccgggtttaaccggggcttaacccggggttcccggttaaccggggcccgttaaaacccggggttcccttaaccgggtttacccccacgggtttaccgtaccccgggttccggttccctaacgggtcggggtacccgtacggtaccgggg

SEQ ID NO: 129246 - DNA, 579 bp, Homo sapiens
  misc_feature: GYAE6OF02FI21B.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgattttggagtggttattcggacggtatggacgtctggggccaaggggaccacgggtcaccgtctcctcagcctccaccaagggcccatcggtccttcccctggccaccctcctccaagacgccaccctcgtcgggggccacgacggccggcccgtgggccgtcggccctcgggtccgaacgggaccttacccgttcccgtccgtaacgtccggccggttccgtcggacggtccggggtcctcgggg

SEQ ID NO: 129247 - DNA, 602 bp, Homo sapiens
  misc_feature: GYAE6OF02G0AOX.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgagctgagatctgacgacacggccgtgtattactgtgcgagaggcaaggaattacgtatttttggagttggttattcgggacgtagtggacgtcgtggggccaagggaccacggtcaccgtctccctcacgcctccaccgaacgggcccaacgtccggtccttcccccgtcggcccaccctcccgtccaacgcgcctaccgtcgtcggggccacgacgccggcccgtgggccgtcggcccgttcggtaccgtaaacgggtaccttaccgttcccgtaccggtaacgttccggccgttccgttcggacggtccggggctaccggg

SEQ ID NO: 129248 - DNA, 527 bp, Homo sapiens
  misc_feature: GYAE6OF02HGE80.45.78.H01.1.454.CMB.1.raw
  modified_base (495)..(495): a, c, t, g, unknown or other
  misc_feature (495)..(495): n is a, c, g, or t
  modified_base (498)..(498): a, c, t, g, unknown or other
  misc_feature (498)..(498): n is a, c, g, or t
  modified_base (516)..(516): a, c, t, g, unknown or other
  misc_feature (516)..(516): n is a, c, g, or t
  modified_base (524)..(524): a, c, t, g, unknown or other
  misc_feature (524)..(524): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcagactgacatctgacgacacggccatttatactgtgcgaggatgtttaccggtggcttggttccttttgacgactggggccagggaaccctggtcaccatctcctcagccctccaccaacgggcccatccggtccttccccctggcccacccctcctcccaagcgccacctcgtggggccacgacgccggccctgggctgcctggcagctacttccncgntccgcgtctgacgcggcnggcaggcncag

SEQ ID NO: 129249 - DNA, 627 bp, Homo sapiens
  misc_feature: GYAE6OF02HJO03.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgaggctgagatctgacgacagtggccgtgtattactgtgcgagaggcaggtaattacgtattttagggagttggttattcggacggttagtggacgtcgtggggaccaagggacccgacggtcgacccgtctccctcgacgccctccgaccgaacgggcccacgtccggttcccttcccccgcggtcccaccccgttcccacccgaacgacgaccacccgtcgtacgggggaccaccgaacggcccggtacccgtcgggccgttcgcccgttacgggtccgaacgggtacctacccgtttacccgtccggaccgttccggtaccgttccgtcggacggtcggggtccgg

SEQ ID NO: 129250 - DNA, 635 bp, Homo sapiens
  misc_feature: GYAE6OF02IGUV1.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaaactatgcacagaagtttcagggcagggtcaccatgaccagggacacgtccatcacgcaacagccctacatggagctgagcaggctgagatctagacgacgacggccgtgtaattactgtcgcgagaggacaggtaattacgtagtttttgggaggtttaggttagttcgggaacggttagtacgggtacggttcgtacgggggaccctaaacggggaccaacgggttaccctaccggtcctcccgtacacggccctccaaccgaacggcccgtagtccggttcccttcccccgtcggccaccccttcctaccaacgacgaccaccgtccggacggggccaacgaccgccggcccgtcgggcgtcgcccgtggtccaaacgggaccttaccgtcgtacgacgtcggccgtactacgggcggtccgggctacggg

SEQ ID NO: 129251 - DNA, 547 bp, Homo sapiens
  misc_feature: GYAE6OF02JFFVJ.45.78.H01.1.454.CMB.1.raw
  modified_base (382)..(382): a, c, t, g, unknown or other
  misc_feature (382)..(382): n is a, c, g, or t
  modified_base (419)..(419): a, c, t, g, unknown or other
  misc_feature (419)..(419): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctcccttccaccctgtctgcatctgtaggagacagagtcaccatcacgttgccgggccagtcagagtattagtaactggttggcctggtatcagcaagaaaccgagggaaacgcccctaagctcctgcctcataaggcatctaagtttagaaggtgggtaccctagtacaaggtcagcggcaggtgatcgtggacagtattcactcacacatcancagccctgccagtcctgtatgtatttcgctaaacttntactgaccaactgtatagtattagttattaccgtagttccgacgtaacgggactaagggtagaagtaccgaaacgtaacgttgtacggtactagacctaccgtacttcgtacgttacctttctaaccg

SEQ ID NO: 129252 - DNA, 564 bp, Homo sapiens
  misc_feature: GYAE6OF02FKXP2.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgatttttggagtggttattcggacggtatggacgtctggggccaagggaccacggtcaccgtctcctcagcctccaccaacgggcccagtccggtccttcccccgtggccacccctcctcccaagacgccacctctcgggggcacgacgccggcccgtgggcctggccctgggtccgaaacgggtaccttaccgttcccgtcgactcggccgtcctggacggcgggctcggg

SEQ ID NO: 129253 - DNA, 590 bp, Homo sapiens
  misc_feature: GYAE6OF02HQNB0.45.78.H01.1.454.CMB.1.raw
  modified_base (323)..(323): a, c, t, g, unknown or other
  misc_feature (323)..(323): n is a, c, g, or t
  modified_base (417)..(417): a, c, t, g, unknown or other
  misc_feature (417)..(417): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgaggctagagatctgacgacgacggccgtgtatacgtgtgcgagnggcaggaattacgtattttgggagttggttattcggacgtatgggtacgtcgtggggaccaagggaccacggtcaccgtcctcctcgacgcccnccaccaacggcccacgtccggtccttcccccgtcgaccctaccctcctaccgaacgacgaccaccgtccgtcggggacaccgtacgcccgggccgtcgggtcctacggccgtacggtacgaacggaccttaccgtcccgtaccgacgtcgcgtccgtaggacggcgggctcgg

SEQ ID NO: 129254 - DNA, 557 bp, Homo sapiens
  misc_feature: GYAE6OF02FH3G1.45.78.H01.1.454.CMB.1.raw
  modified_base (412)..(412): a, c, t, g, unknown or other
  misc_feature (412)..(412): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccggccagtcagagtattagtaactggttggcctggtatcagcagaaaccagggaaagccctaagctcctgctcataagcatctagttagaagtgggtccatcaaggtcagcggcagtggatcgtgggacagaatcactctacacatcagcagcctgcagcctgatgtattttgactaatttattactgtaccaanacgttatacgtattaacgtttagttacgtaccgtttacggaccgtaaaggggtacccaaaggggtggaaaactacggtaaaaaccggaacgttcggtacggacctaggacctaccgtaattacgttacgttcctttactaacccg

SEQ ID NO: 129255 - DNA, 572 bp, Homo sapiens
  misc_feature: GYAE6OF02FPC3I.45.78.H01.1.454.CMB.1.raw
tcagacgcgatcgacacgaccggtgctcgatttagtgtgagtagtttgggtttggggagagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacagggcttggagtggatgggatggatacaaaccctaaacaagtgggtaggacaacaaactatgcacaagtaagtttcgagggcagggtacaccgagtacgaccgagggaccacgtccagtcagaccacacgcctaacgagtaggacgtcgtacggagacgacggtcgtaggaagtagtaccgagtaccgacgaccgggtaccgttaggtactttacgtgtcggacgaaggacggtacgaagggtaacgtttacggtagtttttacgggg

SEQ ID NO: 129256 - DNA, 532 bp, Homo sapiens
  misc_feature: GYAE6OF02IQAJ9.45.78.H01.1.454.CMB.1.raw
  modified_base (427)..(427): a, c, t, g, unknown or other
  misc_feature (427)..(427): n is a, c, g, or t
tcagacgcgatcgacacgaccggtgctcgatttagtgtgagtagtttgggtttggggacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtgcgacaggcccctggacaagggcttgagtggatgggatggatcaaccctaacaatggtggcacaaactatgcaacagtaagtttcagggcacggggtacaccagtgaaccgagggaccacgtccatcagcacacgcctacgatggacnctagacacagactgacatctacgacgacacggccatttatactgtcgagtaggtattcggttaccggtgtcgttcggtttcctttggacgttacgtgggtacccg

SEQ ID NO: 129257 - DNA, 599 bp, Homo sapiens
  misc_feature: GYAE6OF02HJ0TI.45.78.H01.1.454.CMB.1.raw
  modified_base (284)..(284): a, c, t, g, unknown or other
  misc_feature (284)..(284): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgagcgngaagactcgtagacgacacggccgtgtatactgtgcgagaggcaggtaattacgtagttttggagttggttacgttcggtacgtagtggtacgtcgtcgggacaacgggtacctacggtcgaccgtcgtccgtcacgcctaccgaccgaacggcccacgtccgtaccttccccgtcggccctaccctcccgtccaacgtacgaccgtacctcgtcggggacacgaccgcccggtccgtcggtctcgccgttcggacgtacggtactaccgttccgtacgtctccgtacgtcgtacggtcggtccggtgtaccggg

SEQ ID NO: 129258 - DNA, 492 bp, Homo sapiens
  misc_feature: GYAE6OF02ITQOS.45.78.H01.1.454.CMB.1.raw
  modified_base (286)..(286): a, c, t, g, unknown or other
  misc_feature (286)..(286): n is a, c, g, or t
  modified_base (413)..(413): a, c, t, g, unknown or other
  misc_feature (413)..(413): n is a, c, g, or t
  modified_base (417)..(417): a, c, t, g, unknown or other
  misc_feature (417)..(417): n is a, c, g, or t
  modified_base (435)..(435): a, c, t, g, unknown or other
  misc_feature (435)..(435): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctgggctgaggtgaagaagcctggggcctcagtgaaggtctcctgcaaggcttctggatacaccttcaccggctactatatacactgggtncgacaggccctggacaagggcttgagtggatgggatggatcaaccctaacaatggtggcacaaactatgacacagaagtttcagggcagggtcaccagtgacgaggacacgtcatcagcacagctantganctgagcgaagctagagtntactgacgacacgcgtagtatactgtgcgagaggcgagtaatacgtattttggaagg

SEQ ID NO: 129259 - DNA, 683 bp, Homo sapiens
  misc_feature: GYAE6OF02GZ8P4.45.78.H01.1.454.CMB.1.raw
  modified_base (435)..(435): a, c, t, g, unknown or other
  misc_feature (435)..(435): n is a, c, g, or t
  modified_base (596)..(596): a, c, t, g, unknown or other
  misc_feature (596)..(596): n is a, c, g, or t
  modified_base (634)..(634): a, c, t, g, unknown or other
  misc_feature (634)..(634): n is a, c, g, or t
tcagacgcgatcgacacgaccggtgctcgatttagtgtgagtagtttgggtttgggggaggcgatcacccagcaaccacatctgtcctctagagaatcccctgagagctccgttcctcaccatggactggacctggaggatcctcttcttggtggcagcagccacgaggacgcccactcccgaggtcgcgagccgtggtgcagtcgtggggctgaggtgaagaagccgtgggcctcgagtgaggtctcctgcaaggcttcgtaggactacaccttcgaaccggctaacttatactactacgtggggtacaccgaacgtacccgggcccctagggaaccaacggggtcctttagggacgtgggtaagtggggacggttgggaactaccgaaacccgtaaaacgtaaggttggggtacgaaccgaactaaaaccgtnttcgggacaaacgtaaggtaacgtttacggaacgggcggaacgggtaccaaacgtagtcgggaaaccgtaacgggacgtactaaccgatacaacggtcaacgacgacccttaacgaagtcgggtaaccgtcgaaggacgtaccggaggccgtaggagtacncggtacgaacggaccgacgggtcgtacgtacgttacgnggtaccgaggtacgagtcgaaagaacgtttacggttagtttggtaacgg

SEQ ID NO: 129260 - DNA, 676 bp, Homo sapiens
  misc_feature: GYAE6OF02GLE96.45.78.H01.1.454.CMB.1.raw
tcagacgcgatcgacacgaccggtgctcgatttagtgtgagtagtttgggtttggggagagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagccgtggggcctcgagtgaaggtctcctgcaaggcttcgtggatacaccttcaccggctaactatatacactgggtgcgacgacggcccctggacgagggcttgagtggagtgggatggatccaaaccctaaacaagtgggtcgacaacaaactagtagacacaaggtaagtttcgaaggggtacgacgggtaccaaccgtagtacggtaacccggaaggggaacctaaccgggtaacctaacgtaccgaacggtacccgaaacgaccgtacccgtaacgtaacgtacgggacgtacgtagggaccggacgacgggtacgtacggaaaggtacgtacgttacgggaaccggtaaccggaccgggtaccggttaacggttaaccgtttacgtcgggttacggtaccgggaggtaacgggtacggaagggtttaacggtttaaccggtaggttttttaacgggg

SEQ ID NO: 129261 - DNA, 686 bp, Homo sapiens
  misc_feature: GYAE6OF02JYGEP.45.78.H01.1.454.CMB.1.raw
  modified_base (272)..(272): a, c, t, g, unknown or other
  misc_feature (272)..(272): n is a, c, g, or t
  modified_base (291)..(291): a, c, t, g, unknown or other
  misc_feature (291)..(291): n is a, c, g, or t
  modified_base (321)..(321): a, c, t, g, unknown or other
  misc_feature (321)..(321): n is a, c, g, or t
  modified_base (330)..(330): a, c, t, g, unknown or other
  misc_feature (330)..(330): n is a, c, g, or t
tcagacgcgatcgacacgaccggtgctcgatttagtgtgagtagtttgggtttgggtgaagaagcctggggcctcagtgaaggtctcctgcaaggcttctggatacaccttcaccggctactatatacactgggtgcgacaggcccctggacaagggcttgagtggatgggatggatcaacctaacaatggtggcacaaactatgcacagaagtttccagggcagggtcaccatgaccagggacacgtccatcagcacagcctacagtgganctgagctaggctagagtancgtgacgacgaccggccgtagtacttacgngtgacgagngcaggtattacggattttgggagtttggttagttccgggaaggtcgtgggtacgtcggttacggggacgtaacggggaccctacggggtcccacccggttactcccgtacgtccgtacccgttacccacccgtaaccggggacccctaacggttcccggtaccccgttcccccgtacggccccaccccgttccccaccgtaccggtacgacccgtaccgtacccggtcggggaccctacgaccgggtcccggacccggtcggcccgtcggaccgtcgggtacgtaaccggtaccgttaccgttacccgtcgtaaccggtccggtccggtacgtcggacgggtccgggtctaccggg

SEQ ID NO: 129262 - DNA, 607 bp, Homo sapiens
  misc_feature: GYAE6OF02I4D1Y.45.78.H01.1.454.CMB.1.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctcctgcaaggcttctggatacaccttcgaccggctactatatacactgggtgcgacacggcccctggacgaagggcttgaggtggagtgggatggatacaaacctaacaagtgggtacggacaacaaaactagtagacaacgaagtaacggtttcgaaggggcgtaaggggtccaaccgaagtacggaacccgaggggaacctaccggtaccataccgaacgaccgaacacggtaccctaacacgtggaacgtcgtaggacgcgaagggcgtagaagtacgtcgtagacgacgaccggccgttagttaacttacgtggtaggacgaaggacggactaagggtaactttacggttacggttttggtaacgg

SEQ ID NO: 129263 - DNA, 559 bp, Homo sapiens
  misc_feature: GYAE6OF02J22IF.45.78.H01.1.454.CMB.1.raw
  modified_base (271)..(271): a, c, t, g, unknown or other
  misc_feature (271)..(271): n is a, c, g, or t
  modified_base (318)..(318): a, c, t, g, unknown or other
  misc_feature (318)..(318): n is a, c, g, or t
  modified_base (554)..(554): a, c, t, g, unknown or other
  misc_feature (554)..(554): n is a, c, g, or t
tcagacgcgatcgacacgaccggtgctcgatttagtgtgagtagttgggtttgggtgaagaagcctgggcctcagtgaaggtctcctgcaaggcttctggatacaccttcaccggctactatatacactgggtgcgacaggcccctggataagggcttgagtggatgggatggatcaaccctaacaatggtggcacaaactatgcacagaagtttcagggcagggtcaccatgaccagggacacgtccatcagcacagcctacatcgggancctgagccgaggctggagaatcgtgacgacacggcccgtgtattacnggtgcgaggaggcaggaattacggattttggaggttggttagttcggacggttatcgggacgtcgtggggaccgaagggccacggtcgacgtcgtccgtacacgccgtaccaccgacggccagtccgtccttccctcgccgaccctcaccacgacgccaccgtcgtccgggcacgacggccgcgtcggctcgccgtgtcgaacggtactcgtcctcgactcgacgtcgtgcgcggntacgg

SEQ ID NO: 129264 - DNA, 500 bp, Homo sapiens
  misc_feature: GYAE6OF02GTTEE.45.78.H01.1.454.CMB.1.raw
  modified_base (276)..(276): a, c, t, g, unknown or other
  misc_feature (276)..(276): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtaactggttggcctggtatcagcagaaaccagggaaaancccctaaagctcctgctctataaggcatctagtttagaaagtggggtcccatcaaggttcagcggcagtggatctgggacagaattcactctcaccatcagcagcctgcagcctgatgattttgctaacttattactgccaaacagtatgatagttattcgacgttcgccaagggaccaaggtggaaatcgaaaacgaactgtggctgcaccatctgtctctac

SEQ ID NO: 129265 - DNA, 598 bp, Homo sapiens
  misc_feature: GYAE6OF02I4RF3.45.78.H01.1.454.CMB.1.raw
  modified_base (435)..(435): a, c, t, g, unknown or other
  misc_feature (435)..(435): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccaaaatgacccagtctccttccaccctgtctgcatctgtaggagacagagtcaccatcacttgccgggccagtcagagtatagtaactggtggctggtatcagcagaaaccagggaaacgcccctaaagctcctgctactataaggcatctagtttaagaaagtcggggtccctatcaaggttcagcggacagtggatcgtagggacagaattcactctcaccatacagcacgcctgcagcctgatgtattttgacctaactttaattactagacctaaanagtatagtattaagtttaagttacgtacgtttacgggaccgtaaacgggtaaccgtaaagggtaggtaaaacgtaccgtaaaacggtaaacgttacggtagggtaccgttagacccgtaacctacgttaccgttcggtttacctttacgtaaccgtttccccg

SEQ ID NO: 129266 - DNA, 583 bp, Homo sapiens
  misc_feature: GYAE6OF02HHZYN.45.78.H01.1.454.CMB.1.raw
  modified_base (343)..(343): a, c, t, g, unknown or other
  misc_feature (343)..(343): n is a, c, g, or t
tcagacgcgatcgacacgaccggtgctcgatttagtgtgagtagtttgggtttggggacccagcaaccacatctgtcctctagagaatcccctgagagctccgttcctcaccatggactggacctggaggatcctcttcttggtggcagcagccacaggagcccactcccaggtgcagctggtgcagtctggggctggaggtgaagaagccgtggggcctcagtgaaggtctcctgcaaggcttcgtggatacaccttcgaccggctactatatacacgtgggtgcgacacggcccctgggacgaagggcttggagtggatgggatggataccaaaccctaanaagtggtggacaacaaacgtatagacacgaagtaagtttcgagggacagggtccaaccgagtacgaccgaagggacctaacggtaccagtacgagaccacgaacgaccctaacgagtacgggagcgtgacgcgaggcctagacgatcgtacgacgacgcggtaccgtagttattacgtgtggacggaggaggacgaaggtaagttacggttagtttggaggtttggttagtcggtaacgg

SEQ ID NO: 129267 - DNA, 557 bp, Homo sapiens
  misc_feature: GYAE6OF02HAVOL.45.78.H01.1.454.CMB.1.raw
  modified_base (288)..(288): a, c, t, g, unknown or other
  misc_feature (288)..(288): n is a, c, g, or t
  modified_base (357)..(357): a, c, t, g, unknown or other
  misc_feature (357)..(357): n is a, c, g, or t
  modified_base (363)..(363): a, c, t, g, unknown or other
  misc_feature (363)..(363): n is a, c, g, or t
  modified_base (370)..(370): a, c, t, g, unknown or other
  misc_feature (370)..(370): n is a, c, g, or t
  modified_base (380)..(380): a, c, t, g, unknown or other
  misc_feature (380)..(380): n is a, c, g, or t
  modified_base (399)..(399): a, c, t, g, unknown or other
  misc_feature (399)..(399): n is a, c, g, or t
tcagacgcgatcgacacgaccggtgctcgatttagtgtgagtagtttgggtttgggggagtcagacccagtcaggacacagcatggacatgagggtccccgctcagctcctgggctcctgctgctctggctcccaggtgccaaatgtgacatccagatgacccagtcctccttccaccctgtctgcatctgtaggagacagagtcaccatcacttgccggcagtcagagtatagtaactggtgcctggtatcagcaagaaacaggaaacgccctaagctctgctctanaggctatctagttagaaggtcggtaccagtcaaggttcagcggcagtgatcgtaggacagtatcactcncacatnagcagcngcagctgatntattgacttaacttatacncgaccaagtacgtagtacgtaattacgtttattacggtaccgtttaccggaaacgtaacggggaaccgtaaggggttacgaaaacttaccgaaaacggtacgtagggtaacgtaccgtagaccctaacgtacgttcctttggttaccttaccgtaccg

SEQ ID NO: 129268 - DNA, 583 bp, Homo sapiens
  misc_feature: GYAE6OF02HRCKR.45.78.H01.1.454.CMB.1.raw
  modified_base (188)..(188): a, c, t, g, unknown or other
  misc_feature (188)..(188): n is a, c, g, or t
  modified_base (275)..(275): a, c, t, g, unknown or other
  misc_feature (275)..(275): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaanaatggtgcacaaactatgcacagtaagtttcagggcagggtcaccatgaccgagggaccacgtccagtcagcacagcctacatgganctgagcgaggctgagatctgacgacgacggccgtgtatactgtgcgagaggcaggtaattacgtagttttggagttgttatggacgtagtggacgtcgtggggaccgaacgggaccacggtcgaccgtcctctcacgcctccaccgacggcccagtccggtccttccccgtgccctaccctcctccaaacgcgacccacccgttcggacggggccacgcggcccggccgtcgggtcctcgtccgtaggttaaccggcttaccgttccgtcgtactcggtcgtcgtacggacggcggtcgtggaaccgg

SEQ ID NO: 129269 - DNA, 526 bp, Homo sapiens
  misc_feature: GYAE6OF02HMZTX.45.78.H01.1.454.CMB.1.raw
  modified_base (197)..(197): a, c, t, g, unknown or other
  misc_feature (197)..(197): n is a, c, g, or t
  modified_base (275)..(275): a, c, t, g, unknown or other
  misc_feature (275)..(275): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtagganacagagtcaccatcacttgccgggccagtcagagtattagtaactggttggcctggtatcagcagaaaccagggaaanccctaagctcctgctctataaggcatctagttagaaagtgggtccatcaaggttcagcggcagtggatcgtgggacagaattcactctcacatcaagcagcctgcagtcctagatgtattttgacttaacttattactacgaccaatagtatagtattagttacttacgtacgttcggacgaagggaccaaggtacgaaatacgaaaacgtactgtacggctagaccacctatccgtatccgttactaccg

SEQ ID NO: 129270 - DNA, 511 bp, Homo sapiens
  misc_feature: GYAE6OF02G00SC.45.78.H01.1.454.CMB.1.raw
  modified_base (420)..(420): a, c, t, g, unknown or other
  misc_feature (420)..(420): n is a, c, g, or t
  modified_base (435)..(435): a, c, t, g, unknown or other
  misc_feature (435)..(435): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcacatgaccagggacacgtcatcagcacagcctacatgganctgagcgagctgagntcgtagacgacacggtaccgtgttaacttacgtgtacgcgaggaggcgaaggtaacttacggtattttggtaaggg

SEQ ID NO: 129271 - DNA, 579 bp, Homo sapiens
  misc_feature: GYAE6OF02JDJRQ.45.78.H01.1.454.CMB.1.raw
  modified_base (244)..(244): a, c, t, g, unknown or other
  misc_feature (244)..(244): n is a, c, g, or t
  modified_base (415)..(415): a, c, t, g, unknown or other
  misc_feature (415)..(415): n is a, c, g, or t
tcagacgcgatcgacacgaccggtgctcgatttagtgtgagtagtttgggtttggggacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttcnggatacaccttcaccggctactatatacactgggtgcgacaggcccctggacaagggcttgaggtggatgggatggatcaacctaacaatggtgcacaaactatgacacagtaagtttcgagggcagggtcacagtgaccgagggacacgtccatcagacacacgacctanataggagcgtagagcgaggctaggagagtcgtacggtaaccgacgaaccgggtccgttagttacgtttacgtggtacggacggtaaggacgggacgtaacggttaacgtttacggttaggtttttacgggtagggtttacggttttaggttacgggttaacggg

SEQ ID NO: 129272 - DNA, 699 bp, Homo sapiens
  misc_feature: GYAE6OF02IJ9VY.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggccccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacgacggccgtgtattactgtgcgagaggcaggattacgtatttttaggagttggttattcggtacggttagtggacgtcgtggggccgaagggaccgacggtcaccgtctcctcgacgtccctccgaaccgaacgggccccacgtcccgggttcccttcccccgtacggtccctaccccgttccctacccgaacggacgtcccaacccgttccggtacggggggcccaaccggacgggtaccccggggtccccgttacgggggccgttaccgggtccccggttcggggtaaccgtaaaccgggttaaccccgttacccgtttaccccgttaccccggtaacggtttcccgggtccccggtttccggttaccgggacgggttcccggggtccgtaacccggggg

SEQ ID NO: 129273 - DNA, 722 bp, Homo sapiens
  misc_feature: GYAE6OF02JJG9X.45.78.H01.1.454.CMB.1.raw
  modified_base (106)..(106): a, c, t, g, unknown or other
  misc_feature (106)..(106): n is a, c, g, or t
  modified_base (178)..(178): a, c, t, g, unknown or other
  misc_feature (178)..(178): n is a, c, g, or t
  modified_base (329)..(329): a, c, t, g, unknown or other
  misc_feature (329)..(329): n is a, c, g, or t
tcagacgcgatcgacacgaccggtgctcgattagtgtgagtagttgggtttggggtgaagaagcctggggccgtcagtgaaggtctcctgcaaggcttctggatanaccttcaccggctactatatacactgggtgcgacaggcccctggacaagggcttgagtggatgggatggatnaaccctaacaatggtggcacgaaactatgcacagaagtttcagggcagggtcaccatgaccagggacacgtccatcagcacacgacctacatggaacgctagagcgaggctgagatcgtagacgacgacgccgtgtattacgtgtgcgagnggacgaggaattacggtacttttagggagttaggttacgttacgggaacggttagtagggtacggttacggttcgggggaccgtaacgggggtaccctaacgggggttacccgtaccgggtccgttacccgtacgtaaccggtaccctacccggaaccgtaaccggggaccccgtacggtaccggttcccgttaccccgtcgggtaccccgacccccgttcctacccggaaacggtcccgtaccgacccgttaccgggtaccgggggactacccggacggtacccggcccggttaccgggccgttccggccgtcgggtaccgaaccgggtacgttacccgtccgttaccgacgtccggaccggttccgacgggtaccggtcgggtcgtacggg

SEQ ID NO: 129274 - DNA, 559 bp, Homo sapiens
  misc_feature: GYAE6OF02JBRK4.45.78.H01.1.454.CMB.1.raw
  modified_base (343)..(343): a, c, t, g, unknown or other
  misc_feature (343)..(343): n is a, c, g, or t
tcagacgcgatcgacacgaccggtgctcgatttagtgtgagtagtttgggtttggggagagcatcacccagcaaccacatctgtcctctagagaatcccctgagagctccgttcctcaccatggactggacctggaggatcctcttcttggtggcagcagccacaggagcccactcccaggtgcagctggtgcagtctggggctggaggtgaagagccgtggggcctcagtgaggtctcctgcaaggcttctggatacaccttcaccggctactatatacactgggtgcgacacggcccctggacaagggtcttgaagtggagtgggatggatcaaacctaanagtggtaggacaacgaactagtgacacaagtaagttcgaggcgaggtcacagtcgacgaggacacgtcagtcagcacgacgccaagagtggagtacgtagaggacgaggtcgtagaagacgttcgtaacgaccgtacgaccgggtccgtagttacgttacgtaggtacggacggacggaggtacggaacggtacgtttaacggttgttttaagggg

SEQ ID NO: 129275 - DNA, 587 bp, Homo sapiens
  misc_feature: GYAE6OF02HN9H8.45.78.H01.1.454.CMB.1.raw
  modified_base (271)..(271): a, c, t, g, unknown or other
  misc_feature (271)..(271): n is a, c, g, or t
tcagacgcgatcgacacgaccggtgctcgatttagtgtgagtagtttgggtttgggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccggcagtcagagtattagtactggttgctggtatcagcaagaaaccgagggaaacncccctaagctctgctctataaggcatctagtttaagaaggtcgggtaccatacgaaggttcaggcggacaggtggatcgtagggacaagtattcactctacaccatcagcacgcctgacacgtcctgattgtattttcgacttaactttattactcgacctaactagttatagtaattagtttacgttacggtacggttaccggaaccggaaacgggaaccgtaagggtacggaaacgttaaccgaaaacggtaacgttcggtacggtcctacgacctaacctacgttccttacgttacctttactactttccccg

SEQ ID NO: 129276 - DNA, 545 bp, Homo sapiens
  misc_feature: GYAE6OF02GMOUQ.45.78.H01.1.454.CMB.1.raw
  modified_base (437)..(437): a, c, t, g, unknown or other
  misc_feature (437)..(437): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacacgtgggtgcgacacggcccctggacaagggcttgagtggagtgggatggatcaacctaacagtggtgacacaaactatcgacacgaagtaacgtttacgagggacgagggtccaccgagtcgaacgagggacacgtccatcgacgcacgacacctanagtggacgcgtagagcgaggctgaagatcgagaaccgacgaccggtccgtagttacgttacgtgtcggcgaggacggcgaaggtaacgttacgttaggtttggtacgg

SEQ ID NO: 129277 - DNA, 542 bp, Homo sapiens
  misc_feature: GYAE6OF02HHI42.45.78.H01.1.454.CMB.1.raw
  modified_base (447)..(447): a, c, t, g, unknown or other
  misc_feature (447)..(447): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtatactgtgcgagaggcaggaattacgattttggagtggttattcggacggtatggacgtcgtggggccaagggccacggtcaccgtcctcctcagcctccaccaacgggcccatccggtcttcccccgtggccaccctccnccaagacgccacctcgcgggggccacgacgcggccctgggctcgccgtggtcgaacggactaccgttcctcgatcgcgtctggacgcgggctcgg

SEQ ID NO: 129278 - DNA, 603 bp, Homo sapiens
  misc_feature: GYAE6OF02F4E89.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgattttggagtggttattcggacggtatggacgtctggggccaaggggaccacggtcaccgtctcctcacgcctccgaccaagggcccagtccggtccttcccccgtggccaccctccctaccaacgtacgcctacctccgtcgggggccaccgacggccggaccccgtcggggcctcggcccgtcgggtccgtaacgggaacctttaccgttacccgtccggtacgttaccggtccggttaccgttggaccggtccgggtcgtaccgggg

SEQ ID NO: 129279 - DNA, 514 bp, Homo sapiens
  misc_feature: GYAE6OF02HVPXJ.45.78.H01.1.454.CMB.1.raw
  modified_base (338)..(338): a, c, t, g, unknown or other
  misc_feature (338)..(338): n is a, c, g, or t
  modified_base (494)..(494): a, c, t, g, unknown or other
  misc_feature (494)..(494): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgcccgggcagtcagagtattagtaactggttggcctggtatcagcagaaaccagggaaagcccctaagctcctgctctataaggcatctagtttagaaagtggggtccatcaaggttcagcgnagtgatctgggacagaattcactctcacatcagcagcctgcagcctgatgatttgctaacttattactgcctaacagtatagatagttagttcgtacgttcggaccaagggacctaagggtagaactacgaaacgtaactagtaggactgaacctntaccgtatcgttcattcccg

SEQ ID NO: 129280 - DNA, 615 bp, Homo sapiens
  misc_feature: GYAE6OF02F1XBH.45.78.H01.1.454.CMB.1.raw
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgcccgggccagtcagagtattagtaactggttggcctggtatcagcagaaaccgagggaagcccctaagctcctgctctataggcatctagtttagaaagtggggtccatcgaaggttcagcggcagtggatcgtgggactagaattcaactactaaccatcagcagcctgcacgtcctgtatgtagtttcgactaactttacttactagaccctaaatagttatagtaactttagtttaacgtttaccggtaccggtttaccgggaccgtaaaacggggaaccgtaaaggggttacggaaacttaaccgaaaaaccggtaacgttacgggttaacggtaccgttacggaccctaaccgtacttaccgttacgtttcctttaccgtaacctttcccccgg

SEQ ID NO: 129281 - DNA, 528 bp, Homo sapiens
  misc_feature: GYAE6OF02HJR2R.45.78.H01.1.454.CMB.1.raw
  modified_base (415)..(415): a, c, t, g, unknown or other
  misc_feature (415)..(415): n is a, c, g, or t
  modified_base (423)..(423): a, c, t, g, unknown or other
  misc_feature (423)..(423): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggcttgagtggatgggatggatacaaccctaacaatggtggcacaaactatgacacagaagttcgagggcaggggtcaccgatcgaccgaggacacgtccatcagcacncgacctanagtggatcgtagacgacgagggctagacgtatcgtagacgacgacggtcgtagttattcgtgtcgacggagacggactaggtaattacgttagttttaggtacgg

SEQ ID NO: 129282 - DNA, 679 bp, Homo sapiens
  misc_feature: GYAE6OF02JVS27.45.78.H01.1.454.CMB.1.raw
tcagacgcgatcgacacgaccggtgctcgatttagtgtgagtagtttgggtttgggggtagcgatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctcctgcaaggcttctggatacaccttcaccggtctacgtatatacacgtggtcgcgacgacggtcccctggacgaagggcttggaggtcggtagtgggagtaggataccgaaacctaaacaagttcgggtggacctaaccgaaaactacttaggaccgaacgaagtaaacggtttcgaacggggtaccaacggggttccaaccgacgttacgggaaaccggacggggtaaccaccggttaccgaatcccgaaagtccggaaactaccggtcccgtaaaccgtagtacgggaacgtacgtacgggtacaacgacgggacgtggaacgtattaccggacggaaccgtcggacccggtcggttacgttaacgttacgttacgggtacgacggtacgggaacggcgtaagggtaacgtttaacggttagttttagggtaacggg

SEQ ID NO: 129283 - DNA, 537 bp, Homo sapiens
  misc_feature: GYAE6OF02FW4ZJ.45.78.H01.1.454.CMB.1.raw
  modified_base (533)..(533): a, c, t, g, unknown or other
  misc_feature (533)..(533): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgatttttggagtggttattcggacggtatggacgtcgtggggccaaggggaccacggtcaccgtctcctcagcctccaccaagggcccatcggtccttcccccgtggccacccctcctccaagacgccacctcgtgggggctacagccggccctgggctgccgtggcaaggcctactcctcgactcgcgtctgacgcgggntcgg

SEQ ID NO: 129284 - DNA, 545 bp, Homo sapiens
  misc_feature: GYAE6OF02F93JH.45.78.H01.1.454.CMB.1.raw
  modified_base (252)..(252): a, c, t, g, unknown or other
  misc_feature (252)..(252): n is a, c, g, or t
  modified_base (288)..(288): a, c, t, g, unknown or other
  misc_feature (288)..(288): n is a, c, g, or t
  modified_base (428)..(428): a, c, t, g, unknown or other
  misc_feature (428)..(428): n is a, c, g, or t
  modified_base (432)..(432): a, c, t, g, unknown or other
  misc_feature (432)..(432): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcgagtgaaggtctcctgcaggcttcnggatacaccttcaccggctactatatacactgggtncgacacggcccctggacgaagggcttggagtggagtgggatggataccaaccctaacaagtggtacgacaacaaactatgacaacgagtaagtttcgagggcgaggtcactatacgacgaggacacgtcatcagcacacnctangtggagcgtgagcgaggctagagtacgtcgtacgacgaccgacgtccgttaggtacttacgttgtcgacggtagacggagaaggtaacgtttacggttagttttagggtacgg

SEQ ID NO: 129285 - DNA, 638 bp, Homo sapiens
  misc_feature: GYAE6OF02JMOFA.45.78.H01.1.454.CMB.1.raw
  modified_base (251)..(251): a, c, t, g, unknown or other
  misc_feature (251)..(251): n is a, c, g, or t
  modified_base (346)..(346): a, c, t, g, unknown or other
  misc_feature (346)..(346): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctggaggtgaagaagccgtggggcctcagtgaaggtctctgcaggcttcnggatacgaccttcgaaccggctactatatacacgtgggtgcgacaggccccgtaggacgaaggcttgagtggagtgggagtggatcaaccgtaanaagtggtggacaacgaaactatgacaacgtacggtaagtttcgaacggggcgtacgggtacgtaccgacgtacggaaccgtaacgggaccgtaaccggtaccctaacgtaccgacgaccgaacgacgacctaaccgagtaggacgacgtaggacgacgtacgggacgtacgggaagtacgtacgttacggaacgaccgtaccgggtccggtacggttaacgttacgtacgggtgtaccggtaggacgggtacgtaaggtaacggtttaacggttaggttttacggttaaggg

SEQ ID NO: 129286 - DNA, 538 bp, Homo sapiens
  misc_feature: GYAE6OF02IDOJ3.45.78.H01.1.454.CMB.1.raw
  modified_base (339)..(339): a, c, t, g, unknown or other
  misc_feature (339)..(339): n is a, c, g, or t
  modified_base (342)..(342): a, c, t, g, unknown or other
  misc_feature (342)..(342): n is a, c, g, or t
  modified_base (352)..(352): a, c, t, g, unknown or other
  misc_feature (352)..(352): n is a, c, g, or t
  modified_base (366)..(366): a, c, t, g, unknown or other
  misc_feature (366)..(366): n is a, c, g, or t
  modified_base (373)..(373): a, c, t, g, unknown or other
  misc_feature (373)..(373): n is a, c, g, or t
  modified_base (380)..(380): a, c, t, g, unknown or other
  misc_feature (380)..(380): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtaactggttggcctggtatcagcagaaaccagggaaacgcccctaagcctcctgctctataaggcatctagtttagaagtgggtaccatcaaggttcagcgnagngatcgtgganagatcactctcacntcagcancctgcancctgatcgtattttcgacttaactttattacctgaccaactagtactagattagttattcgtaccgttcggtaccgaagggtaccgaaggtaggaaacttacgaaacggtaacgttgtacggtacctagaccgaacctattccgtcgttcctagtacc

SEQ ID NO: 129287 - DNA, 598 bp, Homo sapiens
  misc_feature: GYAE6OF02H1RK8.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcggagaggcaggaattacggtatttttgggagttggttagttcgggtacggtagtgggacgttcgtggggaccgaagggaccgacggtcgtaccgtctcctcacgccctccgaccgaacggcccacgtccgtccttcccccgtcggcccaccctcctcccaacgacgccaccgtccgtcggggcaccgacgccggcccgtcgggcctcggccgtcggtccgaacggacctaccgttccctaccggtacgtccggtcgtcgttacggacggtccgggcgtcggg

SEQ ID NO: 129288 - DNA, 795 bp, Homo sapiens
  misc_feature: GYAE6OF02FO6P9.45.78.H01.1.454.CMB.1.raw
  modified_base (197)..(197): a, c, t, g, unknown or other
  misc_feature (197)..(197): n is a, c, g, or t
  modified_base (284)..(284): a, c, t, g, unknown or other
  misc_feature (284)..(284): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtagganacgagacgtcaccatccacttcgccgggccagtcagtagtattagtaactggttcggcctggtatcagacagaaaccgagggaaacnccctaagctcctggcctactagtaacggcactacttaagtttaaggaaacggttcggggtacccctaagttaccgtaacggttccgaaacggtccgggtaccaagggttacgggaactttaccggtaggggaacctaaggtaaacctttccgaacctttaccctacccgtaacccgtaacgttccgtaacggtaccgtaacggtacccgttacggacccgtaacggtacccgttaggtaacgtttacggttaacgtttttacgaaccgtttaaaccgttttaacgtttaaccgttaccggtaaccctaaacggtaaggttacgttaggttaacgtttaacggtttaacgttaccgttaaccgggtttaccggtaacccggtaaaccggggtaacccgttaagggtacggtaaaccgtaaccggtaaaaccggttaaaccgttgggtaccggttaccggttaccggtaccgttaaccgtacgttaccgttacgtttaccgttacttaacccg

SEQ ID NO: 129289 - DNA, 524 bp, Homo sapiens
  misc_feature: GYAE6OF02GH05D.45.78.H01.1.454.CMB.1.raw
  modified_base (368)..(368): a, c, t, g, unknown or other
  misc_feature (368)..(368): n is a, c, g, or t
  modified_base (415)..(415): a, c, t, g, unknown or other
  misc_feature (415)..(415): n is a, c, g, or t
  modified_base (421)..(421): a, c, t, g, unknown or other
  misc_feature (421)..(421): n is a, c, g, or t
tcagacgcgatcgacacgaccggtgctcgatttagtgtgagtagtttgggtttgggggagtcagacccagtcaggacacagcatggacatgagggtccccgctcagcctccgtggggctcctgctgctctggctcccaggtgccaaatgtgacatccagatcgacccagtcctccttcccaccctgtctgcatctgtaggagacagagtcaccatcacttgccgggccagtcagagtattagtaactggttggcctggtatcagcagaaaccagggaaacgcccctaagctcctgctctataaggcatctagttagaaggtgggtccatcaaggttcagcggcagtggatcgtggacagattcactcncaccatcagcagcctgcagcctgatgtatttgactaactttatactnaccaanagtatagtattagttacgttacgtacgttccggaccgtaacggaccgaagggtagaaactacgaaacgaacgtggtagtctgacacctatcttcgtctgtacc

SEQ ID NO: 129290 - DNA, 732 bp, Homo sapiens
  misc_feature: GYAE6OF02IARV7.45.78.H01.1.454.CMB.1.raw
  modified_base (263)..(263): a, c, t, g, unknown or other
  misc_feature (263)..(263): n is a, c, g, or t
tcagacgcgatcgacacgaccggtgctcgatttagtgtgagtagtttgggtttgggggagtcagacccactcaggacacagcatggacatgagggtccccgctcagctccgtggggctcctgctgctctggctcccaggtgccagatgtgccatccagatcgacccagtctccattcctccctgtctgctatcgtgtaggagacagtagttaccattaacgttgcggacaagtcaggatatagaatgagtagctagtatcagnagacgacggaggggaccaccccctaatcctagtcttagtcggtcgtcctttaccgaaggtttaacaaacgggtcgggtaccctagtaccgtaaggttcgaggtcgggtcggggttcggtacgtcggacacgtaaggtaacttccacgttcgtaccaacctagtccacggcccgtctaggacccgacggtacccgtaagtttacgttttaccgaacttaaacgttttaacttaacgttcgttaaccttaacgtaaaacgtttacttttaaccaaacccgtttaacccgtaccgggtaaacctacggtttacccggaacccggtaaacggggtaacccttaaacggtcgttaacgaacggtaaaccttaaccggaaaccggttaacggtcggttaccggtacttaccgacccgtaacttaccgtttcgttaccgtttacccttaccgttaaccgttccccgtttacccccg

SEQ ID NO: 129291 - DNA, 614 bp, Homo sapiens
  misc_feature: GYAE6OF02G7HCE.45.78.H01.1.454.CMB.1.raw
tcagacgcgatcgacacgaccggtgctcgatttagtgtgagtagtttgggtttgggggagagcatcacccagcaaccacatctgtcctctagagaatcccctgagagctccgttcctcaccatggactggacctggaggatcctcttcttggtggcagcagccacaggagcccactcccaggtgcagctggtgcagtctggggctggaggtgaagagccgtggggcctcgagtgaaggtctcctgcaaggcttctggatacaccttcaccggctactatatacactgggtgcgacacggcccctggacgaagggcttgagtggagtgggatggataccgaaaccctaacgaagtgggtacggacaactaaaactatacgacaacgaagtaacgtttacgagggtacgagggtaccaccgagtcggaaccgacgggacctacggtaccacgtacacgtccaacgacgaccctaacgacgtacgggacgcgtacggacgcgagggactaggagtactcgtagaaccgacgaccgggtaccggttaggttaacttacggtggtacggacggacggacgggtacgtaagggttaacgtttacggttagttttacgggg

SEQ ID NO: 129292 - DNA, 547 bp, Homo sapiens
  misc_feature: GYAE6OF02H8QGU.45.78.H01.1.454.CMB.1.raw
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtaactggttggcctggtatcagcagaaaccagggaaacgcccctaagctcctgctctataggcatcagtttagaagtgggtccatcaaggttcagcggacagtggatcgtagggacagaacttcactctcacatcagcagcctgcagctgatgatttgctaacttattactcgacctaacgtagtatagtattacgttagttcggtacgtttaccgggacgtaaacgggaccgtaaggtacggaaataaccgaaacggaaccttggtacggactagtacctacctagttacgttcgttcttacttaaccg

SEQ ID NO: 129293 - DNA, 581 bp, Homo sapiens
  misc_feature: GYAE6OF02HPCUO.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgattttggagttggtattcggacggtatggacgtcgtggggaccgaagggaccacggtccaccgtcgtcctcgacgccctcgaccgaacgggcccacgtccggtccgttcccccgtcggcctaccctcctccaacgacgccaccgtcgtcggggccacgacgccggccgtcgggctcgccgtcggtccgaacggtaccttacttcccgtcgtacgtcggccgttcgtcggacggtccgggtcgtacggg

SEQ ID NO: 129294 - DNA, 582 bp, Homo sapiens
  misc_feature: GYAE6OF02FZ757.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcacctgctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtatactgtgcgagaggcaggaattacgattttggagttggttattcgggacggtatggacgtcgtggggccaagggaccacggtccgaccgtctcctcgagccctccaccgaacgggcccatccggtccttcccccgtggccctaccctccctccaacgcgcacccgtcgtcggggcacgcgccggcctacgggcgtcgccgtcggtacgaacggaccttaccgttcccgtaccggtacgttccggtaccgttccgtacggacggtccgggtcccgg

SEQ ID NO: 129295 - DNA, 583 bp, Homo sapiens
  misc_feature: GYAE6OF02G8UTM.45.78.H01.1.454.CMB.1.raw
  modified_base (294)..(294): a, c, t, g, unknown or other
  misc_feature (294)..(294): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctgggaggatcctcttcttggtggcagcagccacaggagcccactcccaggtgcagctggtgcagtcgtgggctggaggtgaagaagccgtggggcctcgagtgaaggtctcgtgcaaggcttcgtggatactaccttcaccggctactatatacacgtgggtncgacacggccctggacgaaggctggagtaggagtgggatggactacaaacctaataagtggtaggacaactaaactatagacaacgtagtaagtttcgagggacgacgggtacaacgtagtacgaacgacgggaccacggtaccagtcgacgcaacgacgcctacgacgtggacgcgtagaacgcgacgcgtaagacgtactacgtcgaacgacgtaccggtcgtagttaagttacgtaggcgtacggagacgggacgtaaggtactttacggttaggtttggtaacgg

SEQ ID NO: 129296 - DNA, 540 bp, Homo sapiens
  misc_feature: GYAE6OF02J1RIQ.45.78.H01.1.454.CMB.1.raw
  modified_base (331)..(331): a, c, t, g, unknown or other
  misc_feature (331)..(331): n is a, c, g, or t
  modified_base (418)..(418): a, c, t, g, unknown or other
  misc_feature (418)..(418): n is a, c, g, or t
  modified_base (424)..(424): a, c, t, g, unknown or other
  misc_feature (424)..(424): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagctgggctcagtgaagtctctgcaggcttcgtggatacaccttcaccggctactatatacactggtgcgacacgccctggacaagggctgaatggactgggatggatcaaaccctaanaagtggtaggcaacaaactagtgacagagaagtttacagggcaggtacacatacgacgaggacacgtcatacagacacacgcacagngtacgngtagacgtcgagaccgtagagtactacgtcgacgacgacggacgttacggtaacttaacctggtacggacggaggacggacgtaagggtaatttacggttagttttaggtaacggg

SEQ ID NO: 129297 - DNA, 549 bp, Homo sapiens
  misc_feature: GYAE6OF02F556E.45.78.H01.1.454.CMB.1.raw
  modified_base (416)..(416): a, c, t, g, unknown or other
  misc_feature (416)..(416): n is a, c, g, or t
  modified_base (520)..(520): a, c, t, g, unknown or other
  misc_feature (520)..(520): n is a, c, g, or t
  modified_base (537)..(537): a, c, t, g, unknown or other
  misc_feature (537)..(537): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtatagtaacgtggttggcctggtatcagcagaaaccgagggaaacgccctaagctcctgctctataaggctatctagtttagaaagtcgggtccatcaaggttcaggcggcagtggatcgtgggacagattcactcacaccatcagcagtctgacacgcctgatagtattttcgactaaactttnttaacgtcgacctaaactagtatgtaattagtttacttcggaccggtttcggaccgaagggtaaccgaagggtacgaaactacgaaacggtaactgggtacggntcgaccaccattccgtntaccttataccg

SEQ ID NO: 129298 - DNA, 527 bp, Homo sapiens
  misc_feature: GYAE6OF02GGTU0.45.78.H01.1.454.CMB.1.raw
  modified_base (275)..(275): a, c, t, g, unknown or other
  misc_feature (275)..(275): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtaactggttggcctggtatcagcagaaaccagggaaancccctaagctcctgctctataaggcatctagtttagaaagtgggtcccatcaaggttcagcggcagtggatcgtgggacagaattcactctcaccatcagcagcctgcagcctgatgtattttgactaactttattactgaccaagagttatagtattagttattccggacgttcggaccgaagggaccaagggtagaaatacgaaaacgacgttggtacggtctgaccacgtactcgtcgtacttctaccg

SEQ ID NO: 129299 - DNA, 545 bp, Homo sapiens
  misc_feature: GYAE6OF02GHCXK.45.78.H01.1.454.CMB.1.raw
  modified_base (385)..(385): a, c, t, g, unknown or other
  misc_feature (385)..(385): n is a, c, g, or t
  modified_base (396)..(396): a, c, t, g, unknown or other
  misc_feature (396)..(396): n is a, c, g, or t
  modified_base (535)..(535): a, c, t, g, unknown or other
  misc_feature (535)..(535): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctcccttccaccctgtctgcatctgtaggagacagagtcaccatcacttgccgggccagtcagagtattagtaactggttggcctggtatcagcaagaaaccgaggggaaacgccccctaagctcctgctactataaggcatctaagtttagaaagtcggggtccatcaaggttcaggcggcagtgatcgtgggacagaattcactctacaccatacngcacgctgcancctagatgtattttcgactaactttacttactcgacctaactagttatagtacttagtttacttcggtaacgttccggacgaaacgggaccgtaagggtagaataccgaaacgtacgtaggtggactgaccactatctnttcttctacc

SEQ ID NO: 129300 - DNA, 626 bp, Homo sapiens
  misc_feature: GYAE6OF02G816I.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggccccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattacgtgtgcgagtaggcaggaattacgtagtttttggagttggttagttcggacggtagtcggacgtcgtggggaccgaaggggacccgacggtccaccgtctccctcgacgccctcccaccgaacgggcccacgttccggtcccttcccccgtggcccacccctcctacccaacgaccgccaccgtcggtcgggggaccacgacggccggtacccgtgggtcctcggtcccgtacgggtcgtaacgggaccttacccgttcccgttaccgacgttccggccggttccgtcggtacgggtccgggtacgtaccgggg

SEQ ID NO: 129301 - DNA, 655 bp, Homo sapiens
  misc_feature: GYAE6OF02IPZQL.45.78.H01.1.454.CMB.1.raw
tcagacgcgatcgacacgaccggtgctcgatttagtgtgagtagtttgggtttggggggagcatcacccagcaaccacatctgtcctctagagaatcccctgagagctccgttcctcaccatggactggacctggaggatcctcttcttggtggcagcagccacaggagcccactcccaggtgcagctggtgcagtcgtgggctgaggtgaagaagccgtgggcctcagtgaaggtctcctgcaaggcttctggatacaccttcaccggctactatatacactgggtgcgacacggccctggacaagggcttggagtggagtgggatggataccaaccctaagaagtgggtaggacaacaaactagtacgacaactagaagttcgaaggggcgagggtacgaaccatacggaaccggaaggggacaacggtaccagtacgaacggaccaacgacgacctaacgaagttaggacggtaccgtaggaacggacgtacggggtcgtaacggaacgtacttacggtacggaacggaacccgtaccggggtcccggtttaaggttaaccgtttaccggtacgggttacggaccgggtaagggacgggtaacggtaagggttaaacgttttaaccggttaggttttttaagggtaacgggg

SEQ ID NO: 129302 - DNA, 576 bp, Homo sapiens
  misc_feature: GYAE6OF02HSHNN.45.78.H01.1.454.CMB.1.raw
  modified_base (276)..(276): a, c, t, g, unknown or other
  misc_feature (276)..(276): n is a, c, g, or t
  modified_base (366)..(366): a, c, t, g, unknown or other
  misc_feature (366)..(366): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtaacttggttggcctggtatcagcagaaaccagggaaancccctaagctcctgctctataaggcatctagtttagaaagtcggggtccatcaaggttcagcggcaggtgatctgggacagattcactcncacatcagcagcctgccagcctgatgtattttgactaaacttatttacgtcgacctaatagttaattgtaattaggttttaagtttacggtaccggtttacgggaccgtaaacggggaaccgtaagggttacggaaattaccgaaaacggtaacgttaggtacgggtactaggtaccgaacctagttaccgttcgttccttacttacccg

SEQ ID NO: 129303 - DNA, 536 bp, Homo sapiens
  misc_feature: GYAE6OF02I5QC6.45.78.H01.1.454.CMB.1.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacacggccccgtggacaaggggcttggagtggatgggatggatcaaccctaacaagtggtggcacaaactatgcacgagaagtttcgagggcacgggtcaccatgaaccgagggacacgtccatcagcacagcctaacagtggagcgagagcgaggctgaagcgtctgaccgacgacggcgtaggtacttacgtaggtcgacggaggacggacgaacggtaagttacggttaggtttttaggtaggg

SEQ ID NO: 129304 - DNA, 567 bp, Homo sapiens
  misc_feature: GYAE6OF02H74SF.45.78.H01.1.454.CMB.1.raw
  modified_base (397)..(397): a, c, t, g, unknown or other
  misc_feature (397)..(397): n is a, c, g, or t
  modified_base (410)..(410): a, c, t, g, unknown or other
  misc_feature (410)..(410): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacgttggcccggcagtcagagtattagtaactggttggccttggtatcagcaagaaaccagggaaagcccctaagctcctgctactataaggccatcgtagtttagaaaggtgggtcccatcaaggttcaggcgcagtggatcgtaggacagtaatcgactctacaccatcgagtcacgcctgacngcctagattagtntttcgacttaacttatactgaccctagtagttatagtaattagttacgttcgtacgttaccggaccggtaacgggaccgtaagggtacgtaaactacgaaaccggttacgtaggtacggtctacgcctacgtagttcgtacttaccgttctaacccg

SEQ ID NO: 129305 - DNA, 606 bp, Homo sapiens
  misc_feature: GYAE6OF02GYVHR.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgatttttggagtggttattcgggacggttatggacgtcgtggggccaagggaccacggtcaccgtctccgtcagccctccgaccaacgggcccagtccggtccttcccccgtggccctacccctcctacccgaacgcgaccacccgttcgtacgggggccaaccgcggcccgggtccccgtggggcctcggcccgttcgggtaccgaaagggtacccttaccgttcccgtcgtaacgtccggtccggttctcgggacggtccggggctacgggg

SEQ ID NO: 129306 - DNA, 561 bp, Homo sapiens
  misc_feature: GYAE6OF02JGQU7.45.78.H01.1.454.CMB.1.raw
  modified_base (276)..(276): a, c, t, g, unknown or other
  misc_feature (276)..(276): n is a, c, g, or t
  modified_base (347)..(347): a, c, t, g, unknown or other
  misc_feature (347)..(347): n is a, c, g, or t
  modified_base (451)..(451): a, c, t, g, unknown or other
  misc_feature (451)..(451): n is a, c, g, or t
  modified_base (554)..(554): a, c, t, g, unknown or other
  misc_feature (554)..(554): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctccaggtgccaaatgtgacatccagatgacccagtctccttccaccctgtctgcatctgtaggagacagagtcaccatcacttcgccgggccagtcagatatagtaacgtggttcgcctggtatcgagcaagaaccgagggaacnccctaagctacctgctactagaagctatctagtttaagaaggtcgggtaccatcgaaggttcaggccgganagtgactcgtagggacagtaacttcacgtctaccgactatcagcaacgcctgaccgtagctagactagtactttgactaactttagactcgaccaaatgtagtntaacgttagttagtccgtaacgttccggaacctaagggacctaagggttagaaaactcggaaaaccgtagtaggtacgctacgacgactgttacgtctttacncttaccg

SEQ ID NO: 129307 - DNA, 729 bp, Homo sapiens
  misc_feature: GYAE6OF02H1JZ1.45.78.H01.1.454.CMB.1.raw
tcagacgcgatcgacacgaccggtgctcgattagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagttcaggcaggtcaccatgaccagggacacgtccaatcagcacagtcctacagtgagctgaagcaggctagacgatcgtagaaccgacgacggtccgtgttatactggtgacggagaggacgaaggtaattacgtagtttttgggaagttggttaattcgggtaacggttaagtcgggtaaccggttcgtacgggggaccgtaaaacgggggtaccctacgggttacccgtaaccggtccgtttacccgtaccgaacgtccccgttaacccgaaccggtaaaccgggtcccctaacggttcccgggtaccctttccccccggtacggaccctaccccgttcccgtaccgaaacggaccgtacccgtaacccgttccgggtaccggggccacccggttaacgcccgggtcccgtacgggtccgtaccggtcccgtagggtaccgaaacggttaccttaccggttcccgtaccgtacgttccggtaccgttcgtaggaccgggtccggtacgtccggg

SEQ ID NO: 129308 - DNA, 609 bp, Homo sapiens
  misc_feature: GYAE6OF02FYBKI.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgaggctgagatctgacgacacggccgtgtattactgtgcgagaggcaggaattacgtagttttggagttggttattcggacggtatgggacgtcgtggggaccaagggtaccgacggtcgaccgtctcctcgacgcctaccaccgaacgggccctacgtccggttccttcccccgtcggtcctaccccgtcctacccaacgacgccacctcgtcggggaccacgacgccggtcccgtcgggcctcgtccgtacggtccgtaaaacgtaccgttacccgttcccgttacgtaaccgttcggccgttcgtcggaccggtcgggtctaccgggg

SEQ ID NO: 129309 - DNA, 600 bp, Homo sapiens
  misc_feature: GYAE6OF02GGJWP.45.78.H01.1.454.CMB.1.raw
  modified_base (281)..(281): a, c, t, g, unknown or other
  misc_feature (281)..(281): n is a, c, g, or t
  modified_base (308)..(308): a, c, t, g, unknown or other
  misc_feature (308)..(308): n is a, c, g, or t
  modified_base (378)..(378): a, c, t, g, unknown or other
  misc_feature (378)..(378): n is a, c, g, or t
tcagacgcgatcgacacgaccggtgctcgatttagtgtgagtagtttgggtttgggggtaggtcagacccagtcaggacacagcatggacatcgagggtccccgctcagctcctggggctcctgctgctctggctcccaggtgccaaatgtgacatccagatgacccagtctccttccaccctgtcttgcatctgtacggagacagagtcaccatcacttgccgggccagtcagagtattagtaactggttggcctggtatcagcaagaaaccagggaacncccctaagctcctgctctataagcatntagttagaacgtgggtccatcaaggtcagcggtgagtggatcgtagggacagtattcactctacacctancagcagcctgcagcctagatgtatttgacttaactttattactcgacctaacgtagttatacggtagtttaacgtttacgttaccggtaacgggtttcccggaaccgtaaacgggggtaacccgtaaaggggttacggaaaacttaccggtaaaaacggtaaccgttaggtaacgggtcttacggtacctaaccgtagttccgttacgttaccttactaccg

SEQ ID NO: 129310 - DNA, 574 bp, Homo sapiens
  misc_feature: GYAE6OF02IPV0J.45.78.H01.1.454.CMB.1.raw
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcacatcacttgccgggcagtcagagtattagtaacgtggttggcctggtatcagcaagaaaccgaggggaaacgacccctaagcctacctgcctactaataaggctatactagtttaagaaaggtcggggtaccatacgaaggttcaggcggcgagtggtatcgtaggacagtaattcactcacaccatcagcagcctgcagctgattgtatttgacctaatttactactgaccaagtagtatagtattagttacgttacgtacgttcggacgaaacgggtaccgtaagggtacgaaaactacgaaaacggtacgttagggtccggtactacggacctaccgtacgttcgtacgtttcctacttaacccg

SEQ ID NO: 129311 - DNA, 660 bp, Homo sapiens
  misc_feature: GYAE6OF02ID74B.45.78.H01.1.454.CMB.1.raw
  modified_base (401)..(401): a, c, t, g, unknown or other
  misc_feature (401)..(401): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcgagtgaaggtctccgtgcaaggtcttcgtggataccacctttccgaccggtcttaactatactacacgttgggtagccgacgacggccccgtaggaacgaagggtcttaggacggtggagtgggagtaggactaccgtaaaccgtaacgaaggtggtcggaccaacgtaaactanacgacaacgagttaacgttcggaagggcgtaacgggtacaacgtagtacgaaccgacgggtaaccaccgttaccagtccgaagtccaacgtacgaccttacgaaggtcggaacgtacgtacggacgacgtaacgggcttacggacgacgttacgacggtaaccgacggtaccgggtcgttacggtaacgtttacgtcgggtacgacggtaggacggtacgtaaggttaacgtttaccgttaggttttacgggtaacggg

SEQ ID NO: 129312 - DNA, 619 bp, Homo sapiens
  misc_feature: GYAE6OF02HVGN9.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatggggatggatcaaaccctaacaatggtggcacaaaactatgcacagaagtttcagggcagggtcaccatgaccagggacacgtccatcagcacagcctacatggagctgagcaggctgagatctgacgacacggccgtgtattactgtgcgagaggcaggattacgtattttggagttggttattcgggacggtatgggacgtcgtggggccgaaggggaccacggtcgaccgtctcctcgacgcctccaccgaacgggccctacgtccggtacccgttcccccgtcggcccacccctccctaccaacgacgccgaccctcgtcgggggccacgaccgccggcccgtagggtccgtcggcccgttcgggtaccgaacgggttacccttaccgttcccgtcggtaacgtccggtaccgttccgtacgggaccggtccggggcgtaccgggg

SEQ ID NO: 129313 - DNA, 713 bp, Homo sapiens
  misc_feature: GYAE6OF02I7LWB.45.78.H01.1.454.CMB.1.raw
  modified_base (248)..(248): a, c, t, g, unknown or other
  misc_feature (248)..(248): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggctcagtgaggtctctgcaggtcttntggatactacctcaccggctactatatacactgggtgcgacacggccctggacgtaaggccttaggacgtgggagtgggtagtggaacgtcaaacccgtaacgtaagtaggtcgggactaacctaaatacgtcgactaacgtaaacgtaacgggttttaccgaaggggtaccgtaacggggttaccgaaacccgtacggttaaccgggaaccggtaaacggggacccgtaaaccggtcccgtaaacgtccgaacggacttaaccgaccgacccgttaacgacggtacggtacgtacgtgaccgacgaaggtcccgtaggacgtaacgtaccgttaggaaccgtaccggtaccgggtaaccggtttacggtaacgtttaccgtaggggttacgaccgggttaacggaacgggtaaccgtaaaggggttaacccggtttaaggtttaccgttttagggttaacgggg

SEQ ID NO: 129314 - DNA, 581 bp, Homo sapiens
  misc_feature: GYAE6OF02GO7YE.45.78.H01.1.454.CMB.1.raw
  modified_base (457)..(457): a, c, t, g, unknown or other
  misc_feature (457)..(457): n is a, c, g, or t
tcagacgcgatcgacacgaccggtgctcgatttagtgtgagtagtttgggtttggggacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggcttgaggtggagtgggatggatcgaaccctaacaagtgggtggacacgaaactagtgacaacagtaacgtttcgaggggcaacggggtacaccgaagtcggaaccaaggggaccacgtccacgtacgacgacacgacgaccctaacagtggagcgngacgcgaggcgtaggacgtatcgtagacgaccgacggaccgtagtacttacgtgtcggcggaggacggacgaaggtaagttacgttaggttttaggaggttagggtttacgttcgggtaacggg

SEQ ID NO: 129315 - DNA, 541 bp, Homo sapiens
  misc_feature: GYAE6OF02FP7UQ.45.78.H01.1.454.CMB.1.raw
  modified_base (286)..(286): a, c, t, g, unknown or other
  misc_feature (286)..(286): n is a, c, g, or t
  modified_base (354)..(354): a, c, t, g, unknown or other
  misc_feature (354)..(354): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactggtncgacaggcccctggacaagggcttgagtggatgggatggatcaacctaacaatggtggacacaaactntgcacagtaagtttcgaggcagggtcacatgaccaggacacgtccatcagcacgagcctacagtggagcgtagagcgagaccgtagaacagtctagacgacgaccgaccgtatttaacgtttacctggtacggtcgtagggtacttcgggttttacccggtggtcgtttcggtttcctttttacggg

SEQ ID NO: 129316 - DNA, 581 bp, Homo sapiens
  misc_feature: GYAE6OF02I25T9.45.78.H01.1.454.CMB.1.raw
  modified_base (387)..(387): a, c, t, g, unknown or other
  misc_feature (387)..(387): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggcagtcagagtattagtaactggttggcctggtatcagcagaaaccagggaaagcccctaagcctcctgctctataaggcatctagttagaaagtcggggtcccatcaaggttcaggcgacgagtggatcgtgggacagtaattcactctcacatcagcagcctgcngacctgatagtatttagaacttaaatttacttactacgacctaaacgtattaagtgtactttaagtttacgttaccgtacggtttaccggacgaaacggggtaaccgtaagggtacggaaacttacgaaaacggtacgttagggttacggaccgttacggacctacgtaacgttcgtacggttcttactacccg

SEQ ID NO: 129317 - DNA, 625 bp, Homo sapiens
  misc_feature: GYAE6OF02JZYXR.45.78.H01.1.454.CMB.1.raw
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtaactggtgcctggtatcagcagaaaccagggaaacgccctaagctctgctctataggcatctagttagaaagtgggtaccatcaaggttcaggcggcaggtcgatcgtggacagtaatcactctcacatcgagcagcctagcagcctagtatacggtatttacggaccttaacgtttacttaccgtacgtaaccctaaagttaaggttattagttaagttttaacgtttaaccggtttaccggttaaaccgggttttaccggaaacccggtaaacgggggtaaacccgttaaaggggttaaccgggtaaaacgtttaaccggaaaacggttaaccgttgggtacgtacgttacggacctacgtaactcgttacgttcctacgttacc

SEQ ID NO: 129318 - DNA, 660 bp, Homo sapiens
  misc_feature: GYAE6OF02JS7GT.45.78.H01.1.454.CMB.1.raw
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcacatcacttcgccgggccagtcagagtattagtaacgtggttggctggtatcagcagaacgaggaacgccctaagctcctgctactataaggctagtactaagttagaaggttcggggtacccagtacgtaaggttcgaggtcggtacgtaggtaggacgttcggtagggaactaaggtaacgttctaccgtactccaacctactacgagaccacggtcctcggactacggtcctaggtactggttactttacggtaaccttaaactttacgttacgtaccgtaaccaacgttacgttagtagttaacgtttagttacgttaccggttacggttaccggaaccggtaaacgggtaacgtaagggtacgtaaacgtaacccgtaaacgggtaccttgggtaacgtaccttacggacccttaacggtcttaccggtttacttaccgttcttaacccg

SEQ ID NO: 129319 - DNA, 569 bp, Homo sapiens
  misc_feature: GYAE6OF02FYFYW.45.78.H01.1.454.CMB.1.raw
  modified_base (197)..(197): a, c, t, g, unknown or other
  misc_feature (197)..(197): n is a, c, g, or t
  modified_base (348)..(348): a, c, t, g, unknown or other
  misc_feature (348)..(348): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtagganacagagtcaccatcacttgcccgggccagtcagagtattagtaactggttgctgtatcagcagaaacgagggaaacgccctaagctcctgctctataaggcatctagtttagaaagtggggtacccatcgtaaggttcagcgacagtgatntggacagtatcactctacaccatcacgacacgtccgtagcgacgtcctagatgtattttcggaacttaactttaatttacctgacctaagtagttaatagaatttagtttacgttacgtacgttcggaccgaagggtacctaaagggtagaaactaacggaaaccgtaacgttggtaccggcgttacgaccacctaagttctacggttaccttacgttacc

SEQ ID NO: 129320 - DNA, 691 bp, Homo sapiens
  misc_feature: GYAE6OF02I2PWJ.45.78.H01.1.454.CMB.1.raw
  modified_base (204)..(204): a, c, t, g, unknown or other
  misc_feature (204)..(204): n is a, c, g, or t
tcagacgcgatcgacacgaccggtgctcgatttagtgtgagtagtttgggtttgggggagtcagacccagtcaggacacagcatggacatgacgggtccccgctcagctccgtggggcctcctgctgctctggcctcccaggtgaccaaatgtgacatccagatcgacccagtcctccttccaccctgtctgcatctgtagganacagagtcaccatcacgttcggcccgggccagtcaagagttattaagtacgtggttggcctaggtactcgagcaacgaaaccgaagggaaacgaccccgtaagcctcctcgtctactaagtaacggctacttacgttaaggtttaaggaagggttcggggtaccctagttaccgtaacgggttcgacggccggtacgtaggtacggagtacgtagggaactaaggtaacttacaccttcctaccgaacctacgtaccacgaccgacgtcccgttgaccgtacgtccgttaggtaagtttacgtacttttacgaactttaacttttacttaccgtacgacctaacgtagttataggtaagtttacgtttacgttaccggtacgttaccgggacgtaaacggggtaacgtaagggtacgtaaactaccggaaacgtacggttaggtcggtactcggacctaaccgattccgttcgttacttacctaccg

SEQ ID NO: 129321 - DNA, 570 bp, Homo sapiens
  misc_feature: GYAE6OF02IKZH2.45.78.H01.1.454.CMB.1.raw
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccggccagtcagagtattagtaactggttggcctggtatcagcagaaaccagggaaacgcccctaagctcctgctctataaggcatctagtttagaagtgggtccatcaaggttcagcgcagtggatcgtgggacagatcactctcacatcagcacgctgcagcctgatgtattttgacttaacttattaactcgtaccaactagtaactagtaattagtttacttacgtacgtttaccgggaccgtaaacgggtaaccgtaagggtaggaaaacgttaccgaaaacggtaacgttaggttacggtacgtacgacctaaccgtagttaccgttcggttacccttacgtaacccg

SEQ ID NO: 129322 - DNA, 535 bp, Homo sapiens
  misc_feature: GYAE6OF02IUW32.45.78.H01.1.454.CMB.1.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagcctgggcctcagtgaaggtctcctgcaaggcttctggatacaccttcaccggctactatatacactgggtgcgacgacggcccctggaccgaagggcttggagtggagtgggatggatcaaccctaacgaatggtgacacaaactatgcacagtaagttcagggcaggtcacatgacaggacacgcatacagcacagaccctagacgtggagtcgtaggagcgggacgtcggacgaacggcgtacgtagacgagacgtcggtagttacgtacgtcgtacgacggtagacggacgaaggtaacgtacgtagtttggaacggg

SEQ ID NO: 129323 - DNA, 546 bp, Homo sapiens
  misc_feature: GYAE6OF02HAUP4.45.78.H01.1.454.CMB.1.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactccccaggtgcagctggtgcagtctggggctgaggtgaagaagcctggggcctcagtgaaggtctcctgcaaggcttctggatacaccttcaccggctactatatacactgggtgcgacacggcccctggacaagggcttgagtggatgggatggatcaaccctaacaagtggtggacacaaactatcgacacagtaagtttcgagggcagggtacacatgaccgagggacacgtccatcagcacgacgcctacagtggagctggagtcgaggcgtagagactcgtaggacgacgccggtaccggttgttaacgttacgtggtacggcggtaggacggcgtaggtaacgttacggttagtttttaggtacggg

SEQ ID NO: 129324 - DNA, 550 bp, Homo sapiens
  misc_feature: GYAE6OF02IT7J8.45.78.H01.1.454.CMB.1.raw
  modified_base (535)..(535): a, c, t, g, unknown or other
  misc_feature (535)..(535): n is a, c, g, or t
  modified_base (545)..(545): a, c, t, g, unknown or other
  misc_feature (545)..(545): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacgacggccgtgtattactgtgcgagaggcaggaattacgtatttttggagtggttattcggaggtagtggacgtcgtggggccgaagggccgacggtcaccgtctcctcagcctccaccgaacgggcccacgtccggtccttcccccgtggcccaccctcctccaacgcgccacctcgtcggggcacgacgccggccgtggctgccgtggcacggtacctacttccgagctccgcgtccnggacgtcggngtcgg

SEQ ID NO: 129325 - DNA, 586 bp, Homo sapiens
  misc_feature: GYAE6OF02JAD3G.45.78.H01.1.454.CMB.1.raw
  modified_base (256)..(256): a, c, t, g, unknown or other
  misc_feature (256)..(256): n is a, c, g, or t
  modified_base (370)..(370): a, c, t, g, unknown or other
  misc_feature (370)..(370): n is a, c, g, or t
  modified_base (472)..(472): a, c, t, g, unknown or other
  misc_feature (472)..(472): n is a, c, g, or t
tcagacgcgatcgacacgaccggtgctcgatttagtgtgagtagtttgggtttggggagagcatcacccagcaaccacatctgtcctctagagaatcccctgagagctccgttcctcaccatggactggacctggaggatcctcttcttggtggcagcagccacaggagcccactcccaggtgcagctggtgcagtctgggggctgaggtgaagaagccgtggggcctcgagtgaaggtctcctgcaaggcttcgnggatacaccttcaccggctactatatacactgggtcgcgacacggccctggacgaagggcttgagtggagtgggatggataccaaccgtaacaagtggtcggacaacaaaactntacgacaacgaggtaagtttacgagggtacgtagggtactaccgaagtcggaaccgaacgggacctacgtaacactacacgtacacgacgtcctaacgtagnggaacgtctaggacgcgaggtcgagaaggtctacgacgtacgacgtacggacgttggtagttacgtcggtagtacggacggaggacgtaaggtaacgttacgttagtttacggg

SEQ ID NO: 129326 - DNA, 535 bp, Homo sapiens
  misc_feature: GYAE6OF02H3IIS.45.78.H01.1.454.CMB.1.raw
  modified_base (268)..(268): a, c, t, g, unknown or other
  misc_feature (268)..(268): n is a, c, g, or t
  modified_base (282)..(282): a, c, t, g, unknown or other
  misc_feature (282)..(282): n is a, c, g, or t
  modified_base (293)..(293): a, c, t, g, unknown or other
  misc_feature (293)..(293): n is a, c, g, or t
  modified_base (300)..(300): a, c, t, g, unknown or other
  misc_feature (300)..(300): n is a, c, g, or t
  modified_base (312)..(312): a, c, t, g, unknown or other
  misc_feature (312)..(312): n is a, c, g, or t
  modified_base (318)..(318): a, c, t, g, unknown or other
  misc_feature (318)..(318): n is a, c, g, or t
  modified_base (321)..(321): a, c, t, g, unknown or other
  misc_feature (321)..(321): n is a, c, g, or t
  modified_base (329)..(329): a, c, t, g, unknown or other
  misc_feature (329)..(329): n is a, c, g, or t
  modified_base (344)..(344): a, c, t, g, unknown or other
  misc_feature (344)..(344): n is a, c, g, or t
  modified_base (359)..(359): a, c, t, g, unknown or other
  misc_feature (359)..(359): n is a, c, g, or t
  modified_base (456)..(456): a, c, t, g, unknown or other
  misc_feature (456)..(456): n is a, c, g, or t
  modified_base (463)..(463): a, c, t, g, unknown or other
  misc_feature (463)..(463): n is a, c, g, or t
  modified_base (523)..(523): a, c, t, g, unknown or other
  misc_feature (523)..(523): n is a, c, g, or t
tcagacgcgatcgacacgaccggtgctcgatttagtgtgagtagtttgggtttggggtgggaagaagccgtggggcctacagtgaaggtctcctgccaagggcttctcggatacaccttcaccggtctactatatacactggtgcgacaggccccgtggacaagggcttgagtggatgggatggatcaaccctaacaatggtggcacaaactatgcacagaagtttcagggcagggtcaccatgaccagggacacgtcatcagcacanacctagatggatcngagcgaggtcngagatcngacacgagcgtnattacngtncgagacgnaggattagattttgngtgtatcggagttgngatcgtagggaccaaggaccacggtcaccgtctcgtcaagtccaccacgaaggtcccatcggtccttcccaggccaccttcaccagactcacttcgngggacancgccgacgtggctgcctgtacgaacggctactaccgtctacgttcgccacgttagggacnccgggtgaacgg

SEQ ID NO: 129327 - DNA, 705 bp, Homo sapiens
  misc_feature: GYAE6OF02H2YQJ.45.78.H01.1.454.CMB.1.raw
  modified_base (134)..(134): a, c, t, g, unknown or other
  misc_feature (134)..(134): n is a, c, g, or t
  modified_base (186)..(186): a, c, t, g, unknown or other
  misc_feature (186)..(186): n is a, c, g, or t
  modified_base (204)..(204): a, c, t, g, unknown or other
  misc_feature (204)..(204): n is a, c, g, or t
  modified_base (258)..(258): a, c, t, g, unknown or other
  misc_feature (258)..(258): n is a, c, g, or t
  modified_base (317)..(317): a, c, t, g, unknown or other
  misc_feature (317)..(317): n is a, c, g, or t
tcagacgcgatcgacacgaccggtgctcgatttagtgtgagtagtttgggtttgggtgaagaagctgggcctcagtgaaggtctcctgcaaggcttctggatacaccttcaccggctactatatacactgggtncgacaggcccctggacaagggcttgagtggatgggatggatcgaaccctaanaatggtggcacaaactangcaacagtaattcaggcagggtcaaccatgacaagggacacgtccatcagcacngacctacagtggagtcacgagtaccaggtctaggagactcgtagaccggacacgcggtntaactacgtgtgacgagacggcaaggaatttacggtagttttgggaagtttggtagttcgggtagtagtggtaccgtgtcggggaccgtaaggggacctacgggttaccgtaccggtcctccggtaccttacggcccctaacgaaccggtaaccgggtaccccgagtttacccggtaccccgttcccggtccgaaccgtcccccgttacgtacccgaaacggtaccacccgtaaccgtcccggtacggggaccaccggtaacgcccgggacgttccgggacgtcccgtacccggtaggtacccggaacgggtacctttacccgtacccgttaccgaaccggttccggtcccgtacggtaccgggtccgtacggggtaccgtaccgggg

SEQ ID NO: 129328 - DNA, 921 bp, Homo sapiens
  misc_feature: GYAE6OF02GTU6O.45.78.H01.1.454.CMB.1.raw
  modified_base (187)..(187): a, c, t, g, unknown or other
  misc_feature (187)..(187): n is a, c, g, or t
  modified_base (265)..(265): a, c, t, g, unknown or other
  misc_feature (265)..(265): n is a, c, g, or t
  modified_base (272)..(272): a, c, t, g, unknown or other
  misc_feature (272)..(272): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaacctaanaatggtggcaacaaactatgcacagaagtttcagggcagggtcacatgaccagggacacgtccatcagcacagcctanagtgganctgagcgaggctggagattcgaggaccgacgtaccgggtccgtagtacttactggtacgacggaaggtagggacgaaggtaaagtttacggtttaagtttttaggtagggtttacggtttacggtttacggggtacggttaacggtacgggtaccgggttcggttacgggggtaccggaaacggggtaacccgtaccgggtacccgtaccgttcccgtaccgttccgaacccggtaccctcccaaaccgggtaccgggtaccccgtacgtttcccgggttcccctttacccccgggtctaccccgtacccccttaacgtcccaaaaggccgaaaacccccggggttttaccccggtttaacccggggtacccggggggttaacccttaaacccgggggtacccgggttaaacccccgggttacccgggttaccggggttaaaccccggtttcccgggggtttacccccgggttttaaacccgggggtttaaccccgggttaaaaccccggggtttaaccccgttttaaccccgggtttaaccccgggtttaacccggggtaaccggttttacccggggttacccgtttaccggggttaaccccgggtttaaccgggggtttaccccggggtacccggttaacccggggg

SEQ ID NO: 129329 - DNA, 617 bp, Homo sapiens
  misc_feature: GYAE6OF02G1V0E.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgtagttttggagttggttagttcggaacggtagtggacgtcgtggggtccaaggggtaccgacggtcgaccgttcctcctcgacgccctccgaaccaacgggcccaacgtccggttcctccccgtggccctacccgtcctccgaacgcgccctaccgtccgtcggggccacgaccggcggacccgtgggcctcggtccgtggtaccgtaacgggtacccttaccgtttcccgtaaccgtcgttaccggtccgttaccgtacgggtacggtccgggtacgtcgggg

SEQ ID NO: 129330 - DNA, 582 bp, Homo sapiens
  misc_feature: GYAE6OF02I9ZQW.45.78.H01.1.454.CMB.1.raw
  modified_base (551)..(551): a, c, t, g, unknown or other
  misc_feature (551)..(551): n is a, c, g, or t
tcagacgcgatcgacacgaccggtgctcgattagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgtattttggaggttggttattcgggacggttagtgggacgtcgttacgggggccgtaagggaccgacggtccgaccggtcctaccgtacacgccctacccgaccgaacgggcccacgtccggtccttcccccgtaggccacccctcctcccaacgcgccacctcgtcggggccacgacgcggcccgtgggctcgccgtggtacgacggaccttcgttccncgtacgtcgcgttctcggcggcggcgtcggg

SEQ ID NO: 129331 - DNA, 522 bp, Homo sapiens
  misc_feature: GYAE6OF02GVBAG.45.78.H01.1.454.CMB.1.raw
  modified_base (518)..(518): a, c, t, g, unknown or other
  misc_feature (518)..(518): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtaactggttggcctggtatcagcagaaaccagggaaagcccctaagctcctgctctataaggcatctagtttagaaagtggggtccagtcaaggttcagcggcaggtggatcgtagggacagaattcactctcaccatcagcagcctgcagcctgatgtatttgactaacttattactgacctaacagttatagattagttacttcgtacgttcggaccgaagggaccaagggtagaaatacgaaacgactaggtggctagacacctatcctgttaccttntacc

SEQ ID NO: 129332 - DNA, 598 bp, Homo sapiens
  misc_feature: GYAE6OF02GGO9Z.45.78.H01.1.454.CMB.1.raw
  modified_base (344)..(344): a, c, t, g, unknown or other
  misc_feature (344)..(344): n is a, c, g, or t
tcagacgcgatcgacacgaccggtgctcgatttagtgtgagtagtttgggtttggggagagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagcctgggctcagtgaaggtctctgcaaggcttctggatacaccttcaccggctactatatacacttgggtcgcgacacggcccctggacgaagggtcttggagtggagtgggatggatacgaaccctaanaagtggtaggcaacgaaactatcgacaactagtaagtttcgaagggtcgaagggtcaccagtacgaccgaggactacgtccagtacgagtcaacacgtacctacgagtcggacgtcgtagacgacgacggcgtaggacgtacgtatacggaaccggacgaaccgggtccggttaggttaaccgtttacgttacggtaggaccgtaacgggacggtaaccgagggttaacgtttacggttaggttttttacgggg

SEQ ID NO: 129333 - DNA, 533 bp, Homo sapiens
  misc_feature: GYAE6OF02JB8LW.45.78.H01.1.454.CMB.1.raw
  modified_base (339)..(339): a, c, t, g, unknown or other
  misc_feature (339)..(339): n is a, c, g, or t
  modified_base (366)..(366): a, c, t, g, unknown or other
  misc_feature (366)..(366): n is a, c, g, or t
  modified_base (416)..(416): a, c, t, g, unknown or other
  misc_feature (416)..(416): n is a, c, g, or t
  modified_base (424)..(424): a, c, t, g, unknown or other
  misc_feature (424)..(424): n is a, c, g, or t
  modified_base (432)..(432): a, c, t, g, unknown or other
  misc_feature (432)..(432): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactggtgcgacacggcccctggacaagggcttggagtggatgggatggatcaaccctaanaatggtggacaacgaaactagtgacanagtaagttcgagggtcagggtcacatgaccgaggacacgtccatcagcancgacctanagtggacncgtagacgcgaggctagacgatcgtagaccgacgaccgtccgtaggttacttacgtggtacgcgagacggctaaggtaagttacgttagttttggtacggg

SEQ ID NO: 129334 - DNA, 569 bp, Homo sapiens
  misc_feature: GYAE6OF02G29V2.45.78.H01.1.454.CMB.1.raw
  modified_base (460)..(460): a, c, t, g, unknown or other
  misc_feature (460)..(460): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcgagtgaaggtctcctgcaaggcttcgtggatacaccttcaccggctactatatacactgggtgcgacacggcccctggacgaagggcttggagtggagtgggatggactcaaacccgtaacaagtggtacggacaacaaactatcgacacgaagtaagtttcgaggggcgtagggtaccacagtacgaccgacgggacacgtccaagtcagcacgacgacctacacgtaggacncgtagagacgagtcgtagaagtagtcgagaccgacgacggacgttagttacgttacgtggtacgacggaggacggcgtaaggtaatttacggttagtttggttaacggg

SEQ ID NO: 129335 - DNA, 668 bp, Homo sapiens
  misc_feature: GYAE6OF02JBBTZ.45.78.H01.1.454.CMB.1.raw
tcagacgcgatcgacacgaccggtgctcgatttagtgtgagtagtttgggtttgggggagagcatcacccagcaaccacatctgtcctctagagaatcccctgagagctccgttcctcaccatggactggacctggaggatcctcttcttggtggcagcagccacaggacgcccactcccaggtgcagctggtgcagtctggggctggaggtgaagagccgtgggcctcagtgaaggtctcctgcgaaggcttcgtggatacaccttcaccggctactatatacacgtgggtgacgacgacggcccctggacaagggtcttggagtgggtagtgggagtaggataccaaaccctaacgaagtgggtcggacaacctaaaacttagtacgacaacgtaaggttaaacgtttcggaacggggtccgtaacgggttacccaacccgtagtaccggaaccggaacggggtaaaccaaccggttacccaacgtaccaacggaaccaaccgaccgtacccgtaacgtaacgtacgggacgtcgtacggaacgcggaacggtacgtagggaacgtacgtacgtacggaccgaccgaccgggtaccggttagttacttacggtggtcggacggaggacggtaggtaagggtacgtttacgggttagttttaagggg

SEQ ID NO: 129336 - DNA, 585 bp, Homo sapiens
  misc_feature: GYAE6OF02JH62R.45.78.H01.1.454.CMB.1.raw
tcagacgcgatcgacacgaccggtgctcgattagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatcgtagacgacgacggccgtgtattactgtgcgagaggcaggtaattacgtattttggagttggttagttcggacggtagtggtacgtcgtggggaccgaagggaccgtacggtcacccgtctcctcgacgcctccacgacggccacgtccgtccttcccctggccaccctcctaccagacgcctacctcggtcgggccaccgagcccgccgtcggctccgccgtggtaccgaacggtaccttaccgttccgtacgtacgtccggtccgttccgacggtacgggccggtacggtccggg

SEQ ID NO: 129337 - DNA, 554 bp, Homo sapiens
  misc_feature: GYAE6OF02FHAVF.45.78.H01.1.454.CMB.1.raw
  modified_base (431)..(431): a, c, t, g, unknown or other
  misc_feature (431)..(431): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtaactggttgcctggtatcagcagaaaccaggaaagcccctaagctcctgctctataaggcatctagtttagaaagtggggtacccagtcaaggttcaggcggcagtggatcgtgggacagaattcactctcaccatcagcagcctgcagcctgatgtatttcgactaactttattactcgaccaactagttanagtattagtttattccggtaacgtttcggtacgaaagggtaccgtaagggtaggaaaactcgaaaaccgtaactggtacggtcgttaggcctaaccgtaacttccgtacgtttcctactaccg

SEQ ID NO: 129338 - DNA, 663 bp, Homo sapiens
  misc_feature: GYAE6OF02H8WHU.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatcgtgacgacgacggccgtagtacttacgtgtgcgagaggcgaggtaattacgtagtttttgggaggttggttagttacgggtacggttagtcgggtacgttcggtacgggggacccgaaaggggacccgtaacgggtccgacccggtcctttcccgtaccgtacgccccttacccgaacccgaaacggggccccacgttcccggttccttcccccgtcggccctacccctccctaccgaacgcgacccacccgtccgtcgggggccaccgacggcccgggcccgtcgggtcctcgtccgtcgggtaccgaacggtaccttaccgttccgtaccgtacgtccggtccgttcgtggtacggccgggtcgtaccgggg

SEQ ID NO: 129339 - DNA, 574 bp, Homo sapiens
  misc_feature: GYAE6OF02GZIW5.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgattttggagtggttattcggaggtatggacgtcgtggggaccaaggggaccacggtcgaccgtctcctcagcctccaccaacggcccatccggtccttccccgtcggcacccctcctcccaagacgccgacccgtcgtcgggggccacgacgccggcccgtcgggcctcgccgtcggtcgaacggtacctaccgttcccttaccgttcgcgttacggtccgtaggcggacgggtcgtcggg

SEQ ID NO: 129340 - DNA, 546 bp, Homo sapiens
  misc_feature: GYAE6OF02HMD7K.45.78.H01.1.454.CMB.1.raw
  modified_base (275)..(275): a, c, t, g, unknown or other
  misc_feature (275)..(275): n is a, c, g, or t
  modified_base (403)..(403): a, c, t, g, unknown or other
  misc_feature (403)..(403): n is a, c, g, or t
  modified_base (540)..(540): a, c, t, g, unknown or other
  misc_feature (540)..(540): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtaactggttggcctggtatcagcagaaaccagggaaancccctaagctcctgctctataggcatctagttagaagtgggtccatacgaaggttcagcggcaggtggatcgtagggacagtaattcactctacaccatcagcacgcctgcagcctagagtgtatttnacttactttaacttacgtcacctaacgagttactagtattagttacgttcgtacgttcggaccaaagggacctaaggtagaaacttaccgaaacgtacgtaggtaggaccgtagacctacctagttcctgttacctntacccg

SEQ ID NO: 129341 - DNA, 668 bp, Homo sapiens
  misc_feature: GYAE6OF02HNIJS.45.78.H01.1.454.CMB.1.raw
  modified_base (265)..(265): a, c, t, g, unknown or other
  misc_feature (265)..(265): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagttcagggcagggtcaccatgaccagggacacgtccatcagcacagcctanatggagctgagcaggctgagatctggacgacacggccgtgtacttacgtgtgcgagaggcaggaattacgtagttttggagttggttattcgggacggttagtggacgttcgtacggggtccgaaaggggtacccaccgggtccgtacccggtccttcccgttaccgacgtacccgttacccgacccgaaacggggccctacgtccggttacctttccccccgtggccctaccccgtcctacccaacggacgtccgacccgttccgtcgggggtcccaaccgtacggtacccgggcccgtcgggtaccgtcgcccggttaggtaccgtaacgggtacccttaccgtttaccccgtacgtaccgttaccggccgttaccgtggaccgggcgggtaccgtacggg

SEQ ID NO: 129342 - DNA, 678 bp, Homo sapiens
  misc_feature: GYAE6OF02ICUTN.45.78.H01.1.454.CMB.1.raw
  modified_base (256)..(256): a, c, t, g, unknown or other
  misc_feature (256)..(256): n is a, c, g, or t
  modified_base (268)..(268): a, c, t, g, unknown or other
  misc_feature (268)..(268): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagttcaggcaggtcaccatgaccagggacacgtcatcagcacngcctacatgganctgagcaggctgagatctagacgacgacggccgtgtattacgtgtacgcgagaggcgaaggtaattacgttagttttaggagttcggttagttacggaggttatagggtacgtcgtacggggaccgaacgggacccgtacgggtctaccggtcctaccgtaccgacgtcccctaccgaaccgaaacggggtcccctacgtacccgggttccccttccccgtcgccctacccctcccgtaccgaacggacgtccctacccgtccggtacgggggtccaacgtcggcccggtccggtccgggtacgtccggtacccgttacgggtaccgtaacggtaacctttacccgttacccgtccgtaaccgtccgggtaccgttaccggtacggacgggtcccggggtcctaacgggg

SEQ ID NO: 129343 - DNA, 618 bp, Homo sapiens
  misc_feature: GYAE6OF02HST2D.45.78.H01.1.454.CMB.1.raw
  modified_base (274)..(274): a, c, t, g, unknown or other
  misc_feature (274)..(274): n is a, c, g, or t
  modified_base (299)..(299): a, c, t, g, unknown or other
  misc_feature (299)..(299): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatcgacccagtcctccttccaccctgtctgcatctgtaggagacagagtcaccatcacttgccgggcagtcagatattagaatgagttaggctggtatcagcagagacgaggggacncccccaacgtcctagtctagtggtntcttccgaaggttacaaaggtcgggtaccatacgtaaggttcaggttcggcgggtgggtctacggcaacgagtaacttcgactcctacaacctatccacggccgcccgtgaccgacgacccggtaaagttattttacgacctaaactttattactcgtactaactaagttactttaccaactttacccgtacggactacgttaccgggaaccgaacgggtaacctaacggtcttacggaataacctaaccgaaacgtaacgtggtacggctacgaccgtaacctgttacttagttacttaccgtacttcccgttacccg

SEQ ID NO: 129344 - DNA, 808 bp, Homo sapiens
  misc_feature: GYAE6OF02HGNZD.45.78.H01.1.454.CMB.1.raw
  modified_base (304)..(304): a, c, t, g, unknown or other
  misc_feature (304)..(304): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccaggacacgtccatcagcacagcctacatggagctgagcgaggctgagatctgacgacacggcgtntatactgtgacgaggaggcaggtaattacgtagttttgggagtagggttacgttacgggtacggttagtcgggtacggttcgacgggggaccgtaaggggacccgtacgggtccgtacccggttcctcccgtaccgacgtaccccttcccgaacccgtaacggggtccccctaacgttcccgggttaccccgtttcccccccgtaccggggtacccctaaccccccgtttcccgttaaccccggaaaccggtacccggtaccccgtaaccccggtttcccggggttaccgggggggaccccgtaacccggtaccggggtacccccgggtacccccggttacggggggtccccttacgggggtacccccgtttacgggggttaacccgggaaaaccggggttacccctttaacccgttttccccggtaaccggttaccggttcccgggttacccgggttcgtaaccgggggtaaccggtccggggggtaccgttaacccgggggg

SEQ ID NO: 129345 - DNA, 599 bp, Homo sapiens
  misc_feature: GYAE6OF02G14Q4.45.78.H01.1.454.CMB.1.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctcctgcaaggcttctggatacaccttcaccggctactatatacacgtggtgcgacacggcccctggacaagggcttgagtggagtgggatggactaccaacctaacaagtgggtaggacaactaaactatacgacaacgagtaagtttcgagggcgtacgggtaccaaccgacgtacgaaccgagggtaccacggtaccagtaccgacgtaccaacgacgacctacacgtggacgcgtaggacgcgaggtcgtaggagtactcgtaacgaccgaccgtaccgggtaccgttaggtaacgttacgttggtcggacggaggacggtacgtaaggttaacgttacggttaggttttaggtacggg

SEQ ID NO: 129346 - DNA, 561 bp, Homo sapiens
  misc_feature: GYAE6OF02HD9B4.45.78.H01.1.454.CMB.1.raw
  modified_base (251)..(251): a, c, t, g, unknown or other
  misc_feature (251)..(251): n is a, c, g, or t
  modified_base (439)..(439): a, c, t, g, unknown or other
  misc_feature (439)..(439): n is a, c, g, or t
  modified_base (446)..(446): a, c, t, g, unknown or other
  misc_feature (446)..(446): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgccagtctggggctgaggtgaagaagcctggggcctcagtgaaggtctcctgcaaggcttntggatacaccttcaccggctactatatacactgggtgcgacacggcccctggacaagggcttggagtggatgggatggatacaaccctaacaagtggtggacaactaaacgtatcgacacgaagagtttcgagggtcagggtcaccagtacgaccgagggaccacgtccagtcagccaacagtcccanagtcggngactggacgacgaggcgtagagtactcgacgacgaacgccggtcgttggttaacttacggtgtaggacggtaaggacggaccggtaggtaactttacggttagttttggtaaggg

SEQ ID NO: 129347 - DNA, 567 bp, Homo sapiens
  misc_feature: GYAE6OF02I9ACS.45.78.H01.1.454.CMB.1.raw
  modified_base (324)..(324): a, c, t, g, unknown or other
  misc_feature (324)..(324): n is a, c, g, or t
  modified_base (327)..(327): a, c, t, g, unknown or other
  misc_feature (327)..(327): n is a, c, g, or t
  modified_base (336)..(336): a, c, t, g, unknown or other
  misc_feature (336)..(336): n is a, c, g, or t
  modified_base (432)..(432): a, c, t, g, unknown or other
  misc_feature (432)..(432): n is a, c, g, or t
tcagacgcgatcgacacgaccggtgctcgatttagtgtgagtagtttgggtttgggggagagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcgaggtggaaggtcctcgtgcgaaggcttctggatacaccttccaccggctactatatacactgggtgcgacacggcccctggacaagggctgagnggntgggagtgntcaacctaacagtggtgtcacaactagtgacacagaagtttcgaggcgagggtacacgagtacgaccgagggaccgacgaccgaactcagaccganacgacctacgactggacgtgacgtagccgagggtctagacgtactacgtcgaaccgacgcgggacccgttggtaacttacggttggacgtaggaacggtcgaacggtaggtaacgttacggttagttttacgggg

SEQ ID NO: 129348 - DNA, 727 bp, Homo sapiens
  misc_feature: GYAE6OF02IVRDA.45.78.H01.1.454.CMB.1.raw
  modified_base (240)..(240): a, c, t, g, unknown or other
  misc_feature (240)..(240): n is a, c, g, or t
  modified_base (295)..(295): a, c, t, g, unknown or other
  misc_feature (295)..(295): n is a, c, g, or t
  modified_base (585)..(585): a, c, t, g, unknown or other
  misc_feature (585)..(585): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacgaggtcgtccactcccaggtccagcatgtgcagtcgtgggctgaggcgaagacgcgtgggcctgagtgaacgttccngcgagtcttcgtggatactacttcgctcgcctatcgacctattctagttgggtcnccggtccgaacggccccgaaggtaacgggtcttacggacgggttacggtaggttcgggtagtacggtaacgtaccgaacgggtccgtacgggtacttaacggtacggttaaccaacggttaaaacgaaacgtttacgttaaccgaacgtaaacgttaaaaccgttaccgggtaaaggaaccgtaaaggtacgtaacccgtaacgtacgttttaaccggtaaaggtaacctaaacggtttataccgggaccgttaaacaacgtaccgtacctaacgtagtaacggtaccgngtaacgtacgtaggtttacgaacgtacgtttcgaacggaaccgtaaccgtacggtcgttacggttaccttaagtccgttaggtcggaacggttacggaacggggtacggggaagttacgttagttaacgcgtaagttaacgg

SEQ ID NO: 129349 - DNA, 647 bp, Homo sapiens
  misc_feature: GYAE6OF02ILV9D.45.78.H01.1.454.CMB.1.raw
tcagacgcgatcgacacgaccggtgctcgatttagtgtgagtagtttgggtttgggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaaactatgcacagaagtttcagggcagggtcaccatgaccagggacacgtccatcagcacagcctacatggagctgagcgaggcgtgagatctgacgacacggccgtgtatactgtgcggagaggcaggaattagagttttggagttggtattcggaacggtagtcggtacgtcgtacggggaccaagggaccgtacggtccaccgtcctccgtcacgtccctcccaacgaacgggccacgtccggtaccttcccccgtggccctacccttccctaccgaacgcgaccctacccgttccggtacgggggccaaccgacggtcccgggcccgttccggggtacccttcggtacccgttagggtaccggtaaaccggtaccgttaaccctttcccggtccgtaacggttcccgtccggttaccgtcggacggccggggactaccgggg

SEQ ID NO: 129350 - DNA, 581 bp, Homo sapiens
  misc_feature: GYAE6OF02G9UY9.45.78.H01.1.454.CMB.1.raw
  modified_base (374)..(374): a, c, t, g, unknown or other
  misc_feature (374)..(374): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtcctgcatctgtaggagacagagtcaccatcacttgccgggccagtcagagtatagtaactggttggcctggtatcagcagaaaccagggaaacgcccctaagctcctgctctataaggcatctagtttagaaagtgggtccatcaaggttcagcgcagtggatcgtggacagaatcactctcacatcagcancctgcacgctgatgattttgactaactttacttactcgacctaaacagttaactggtaacttaagttttacttacggtaccggttttccgggacccgtaaacggggtacccgtaaagggtcggtaaaaacgtacgaaaaccgtaacgtacggttacggacgttacggaccaaccgtaacgttaccttacggttaccgttacttaccg

SEQ ID NO: 129351 - DNA, 636 bp, Homo sapiens
  misc_feature: GYAE6OF02HPY5I.45.78.H01.1.454.CMB.1.raw
  modified_base (266)..(266): a, c, t, g, unknown or other
  misc_feature (266)..(266): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtcagtcagcacagcctanactggagctagagcaggctagagatctgacgtaccacggccgtgtacttacgtgtcgcggaagaggacaagggtaattacggtagtttttggagttaggttacgttacgggaacggttatagggacgttcgtacggggaccgaaggggaccacggtcgtaccgtctcctcgacgcctaccaccgaacgggacccacgtcggtaccttccccgtcgaccctacccgtactaccacgtacgccgtaccgtcgtcggggacacgacgccgggcccgtcgggactccggcccgttagggtaccgtaacggtaccttaccgttacccgtaccgtacgtcccggtcgtccgtacggacggtccgggtcgtaccggg

SEQ ID NO: 129352 - DNA, 876 bp, Homo sapiens
  misc_feature: GYAE6OF02JVPJE.45.78.H01.1.454.CMB.1.raw
tcagacgcgatcgacacgaccggtgctcgatttagtgtgagtagtttgggtttgggggtaggtcgagacccagtcaggacacagcatggacatgaggtcccgctcagctcctgggctcctgctgctctggctcccgaggtgccaaatgtcgacatccagactacgaccctagtccgttcccttcccacccttcgtcgtcgacctacttcctggtacggagaccaaggacgtaccaaccctatacctaaccgttggcccccgggacctacggttaccaaggtacggttaatttaaacgtaaccgttgggtttcgggtacccgtttagggtaactccgtaaggtaccgtaaaccggaaaaccggtaaggggaaaaccccgtaccccgttaaaggccccttaccggtcggaccttacgttaaaacgtacggaccgtaatttccggtttaaaggttttaaccgaaaacggggttgggtacccccgtaattaccggaacggttacacggttacggctacggtggacgttcgtagggacgagttactctacgccgttaccactacgtaccacgacctacggtcctcgggtaccctacgtaccgtacggttacgttacgtttactttacgaactttaaccgtttaacctttacgtaaccgtacccgttaaacgttaaccggttagttaacggttaacgtttaaccgtttaccggttaaccgttaaccggggttttacccgggaaaccgggttaccgggttaaaccgggtaaccggttaacggtaacccggttaacggtaaaacggtaaccggtttaggtaaccgtaccggttcggtaaccgaccgttaccgttaccgtttacggttacctacccgtttacccg

SEQ ID NO: 129353 - DNA, 841 bp, Homo sapiens
  misc_feature: GYAE6OF02HWL53.45.78.H01.1.454.CMB.1.raw
tcagacgcgatcgacacgaccggtgctcgatttagtgtgagtagtttgggtttgggggagtcagacccagtcaggacacagcatggacatgaggtccccgctcagctcctggggctcctgctgctctggcctcccaggtgccaaatgtgacatccagatcgacccagtcctccttccaccctgtctgcatctggtagggagaccagacgtcaaccattccacgtttggcccgggctagtccaaggtagtattacgtaacgtggttggccgttggtactcgacgactaacggaaaccgagggtaaaccgcccccgtaagtcctaccgtagtccttacgtaagtaacggtctaacttacgttaaggtttaaaggaaacggttcggggtaccctaagttaccggtaacggttaccgaacggtaccgggtacgtaacggttcgggtacgttacggtaacgggtaaccgtaaacggttaactttaccgtaaacccgtttaccctttaacccgaaacccgttaacgttaacccgaacgggtacccgtaaacgggtccccgttacgggaaccctacggtacccgttaggttacgttacggttaacgttttaccgttaaccgtttaaacgtttacctttaaccgtaccgtaacctaacggttaacgttaacgtacggttaacgtttaacgttaaccgttaccggttaaccgtttcccggggaaacgtaaaccgggtaacgtaaaggtaacggttaacggtaaaccgtaacgtaaaaccggttaacggtacggttaacggaccgttaccggtacctaaccgttaacgttacctttacggttaccttaccg

SEQ ID NO: 129354 - DNA, 559 bp, Homo sapiens
  misc_feature: GYAE6OF02GKDWF.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaaactatgcacagaagtttcagggcagggtcaccatgaccagggacacgtccatcagcacagcctacatggagctgagcaggctgagatctgacgacacggccgtgtattactgtgcgagaggcaggaattacgattttggagtggttattcggacggtatggacgtcgtggggccaaggggccacgggtcaccgtctccgtcagccctccaccaagggcccatccggtccttccccctggccacccctcctcccaacgacgccaccctcgtgggggccacgacgccggcccgtgggctgcccgtggtccaaggacctaccttccctacgatccggcgttcctggacggcgggctcggg

SEQ ID NO: 129355 - DNA, 692 bp, Homo sapiens
  misc_feature: GYAE6OF02GTIFQ.45.78.H01.1.454.CMB.1.raw
tcagacgcgatcgacacgaccggtgctcgatttagtgtgagtagtttgggtttgggggtcagacccagtcaggacacagcatggacatgagggtccccgctcagctcctggggctcctgctgctctggctcccaggtgccaaatgtgacatccagatgacccagtcctccttcccaccctgtctgcatctgtaggagacagagtcaccatcacttcgccggccagtcagagtattagtaacgtggttcggccgttggtatcgagacgaacgaaaccgaacgggaaacgaccccgtaagcctaccgtcgactactataacggactaacttacgttaagtttaaggaaggttcgggtaccctagtacgtaacggttacgaggaccggacgtaggtaggtacgtcggtagggaacgtaagtaacttactactccgtacaccgtactacgacgccgaacgtccctaggaccacgtccgagtacgttaggttactttacgaacctttaacttacttacgaccgtaaccgtaattagtattaaggtaactttagttacgttaccgtaccggttacgggaaccggtaacggtaaccgtagggtaacgaaccgtaaccgtaaacgtaacggttggtaccgtacgttaccggacctaaccgttgttacccgttacgtttacgttaccctacgtttcccccg

SEQ ID NO: 129356 - DNA, 689 bp, Homo sapiens
  misc_feature: GYAE6OF02F54ZQ.45.78.H01.1.454.CMB.1.raw
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtcctccttccaccctgtctgcatctgtaggagacagagtacaccatccacttcgccggccagtcagtagtattagtaacgtggttgcctggtatcagacaacgaaccgaaggaacgtaccctaagcctcctacgctacgtagtacggctagtacttaaggttaagaaggtcgggtaccctaagtacgtaaggttcgaggtacggacgtaggtggtacgttcggtagggaactaaggtaactttccgaaccttaccgtacctaaccgtactaccgaacgccgtaacgtccgtacgacctacgtcctagggtaactttggttacttttacgaactttaacgtttacttaaccgtcgtaaaccctaagttaagttataacggttaatttaacggtttagttaccgggtaaccggttcggtaaaccggaaacgggtaaccgtaaagggtacgtaaactaaccggtaaacgtaacggtcggtacggactacgacctaacccgtattccgtacgttacgtacctacccg

SEQ ID NO: 129357 - DNA, 757 bp, Homo sapiens
  misc_feature: GYAE6OF02GEVK0.45.78.H01.1.454.CMB.1.raw
tcagacgcgatcgacacgaccggtgctcgatttagtgtgagtagtttgggtttgggggagagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacgacggccccgtggacaagggtcttgaggtggagtggggataggtactaccgaaacccttaacgaaagttcgggtacgggaccgtaaacaaaacgttaacgtcggaaccaacgtaaggtaaacgggttttaccgaagggggtaccgtaacggggttacccaacccgtagttaaccggaaccccggtaagggggtaaaccctaaccggttaccccgaaacgttacccgaaacggtaccctaaaccgaaccggtaccccttaacgacgggtagggtaaccggtcgtacgggaacgaccggtacggtacggttaaggaacgtaacttaccgtaaccgggaaccggaccgggtacccgggtaccggtttaacggttaaccgtttacggtacggtacggtaccgggttaacgggaccgggtacggttaaacgggttaacgttttaacgggtttaggtttttaaccggggg

SEQ ID NO: 129358 - DNA, 657 bp, Homo sapiens
  misc_feature: GYAE6OF02JSR4W.45.78.H01.1.454.CMB.1.raw
  modified_base (338)..(338): a, c, t, g, unknown or other
  misc_feature (338)..(338): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatcgaccagggacacgtccatcagcacagcctacagtcggagctgagcgacggtcgtgaggactcgtacgacgacacggccgtgtaacttctggtgcgagcgganaggaattacgattttggagttggttaagtcggtacggtagtcggtacgtgtcggggacgtaacgggaccgtacggtactacccgggtctccgtacgaacgccgttacccaaccgaacgggccctagtacccgggttcccttccccgtacggcccgtaccctcctacctaacggacgtacccaccgtcggtccggggacacgtaccggtccggcccgttcgggcgtccgccgttcggtaccggtaacgggtcccttaacgttcccgtacggtaaccgttccggtccggttccggtacggtcggccgggtccggtaccggg

SEQ ID NO: 129359 - DNA, 562 bp, Homo sapiens
  misc_feature: GYAE6OF02F6QGE.45.78.H01.1.454.CMB.1.raw
tcagacgcgatcgacacgaccggtgctcgatttagtgtgagtagtttgggtttggggctgaggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgattttggagttggttattcggacggtatggacgtctggggccaaggggaccacggtcaccgtctcctcacgcctaccaccgaacgggcccagtccggtccttcccccgtcggccacccctcctccaacgacgccacctcgtcggggccacgcgccgcccgtgggcctcggcctggtccaaggtaccttacgttccgtcgacgttccggcgtccgtgtaccggg

SEQ ID NO: 129360 - DNA, 556 bp, Homo sapiens
  misc_feature: GYAE6OF02G0PH4.45.78.H01.1.454.CMB.1.raw
  modified_base (434)..(434): a, c, t, g, unknown or other
  misc_feature (434)..(434): n is a, c, g, or t
  modified_base (454)..(454): a, c, t, g, unknown or other
  misc_feature (454)..(454): n is a, c, g, or t
  modified_base (535)..(535): a, c, t, g, unknown or other
  misc_feature (535)..(535): n is a, c, g, or t
  modified_base (550)..(550): a, c, t, g, unknown or other
  misc_feature (550)..(550): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacaccggccgtgtattactgtgcgagaggcaggaattacgattttggagttggttattcggacggtatggtagtcgtggggcagggaccacggtcaccgtctcctcacgcctccaccaggcccagtcggtccttccccgngcctaccctcctaccagacncacctcgtggggcctacgcgcggcccgtcgggctcggcctcggtcgaacggaccttacctcccgtcgtatccgccggttcncggtacggccgggtntacggg

SEQ ID NO: 129361 - DNA, 557 bp, Homo sapiens
  misc_feature: GYAE6OF02FTM9M.45.78.H01.1.454.CMB.1.raw
  modified_base (423)..(423): a, c, t, g, unknown or other
  misc_feature (423)..(423): n is a, c, g, or t
  modified_base (430)..(430): a, c, t, g, unknown or other
  misc_feature (430)..(430): n is a, c, g, or t
tcagacgcgatcgacacgaccggtgctcgatttagtgtgagtagtttgggtttgggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaagggtctcctgcaaggcttctggctacaccttcaccggcgactatctccactgggtgcgacacggcccctggacaagggcttgagtggagtgggatggatcaaccctaacaagtggtggcaacaaactatgacacagtaacgtttcagggcagggtcaccatcgaccagggacacgtccatcagcacacnccctaanatcggagctagacgcgaggactagacatctagaaccgacgaccgggcctaatttaactttaccgtggtacgtggaagggtacggtttacggtttaccgggtcggttaccgtttgggtttttacccgg

SEQ ID NO: 129362 - DNA, 670 bp, Homo sapiens
  misc_feature: GYAE6OF02G6TU1.45.78.H01.1.454.CMB.1.raw
  modified_base (137)..(137): a, c, t, g, unknown or other
  misc_feature (137)..(137): n is a, c, g, or t
  modified_base (190)..(190): a, c, t, g, unknown or other
  misc_feature (190)..(190): n is a, c, g, or t
  modified_base (269)..(269): a, c, t, g, unknown or other
  misc_feature (269)..(269): n is a, c, g, or t
  modified_base (277)..(277): a, c, t, g, unknown or other
  misc_feature (277)..(277): n is a, c, g, or t
  modified_base (319)..(319): a, c, t, g, unknown or other
  misc_feature (319)..(319): n is a, c, g, or t
  modified_base (326)..(326): a, c, t, g, unknown or other
  misc_feature (326)..(326): n is a, c, g, or t
  modified_base (331)..(331): a, c, t, g, unknown or other
  misc_feature (331)..(331): n is a, c, g, or t
  modified_base (337)..(337): a, c, t, g, unknown or other
  misc_feature (337)..(337): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtncgacaggcccctggacaagggcttgagtggatgggatggatcaaacccctaanaaatggtggccaacaaaacgtatcgcaacagtaagtttcagggcagggtcacatgaccagggacacgtcatcagcaacncgacctanagtgagctggagcgaggctgagactctagaacgcacggcgtntattacngtcgngagagngaaggtaattagtagtttggaagtgttaatcgggtaagtagtggtacgtcgtacgggaccgaacggaccgaacggtctaccgtcgtaccgtcgaccgtcccgtaccaaccgaacggccctaacgtccggtacccgttccccgtcggtcctaccccgtccctaccgaccgtacgacctaaccgttccgggcgggtaccgtaaccgtacggccccggtccggtccgggacgttccggtcccgtacgggtaaccgtaacggtaaccctttacccgttaccgttaccgtacgtacccggtcgttccgaccgggtcgggacccgggtcggtaaccggg

SEQ ID NO: 129363 - DNA, 608 bp, Homo sapiens
  misc_feature: GYAE6OF02IFL79.45.78.H01.1.454.CMB.1.raw
  modified_base (290)..(290): a, c, t, g, unknown or other
  misc_feature (290)..(290): n is a, c, g, or t
  modified_base (337)..(337): a, c, t, g, unknown or other
  misc_feature (337)..(337): n is a, c, g, or t
  modified_base (381)..(381): a, c, t, g, unknown or other
  misc_feature (381)..(381): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcgagggcagggtcaccatgaccgagggacacgtccatcagcacagcctacatggagctgagcgaggctgagntctgacgacgacggccgtgtattactgtgcgaggagcgagattacgnttttggagtgtatcggagtatggacgtgtcgggaccagggaccncggtcaccgtctccgtcacgccctacaccgaacgggcccagtccggtcccttccccgtcggccctaacccctcccgtaccaacgtcgacctaaccgtcggtcgggggacctacggtacgcccgggtacccgtcggggtaccgtcggcccgtggtaccgaacggtaccttaccgttccgtccggtaacttccggtccgttccgtcggacggtccgggtacgtaccggg

SEQ ID NO: 129364 - DNA, 660 bp, Homo sapiens
  misc_feature: GYAE6OF02JBVTP.45.78.H01.1.454.CMB.1.raw
  modified_base (240)..(240): a, c, t, g, unknown or other
  misc_feature (240)..(240): n is a, c, g, or t
  modified_base (249)..(249): a, c, t, g, unknown or other
  misc_feature (249)..(249): n is a, c, g, or t
  modified_base (255)..(255): a, c, t, g, unknown or other
  misc_feature (255)..(255): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaggtcctcngcaagcttngatacnccttcaccggactactatatactacgtggtgcgacgacggccccgtggacgaagggctgaggtggagtgggataggataccaaaccctaagaagtggtacggacaacaactagtacgacaacgaaggtaaggtttacgacgggtacgacggggttaccaaccgtaatacggaaccggtaacgggactaaccggtaccaacgtaccgacgacgaacgtacgaccctaacacggtaggacggtcgaggacgcggtaacggtcgtacgggtataacgttacgtaacggaccgtacccgaccgggttaccgttacggttaacttttaaccggtaggttacggaacgggaaggtacggggtacgtaacgggttaaacgttttaccggttaagggtttttgggtaacgggg

SEQ ID NO: 129365 - DNA, 730 bp, Homo sapiens
  misc_feature: GYAE6OF02JK8K3.45.78.H01.1.454.CMB.1.raw
  modified_base (371)..(371): a, c, t, g, unknown or other
  misc_feature (371)..(371): n is a, c, g, or t
tcagacgcgatcgacacgaccggtgctcgatttagtgtgagtagtttgggtttgggggtaggtcagacccagtcaggacacagcatggacatgagggtccccgctcagctcctgggctcctgctgctctggctcccaggtgccaaatgtgacatccagatgacccagtctccttccaccctgtcctgcatctgtaggagacagagtcaccatcacttgccggcagtcagagtattagtaatggttgcctgtatcgagcaagaaaccgagggaaacgaccccgtaagtcctcctcgactctaataaggcatacctagtttaacgaaaggtcgggtaccatacgtaaggtcagcgacaggtgatcgtaggacngtaatcactctacacctagtacaggacacggtccctagaccgagtccgtagttaaagtcgtttaacgttttacgaactttaaaccgtttttaccgttaacgttaacgtaccctaaaacgttaacgttaacgtttacgtaacgttttaaaggttttaccgttttaaccgggttaaacccgttttcccgggggaaaacccgttaaaaccggggtaaccgtaaaagggtttacggttaaacgggttaaaaccgtttaaacccggaaaaaacggttttaccggttacgggtaaccgggttaacccgttacggtaaccccgtaaccgtttaaaccgttccggttttacgtttaccccgtttacc

SEQ ID NO: 129366 - DNA, 563 bp, Homo sapiens
  misc_feature: GYAE6OF02ITVVS.45.78.H01.1.454.CMB.1.raw
tcagacgcgatcgacacgaccggtgctcgatttagtgtgagtagtttgggtttgggggagtcagacccagtcaggacacagcatggacatgagggtcccccgctcagctcctggggctcctgctgctctggctcccaggtgccaaatgtgacatccagatgacccagtctccttccaccctgtctgcatctgtaggagacagagtcaccatcacttgccgggccagtcagagtattagtactggttggcctggtatcagcagaaaccgagggaaagcccctaaggcctcctgctctataaggctactctagtttaagaaaggtcggggtacccattactaaggttcaggtcggacagtggatcgtagggacagaatcactactcacctatcgagacagcctagccacgtctgagtgtagtttgactaactttattacctgacccaatagtattagaatttagttagttacgtacgtttaccggaccgtaaaggggaccctaaggtacggaaactacgaaacgtaacgtggtagtctacggctaccagtctgttacgtctaccg

SEQ ID NO: 129367 - DNA, 594 bp, Homo sapiens
  misc_feature: GYAE6OF02GFQLC.45.78.H01.1.454.CMB.1.raw
  modified_base (445)..(445): a, c, t, g, unknown or other
  misc_feature (445)..(445): n is a, c, g, or t
tcagacgcgatcgacacgaccggtgctcgatttagtgtgagtagtttgggtttgggggagagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaggtctcctgcaggcttctggatacaccttcaccggctactatatacactgggtgcgacgacggcccctggacaagggctgagtggagtgggatggatccaaaccctaacaagtggtgacaacaaactatgacacgagtaagtttcgagggcgagggtcaccagtcgaccgaggacacgtccatcacgacacgacgacctacagtagggacncgtaggacgacgacggtcgtaggtaacgcgttacgtacgaccggtacgtaccgggtaccggtttacggttaactttacggtcggtaggtaccggaacgggtacggtaccggtaaggttaaacggtttacgtttaaggtttttaacgggg

SEQ ID NO: 129368 - DNA, 654 bp, Homo sapiens
  misc_feature: GYAE6OF02H00DO.45.78.H01.1.454.CMB.1.raw
  modified_base (417)..(417): a, c, t, g, unknown or other
  misc_feature (417)..(417): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcacatcacttgccgggcagtcagagtattagtaactggttggccgtggtatcagcaagaaaccgaagggaaacgccctaagctcctgtctactataaggcatactaagtttaaggaaagtcggggtaccatacgtaaggtcgacggcggacgtagtggatcgtagggacaagtactcactctcacactcgagcacgccgtcgacacgtctagnttgtattttcgacttaaactttacgttaacgttcgaacctaaacgtaagttacgtaagtaacgtttaaggtttacgttaccgggtttaaccggtttccgggaaaccgtaaaaccgggggtaaccgtaaaggggttaacgtaaacgttaaccggaaaaaccggttaaccggtagggttaacggtaccgttaggaaccctacgtacgttaccggtttctttacccttaccgttaacccg

SEQ ID NO: 129369 - DNA, 640 bp, Homo sapiens
  misc_feature: GYAE6OF02JY3Y5.45.78.H01.1.454.CMB.1.raw
  modified_base (364)..(364): a, c, t, g, unknown or other
  misc_feature (364)..(364): n is a, c, g, or t
tcagacgcgatcgacacgaccggtgctcgatttagtgtgagtagtttgggtttgggggaggtcagacccagtcaggacacagcatggacatgagggtcccgctcagctcctgggctcctgctgctctggctcccaggtgccaaatgtgacatccagatgacccagtctccttcaccctgtcctgcatctgtaggagacagagtccaccagtccacttcgccgggccagtcagagtattagaacgttgttggcctggtactcagtcagaaaccgagggaaacgccctaaggacctcctagctctaatacggctagtctacggtttaagtaaacgtcggggtccagtcgaaaggttcaaggcggtnacggtggactacgtaggacagtaagtctactactcgactactacgacgacagtccgtcgacgtacgacccgtagtactacgtatttcggacttaaacgtttacttaccgttgaccctaaagtacggttaatggtaacttagttttaacgtaccgttaacgtttacccggacgtaaacggtacccgtaagggaccgggtaaaacttacgaaaccgggttaatacgggtaacgttcgacggaccgtaactacggttctacggtttacttacgtacccg

SEQ ID NO: 129370 - DNA, 534 bp, Homo sapiens
  misc_feature: GYAE6OF02F5N8W.45.78.H01.1.454.CMB.1.raw
  modified_base (527)..(527): a, c, t, g, unknown or other
  misc_feature (527)..(527): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgcccgggcagtcagagtattagtaactggttggcctggtatcagcagaaaccagggaaacgccctaagctcctgctctataggcatctagttagaagtcggggtccatacaaggtcacgcggcagtggatcgtggacaagtaattcactctcaccatcgagcacgctgcagcctgatgtactttgactaacttattactcgaccaatagtatagtattagttacttcggtacgttaccgacggtaaaggaccgaaggttacgaatacgaaacgtacgttggtcggtcagtacacctacttctacttaccgtnttacccg

SEQ ID NO: 129371 - DNA, 551 bp, Homo sapiens
  misc_feature: GYAE6OF02FPDF7.45.78.H01.1.454.CMB.1.raw
  modified_base (412)..(412): a, c, t, g, unknown or other
  misc_feature (412)..(412): n is a, c, g, or t
  modified_base (417)..(417): a, c, t, g, unknown or other
  misc_feature (417)..(417): n is a, c, g, or t
  modified_base (424)..(424): a, c, t, g, unknown or other
  misc_feature (424)..(424): n is a, c, g, or t
tcagacgcgatcgacacgaccggtgctcgatttagtgtgagtagtttgggtttgggggacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggcttgagtggatgggatggatcaacctaacaatggtggcaacaaactatgcacagaagtttcaagggcagggtcaccatgaccagggacacgtccatcagcacagcctacntggancgtagancgaggctagagatcgtagacgaccacgggaccgttagttacttacgtagtggcggaaggagggccgaagggtaactttaccgggtaatttttacgggaggtttaggtttaagttacgggtaacgggg

SEQ ID NO: 129372 - DNA, 764 bp, Homo sapiens
  misc_feature: GYAE6OF02JHPI5.45.78.H01.1.454.CMB.1.raw
  modified_base (166)..(166): a, c, t, g, unknown or other
  misc_feature (166)..(166): n is a, c, g, or t
  modified_base (258)..(258): a, c, t, g, unknown or other
  misc_feature (258)..(258): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatcgacccngtcctcccttccaccctgtctgcatctgtaggagaacagagtcacatcacttcgccggcacgtcagagtattaggtacgtggttcgcgtgtntcagacaacgaacgaggaacgtccctaagcctaccgtcgactacgtacgtaacgctatacgttaaggttaaggaacggtcggggtaccagtacgtaacggtcgaggcggtacgtaaggtgacgttacggtaggaaacgtagtaacgttaccgacctttaccaccgtaacccgtaacgttacgacggtaccgtaacggccccgttcggaacggttacccggtccgttaggtaagtttaccggttaacgtttccgaaaccgtttaaacctttacgttaacccgttaccgtaaacctaacggttaacggttaacgtagttaacgttttaaccggtttaacggttaccggtaacccggtttacgggaaaccccggttaaaacggggtaccgttaaacggggtaccgtaaaagtaacccggtaaaaccggttacgttagggttaccggtaacccgttaacggtaccaacccgttacggttacccgtttcgttaaccgttacccgtacccgg

SEQ ID NO: 129373 - DNA, 603 bp, Homo sapiens
  misc_feature: GYAE6OF02JZK75.45.78.H01.1.454.CMB.1.raw
  modified_base (197)..(197): a, c, t, g, unknown or other
  misc_feature (197)..(197): n is a, c, g, or t
  modified_base (289)..(289): a, c, t, g, unknown or other
  misc_feature (289)..(289): n is a, c, g, or t
  modified_base (323)..(323): a, c, t, g, unknown or other
  misc_feature (323)..(323): n is a, c, g, or t
  modified_base (333)..(333): a, c, t, g, unknown or other
  misc_feature (333)..(333): n is a, c, g, or t
  modified_base (361)..(361): a, c, t, g, unknown or other
  misc_feature (361)..(361): n is a, c, g, or t
  modified_base (389)..(389): a, c, t, g, unknown or other
  misc_feature (389)..(389): n is a, c, g, or t
  modified_base (395)..(395): a, c, t, g, unknown or other
  misc_feature (395)..(395): n is a, c, g, or t
tcagacgcgatcgacacgaccggtgctcgatttagtgtgagtagtttgggtttgggggtcgaggacccagtcaggacacagcatggacatgagggtccccgctcagctcctggggctcctgctgctctggctcccaggtgcccaaatgtgacatccagatgacccagtctccttccacctgtctgcatctgtagganacagagtcaccatcactgccgggcagtcagagtactagtaactggttagcctggtatcaagctagaaaccaagggaacgtccctaaagctcngctctatagcatctagtttagaagtgggtcctancgtaaggttnaggcgacaggtgatcgtggacagacttnactctacgtacatcagtacagaccgttnacgtanccgtgaacttggtacttttagacttaactttattacctacgtaccgtaataacgttatagtaacgttaggtttaagttccgtaagggttccgtaccgaaacgggttaccaaggggttaccgaaatccgtaaaaggtcgtaagggtttcgaccgtttacggaccgtaacccgtagtccgtttacgtaccggtttcctaagtttccccgg

SEQ ID NO: 129374 - DNA, 563 bp, Homo sapiens
  misc_feature: GYAE6OF02G4LD0.45.78.H01.1.454.CMB.1.raw
  modified_base (394)..(394): a, c, t, g, unknown or other
  misc_feature (394)..(394): n is a, c, g, or t
  modified_base (407)..(407): a, c, t, g, unknown or other
  misc_feature (407)..(407): n is a, c, g, or t
  modified_base (545)..(545): a, c, t, g, unknown or other
  misc_feature (545)..(545): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttcacctgtctgcatctgtaggagacagagtcaccatcacttgccgggccagtcagagtattagtaactggttgcctggtatcagtcagtaaaccaggggaaacgcccctaagcctaccgtggcctctataagggctatctagtttagaaagtcggggttacccagtcgaaggttcaggcggcaggtggatcgtgggactagaagttcactctcactatcgancagcctgcagccngtactgtatttgactattacttacacgccaactaggtaatagtacgtattaacgttcgaccgtttcgggaccctaaacggggacaacggttacggaaataccgtaaacggtaacgttgtacggacttggaccaacgtntccgttgtacttctaccg

SEQ ID NO: 129375 - DNA, 642 bp, Homo sapiens
  misc_feature: GYAE6OF02I88OU.45.78.H01.1.454.CMB.1.raw
tcagacgcgatcgacacgaccggtgctcgatttagtgtgagtagtttgggtttgggggagtcagacccagtcaggacacagcatggacatgagggtccccgctcagctcctggggctcctgctgctctggctccaggtgccaaatgtgacatccagatgacccagtctccttccaccctgtctgcatctgtaggagacagagtcaccatcacttgccgggcagcagagtattagtaactggtgcctgtatcgagacaagaaaccgagggaaacgccctaagctacctgtctactaagtaacggctatcgttaaggttagaaaggttcggggtaccagtactaaggttcgaggtcggagagtggtacgtcgtgggaacagtaacttacactctacaactactacgacgtacaacgcctcgactagtaccgtgtattagtagttttacgaacttaactttacttactacgtacctaactagtatagtagttacgtttagttaccggtaccggttaacggaccgtaaacggggtaccgtaaggggttaacgtaaacttaaccggaaacggttaaccgttagggttacggtaccgtacgtaccgtaacccgttgtaccgtttacggtttaccttacccgttacccg

SEQ ID NO: 129376 - DNA, 739 bp, Homo sapiens
  misc_feature: GYAE6OF02FZEOL.45.78.H01.1.454.CMB.1.raw
  modified_base (293)..(293): a, c, t, g, unknown or other
  misc_feature (293)..(293): n is a, c, g, or t
  modified_base (351)..(351): a, c, t, g, unknown or other
  misc_feature (351)..(351): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcgagtgaaggtctcctgcaaggtcttcgtggatacaccttcgaccggctacgtatatacactgggtncgacacggcccctggacaagggcttggagtggagtgggatgggactacgaaaccctanaacgtggtggacaacaaacttagacgacaacgaggtaacgtttacggacgggtcgtacggggtaccaaccgtagtacggaacccgaacggggtacctaacccggttacccgtaacgtaccgtaacgaccgtaaccgacgtacccgttaacgtaggtaacgggtacggtaccgttacgggaacggtaccggtaacgggtaccgttaagggaacggtaacgttacccggtaacgggtaaccggttaacccgggacccggggtaccggtttaacggtttaacgtttaaccggtttccgggttaacgggtaaccggtaacgggtaacgggtaccggttaaaacgggttaaaccgttttaacgggttttaggtttttacggggttaaacgggg

SEQ ID NO: 129377 - DNA, 693 bp, Homo sapiens
  misc_feature: GYAE6OF02IPNS9.45.78.H01.1.454.CMB.1.raw
  modified_base (379)..(379): a, c, t, g, unknown or other
  misc_feature (379)..(379): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtacttactgtgcgagagcgaggtaattacgtattttggagttggttagttcggacggttagtgggtacgttcgnggggccgaagggaccgtacggtctaccgtctacctcgacgtcctcccaccgaacgggcccacgttcccggtccgttacccccgtcggcccctaccccttcccgtacccaaacggtaccgcctaacccgttccggtaccgggggtccaacccgacgggcccggggtccccggttaccggggtccgtccgggtcccggttacgggtaccgaaacgggttaacccctttaacccgtttacccgttacccgggtaaccgttcccgggtcccggttaccggttacgggtaacgggtccccgggggtcgttacccggggg

SEQ ID NO: 129378 - DNA, 615 bp, Homo sapiens
  misc_feature: GYAE6OF02HFB4H.45.78.H01.1.454.CMB.1.raw
  modified_base (286)..(286): a, c, t, g, unknown or other
  misc_feature (286)..(286): n is a, c, g, or t
  modified_base (327)..(327): a, c, t, g, unknown or other
  misc_feature (327)..(327): n is a, c, g, or t
  modified_base (504)..(504): a, c, t, g, unknown or other
  misc_feature (504)..(504): n is a, c, g, or t
  modified_base (601)..(601): a, c, t, g, unknown or other
  misc_feature (601)..(601): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctganagtctgacgacacggccgtgtacttacgtgtgcgagacggnaaggtaattaccggtattttggagttgggttattacgggtacgtagtggacggttcgtggggacccgaaggggacccgtacgggtccaacccggtctcccgtcacggtcccctacccgaccgaacggggccctagtacccgggttcccttcccccggtcggaccctaccccttcccnccaacgtacgacccgtacccgtcgggacggggccaacgcgacccggcctagggcctcgccgtggtacgacggtacctactccgtagactcggctcgnggcggcgggctcgg

SEQ ID NO: 129379 - DNA, 685 bp, Homo sapiens
  misc_feature: GYAE6OF02ING72.45.78.H01.1.454.CMB.1.raw
tcagacgcgatcgacacgaccggtgctcgatttagtgtgagtagtttgggtttgggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattacgtgtgcgagaggcaggaattacgtattttggagttggttattcggacggtagtgggtacgtcgtggggaccgaaggggacccgtaacgggtccgtaacccgtcctaccctcgacgccctacccgtaaccgaacgggccccacgttcccggttccctttccccccgtacggacccctaccccgttccctacccgaaacggactcccgtacccgttccgtaccggggggacctaaccgaccgggcccggtaccccgtcggggtccctcgggtcccgttacgggttaccgtaaacgggtaccctttacccgtttcccgttaccggaacgtttcccggtccggttccgttcgggacggtccgggggccgtaacgggg

SEQ ID NO: 129380 - DNA, 584 bp, Homo sapiens
  misc_feature: GYAE6OF02HNJ82.45.78.H01.1.454.CMB.1.raw
  modified_base (197)..(197): a, c, t, g, unknown or other
  misc_feature (197)..(197): n is a, c, g, or t
  modified_base (279)..(279): a, c, t, g, unknown or other
  misc_feature (279)..(279): n is a, c, g, or t
  modified_base (302)..(302): a, c, t, g, unknown or other
  misc_feature (302)..(302): n is a, c, g, or t
  modified_base (307)..(307): a, c, t, g, unknown or other
  misc_feature (307)..(307): n is a, c, g, or t
  modified_base (412)..(412): a, c, t, g, unknown or other
  misc_feature (412)..(412): n is a, c, g, or t
tcagacgcgatcgacacgaccggtgctcgatttagtgtgagtagtttgggtttgggggagtcagacccagtcaggacacagcatggacatgagggtccccgctcagctcctgggctcctgctgctctggctcccaggtgccaaatgtgacatccagatgacccagtcctccttccaccctgtctgcatctgtagganacagagtcaccatcacgttgccgggccagtcagagtattagtaactggtcgccttggtatcagctaagaaaccgaggaaacnccctaaagcctactgctcgtaanaggcntctagttacgaaggtcgggtccatccgaaggttcaggcgcagtgactcgtggactagtactcactctacacatcagtccagcctgctgcctgagtagtagtttancgttaacttattactcgacctacgtagttagtaacgtagttaacgtttgtaccgtacggttaccggaacgtaacgggtaccgtaaggttacggtaaaccttaaccggaaacgtaaccgttgggtaccgtcgttacgacctacggtacttcggtcgttacctacgttacccgg

SEQ ID NO: 129381 - DNA, 527 bp, Homo sapiens
  misc_feature: GYAE6OF02HCNR0.45.78.H01.1.454.CMB.1.raw
  modified_base (339)..(339): a, c, t, g, unknown or other
  misc_feature (339)..(339): n is a, c, g, or t
  modified_base (439)..(439): a, c, t, g, unknown or other
  misc_feature (439)..(439): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggcttggagtggatgggatggatcaaccctaanaatgggtgacaacaaactatgacacgagtaagtttcgagggcagggtcaccgatcgacaggacacgtaccatcacgacaacacgacctacgagtaggacncgtggacgtcgaggcgtagagtactcgtagacgacgacggtcgtagtatactggtagacgagagcgaagtagttacgtagtttgtagg

SEQ ID NO: 129382 - DNA, 735 bp, Homo sapiens
  misc_feature: GYAE6OF02H4ZG7.45.78.H01.1.454.CMB.1.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtgggctgaggtgaagaagccgtggggcctcgaggtgaaggtctccgtgacaaggtcttcgtggatacaccttcaccggctactatactacacgtggtgacgtacgacggtaccccgtaggacgaacggtcgttaggacggtaggacgtggggtaagtggacgtaccgtaaacccgtaaacgaacggttacgggtacggtaacaaaccgtaaaacgttacgtacggtacctaacgtaaacggttaacggtttacggaacggggtacgtaacggggtaccacccgtaacggttacggaacccgtaacgggggtaacctaccggtacccgtaaacgtcggtaacgaccaaacgtacggaaccctagtaacgtcggacggcgtagaccggcgtaacggtcaacgggtaatacgtacggaacgaccggaaccggtaccgggtaccgtttaaggtaacgttaccggttaggaccgggtacgtaacgggacggtaacgggtaacggttaaacggttttacggtttacggtttagggttaacgggg

SEQ ID NO: 129383 - DNA, 715 bp, Homo sapiens
  misc_feature: GYAE6OF02I472J.45.78.H01.1.454.CMB.1.raw
  modified_base (191)..(191): a, c, t, g, unknown or other
  misc_feature (191)..(191): n is a, c, g, or t
  modified_base (304)..(304): a, c, t, g, unknown or other
  misc_feature (304)..(304): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtncagtctgggctgaggtgaagaagcctggggcctcgacgtagaaggtctccgtagacaaggtccttcgtggactacaccgttcaccggctactatatacacgtgggtcagtacncggccctggacgaagggcttagcgttggactgggactggactaccgtaaaccctaaagtaagtcggggtaggtacctaaaccgaaacgttaacgtggaaccgtaaccgtaaagggtaaacgtttaccggacgggtacgtaacggggtacctaaccgagttaccggaaaccgtaggggaacccgtacgtaccgtaactaccgtaacgtaccgttaacgaccgtaaccttaaccgaaggttaccggagtaccgtaggacgtacggaacggtacgtaacgtaacggttactaccgttaacggaaccgtaaccgaccgggtttaccgtacggtaacgtttaacgtggtaaccggtacgaacggtacggtaccgtaaagggttacgtttaacggttacggtttttaggtaacgggg

SEQ ID NO: 129384 - DNA, 691 bp, Homo sapiens
  misc_feature: GYAE6OF02HT4PJ.45.78.H01.1.454.CMB.1.raw
  modified_base (268)..(268): a, c, t, g, unknown or other
  misc_feature (268)..(268): n is a, c, g, or t
  modified_base (298)..(298): a, c, t, g, unknown or other
  misc_feature (298)..(298): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctggaggtgaagaagccgtggggcctcgagtgaacggtctccgtgcaaggtcttcgtggataccncttcgaccggactactatatacacgtggtncgacacggcccctggacgaagggtcttaggacgtggagtgggagtggtaactaccgaaaccctaaagaagtcgggtacggaccaacgtaaactagtcgacaacgtaagtaacggtttcgaacgggtcgaacgggtaccaccgtagtcgaaccggaacgggaccgaaccgtaccagtacgacgtaccaacgtacgaccttaagaacgtcgggaacgcgtacggacggtaccgaggtcgtaggtaagtaaccgttcgtaacggaccgtaaccgtaccgggttaccgttacggttaaccgtttaaccggtcgggttaaccggacgggtaagggtaaccggtacggtaaacgggttaacgttttaaccgggttttaggttttaacggggttaacggg

SEQ ID NO: 129385 - DNA, 614 bp, Homo sapiens
  misc_feature: GYAE6OF02IG7KU.45.78.H01.1.454.CMB.1.raw
  modified_base (274)..(274): a, c, t, g, unknown or other
  misc_feature (274)..(274): n is a, c, g, or t
  modified_base (279)..(279): a, c, t, g, unknown or other
  misc_feature (279)..(279): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaaactatgcacagaagtttcagggcagggtcaccatgaccagggacacgtccaatcagcacagcctacatgganctgancaggctgagatctagacgacacggccgtgtaattactgtgcgagaggacaggtaatacggtatttttggagttgtattggacgtatggacgtcgtggggaccaagggaccacggtcaccgtctacctcagcctcaccgaacgggcccagtcggtaccttcccccgtggcaccccttcctaccaacgacgccacctccgtcgggggaccacgacgccggaccctcgggtcctcgacccgtacgggttaccgaaacgggtaaccttaccgtttacccgtaccgtacgttaccggtcccgttaccgttaccggacggtacccggggccgttaccgggg

SEQ ID NO: 129386 - DNA, 792 bp, Homo sapiens
  misc_feature: GYAE6OF02FQUUF.45.78.H01.1.454.CMB.1.raw
  modified_base (269)..(269): a, c, t, g, unknown or other
  misc_feature (269)..(269): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaaccctaacaatggtggcaacaaactatgcacagaagttcgaggcagggtcacatgaccagggacacgtccatcagcacacgcctaacntaggacgctaggagcgagggctaggagactacgtcggaaccgaccgtaccgggcccgttagtacttacgtggtcggacgaggagacgaagtaagtttacggttattttaggggaggtttaggttacgtttacgggacggttaggtcgggtaacgttcgggtacgggggtaccgaaacggggtacccgtacgggtccgtacccggttcctaccgtaccgaaccgtccccgttacccgaaaccggtacccgggtacccgtacggtacccggtttcccccgttacccccggtcgggtccccttaccccccgtacccgttacccgaaaccgggtacccgtacccggttacccgtacggggttaccgggggaccctaccggaccgggtacccgggccccggttcggggacctccggtcccggtggtaacccggtaaccgggtaacccgttacccgtttacccgtaccggtacgttacccggtccggttttccgaacggggtacccggtaccggggtacgttaccgggg

SEQ ID NO: 129387 - DNA, 714 bp, Homo sapiens
  misc_feature: GYAE6OF02H93LT.45.78.H01.1.454.CMB.1.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaaggccgtggggcctcgaggtgaaggtctccgtgacgaaggtcctttcgtggaactacctaccttccgaccggtacctaactataactaacgacgttggggtagccggaacgacggtcccccgtagggaaccgaagggtccttagggaggttagggtagtggggtatacgggaactaccgtaaacccgtaaacgaacgttaggggtacggactaaaccgtaaactacgtacgaccgtaacgtaaggttaacggtttcggaacggggtacgtaacggggttacccaaccgtaacgttaccgggaaccgaacggggtacctaaccggtaccgtaacgtacgaacgaccaacgtacgtactacgtagtacgagtcgtagacgacgacggtcgtagacgtactacgtacgacgtaccgacgggtaccgttagtacgttacgtcggtacgtacggagtacggtacgtaaggttaacgtttacggttttacgtttagggttaacgg

SEQ ID NO: 129388 - DNA, 935 bp, Homo sapiens
  misc_feature: GYAE6OF02JUUZK.45.78.H01.1.454.CMB.1.raw
  modified_base (174)..(174): a, c, t, g, unknown or other
  misc_feature (174)..(174): n is a, c, g, or t
tcagacgcgatcgacacgaccggtgctcgatttagtgtgagtagtttgggtttggggtaggagcatcacccagcaaccacatctgtcctctagagaatacccctgaagagctccgttcctcaccatggactggacctggaggatccgtcttcttggtggcagccgggaccccanacggacgcccccaacgtccccaggtcgaccgaggaccttgggttcgccgtacggtccgtgggggtccttagggacggaaacgtaaggaccgtcccgggtggggcccttagacggttacggtaacggttcccgtaccgtcgaccgtaaggtccttacggtacggtacgtacccgtaccttaccggggtttaaccgacgttaactaccgtacttacggggtacctcgggtaacgcgggacccccgatttacctttaaacccggggtaaccggttaaacggggttagtaggtacgggtagttaccggggtaattaacggccccccggtttaccccccggttaaaataacgggtttacggggtccgaaaccgaaaaaccgttaaaacgttttacggtaccggaacccgtaaaaccggtaaacggtttttaaacccgttaaccggggtaccgggtaacccggggttaacggggtaaccccgtaaccgaaaaccgtttaaccccgggaaaccggaacccggtaaacgtaaccgtaacctaggtaaccgaccgaacccgaaccgtacccggtaacctaacggtaacggtacggtaccgttacgggtaaacggttacccgaacggggtcccgttaaggaacggttaccgaaccgtttacggaaccggtaccgtacgggtacccgacggtttaaccggtaacgttggggaacctagggtactacgggacgtttacgggaactttagggtactttcgggtagtttaacggg

SEQ ID NO: 129389 - DNA, 638 bp, Homo sapiens
  misc_feature: GYAE6OF02GQ35E.45.78.H01.1.454.CMB.1.raw
tcagacgcgatcgacacgaccggtgctcgatttagtgtgagtagtttgggtttgggggagagcatcacccagcaaccacatctgtcctctagagaatcccctgagagctccgttcctcaccatggactggacctggaggatcctcttcttggtggcagcagccacaggagccactcccaggtgcagctggtgcagtctgggggctgaggtgaagaagccgtggggcctcagtgaaggtctcctgcaaggcttgtggatacacttcaccggctactatatacacgtggtgcgaccaggcccctggacgaaggtcttaggacgtggagtgggatggataccaaaccctaacaaagtgggttggactaacaaaacgttgtagactaacgaaggtaaacgttttcgaaggggtaccgtaacggggtacaacccgaacgttacgacccggtaagggaacccaacggttacccaagttaccagacccgaagacggtacctaacgacggttaggacggactgaaccggcggtaacggaccgttagacgtaactcgtaggaccgacaccgggttaccggagttacgttacgtgttacggacgtaagggacgaccggaaggtaacgtaccggttaagtttttacggg

SEQ ID NO: 129390 - DNA, 772 bp, Homo sapiens
  misc_feature: GYAE6OF02IPMAU.45.78.H01.1.454.CMB.1.raw
  modified_base (187)..(187): a, c, t, g, unknown or other
  misc_feature (187)..(187): n is a, c, g, or t
  modified_base (208)..(208): a, c, t, g, unknown or other
  misc_feature (208)..(208): n is a, c, g, or t
tcagacgcgatcgacacgaccggtgctcgatttagtgtgagtagtttgggtttggggtgaagaagcctgggcctcagtgaaggtctcctgcaaggcttctggatacaccttcaccggctactatatacactgggtgcgacaggcccctggacaagggcttgagtggatgggatggatcaaccctaanaatggtgcacaaactatgcanagtaagtttcgagggcaggtcacctatcgaccagggaccacgtaccatcacgacacacgccctaacagtcggagctaggagcgaggctgacgatcgtagaccgacgaccggtcgtatacgttctggtgcggaaggacgggactaagggtaactttacggtagtttttcggagtttaggttaggttacggtacgttaggtagggtacgtcgtacgggggaccgaacggggtccaccgggttccgtaccggttaccgtaccgtcgaccgtcccgtacccgtaccggaaaccgggtccctacggttaccggttccccgtttacccccggtacgggtccccttaaccccgttaccccgtaccgaaaccggttccgaccctacccggttaccgggttcccggggtaccgacccggtaccgggccccgggtacccggttccgggtccgtaccgggtcccgttacgggtaacccgggtaacggttacccgttacccgtttaaccccgtggttaacccggttcccggtaccggttccgttacggaccggggttccgggtccgtaacccgggg

SEQ ID NO: 129391 - DNA, 631 bp, Homo sapiens
  misc_feature: GYAE6OF02HM8FX.45.78.H01.1.454.CMB.1.raw
  modified_base (301)..(301): a, c, t, g, unknown or other
  misc_feature (301)..(301): n is a, c, g, or t
  modified_base (460)..(460): a, c, t, g, unknown or other
  misc_feature (460)..(460): n is a, c, g, or t
  modified_base (475)..(475): a, c, t, g, unknown or other
  misc_feature (475)..(475): n is a, c, g, or t
  modified_base (481)..(481): a, c, t, g, unknown or other
  misc_feature (481)..(481): n is a, c, g, or t
  modified_base (502)..(502): a, c, t, g, unknown or other
  misc_feature (502)..(502): n is a, c, g, or t
tcagacgcgatcgacacgaccggtgctcgatttagtgtgagtagtttgggtttgggggagagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagccgtggggcctcgagtggaaggtctccgtgcaaggcttcgtggactaccgtaccttcaccggcttacctatactacgactgggtnacgtacgacgggcccctaggaccaaggggtctttaggaggttcggagtggggagttgggactaccgaaaccctaagaagtgggacggacaacgaactagtcgacaacgtagtagttcgagggtcgagggtccacagtcggaacgtacggactacgccancacgacacacgctangtgaancgtagagcgaaggtcgtacgngtaacgtcgtaagaccgtaccgggcggttaccgttaggttaccttaggtaacgggttcgaacgggtaacggtaaccggggagtttaaaccgggtaaacggttttacgggtttaggtttttaaacggggg

SEQ ID NO: 129392 - DNA, 620 bp, Homo sapiens
  misc_feature: GYAE6OF02FF8FS.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaacctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgtattttgggagtggttattcgggacggttagtggacgtcgtgggggtaccaaggggaccacggtcaccgtctcctcacgcctcccaccaacgggcccagtccggtccttccccctcggccacccctccctaccaacgacgccaccgtccgtcggggccacgtacggccggtcccgtcgggccgtcggtccgtcgggtaccgtaaacggggtacccttaacccgttcccgtacggtaaccgttccgggtcccgttaccggtcggacgggtcccgggggcgttaccgggg

SEQ ID NO: 129393 - DNA, 664 bp, Homo sapiens
  misc_feature: GYAE6OF02JA91V.45.78.H01.1.454.CMB.1.raw
  modified_base (253)..(253): a, c, t, g, unknown or other
  misc_feature (253)..(253): n is a, c, g, or t
  modified_base (273)..(273): a, c, t, g, unknown or other
  misc_feature (273)..(273): n is a, c, g, or t
tcagacgcgatcgacacgaccggtgctcgatttagtgtgagtagtttgggtttgggtgaagaagctgggctcagtgaaggtctcctgcaaggcttctggatacaccttcaccggctactatatacactgggtgcgacaggcccctggacaagggcttgagtggatgggatggatcaaacctaacaatggtggacacaaacttatcgcacagtaagtttcagggcagggtcaccatgaccagggacacgtccancagcacacgcctacataggngactgacggcaggctgagctcgtgacgacgaccgcgttcgtattactggtacgcgaagcggtcagtaacgttagtagtttttagggagtttgttacttacgggaacggttattcggggacttcgtacgggggaccgtaaaggggacccgtacgggtccgtaaccgttcgtccctcgtaacgtcccctaaccgtaccgaaacggggaccctacggttcccggtcccgtttccccgacccgggtccctaccccgttacccctacccacggtaaaccggcctaacccgttcgcgggggtccaaccggacgccgggtccctggggctccgcgtcgggtaccgtacgactccgttaccctgtaccgtacgtccgtgtccgaggcccgggtgtacgg

SEQ ID NO: 129394 - DNA, 777 bp, Homo sapiens
  misc_feature: GYAE6OF02FR44X.45.78.H01.1.454.CMB.1.raw
  modified_base (253)..(253): a, c, t, g, unknown or other
  misc_feature (253)..(253): n is a, c, g, or t
  modified_base (260)..(260): a, c, t, g, unknown or other
  misc_feature (260)..(260): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtggggcctcgagtgaaggtctcctgcaggcttcnggctacnccttcaccggcgactatcctacctacgtgggtcgcgacgacggcccctggaccgaagggcttgacggtggagtgggatagggataccgaacctaacaagtcggtaggacctaacgaaactagtcgtaccgaacgtacggttaacgtttaccggaaggggtccgtaacgggggttaccctacccggtaacggtaaccggtaaccccgggacggggtaaacccgtaccgttacccgaaccgttaccgaacggacccgaaaccgccggtaccccgttaacgaacggttcgggtaactccggttaggaccggtaccgtaaccgggtaaccttacggaaccgttacgttacccggtacgtaacccggtaacccgtacccggtaaccgtttaaaccgttttaccgtttaaccggttcggttaaccgggtaaccgggttaaggttaaccggtttaccggggtttaaccccggggtttacgggttacccggtttttaccggggttttaccgtttttaacccgggg

SEQ ID NO: 129395 - DNA, 563 bp, Homo sapiens
  misc_feature: GYAE6OF02HTN2J.45.78.H01.1.454.CMB.1.raw
  modified_base (392)..(392): a, c, t, g, unknown or other
  misc_feature (392)..(392): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcacatcacttgccggcagtcagagtattagtaactggttggcctggtatcagacagggaaaccagggaaacgacccctaagcctcctgctactaagtaaggctatctagtttaagaaagtgggtaccatacgtaaggttcagcggcagtgatcgtagggacagtattcactctcacatcagcagcctnctagctagtatgtatttgacttaacttattacctgaccaaatagttatagtaattagttagttaccgtaccgttccggaccgtaaagggtaccgaaggtacgaaacgtaccgtaaaacggacgttaggtacggtccgtacgacctactacttcgttctaccttaccgtacc

SEQ ID NO: 129396 - DNA, 729 bp, Homo sapiens
  misc_feature: GYAE6OF02IHXK2.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaaactatgcacagaagtttcagggcagggtcaccatgaccagggacacgtcatcagcacagcctacatggagctggagcgaggctggagtatcgtagacgacgacgggccgtgtattactgtgcgagtaggcgaggtaattacggtatttttgggagtttgggttagtttcgggtacggttttagtagggttaccggttacggtcgggggtaccgaaacggggtaccgtaccgggttaccgacccggttccgtacccgtaccgtaacgccccgttaccgaacccggaaccggggacccctacgtttcccggtacccgttttcccccgtcgggcccctaccccgttaccctaccgaaacgacgacccgtaccgtccgggttcggggggacctaaccggacggccccgggtacccgttcggggaccttccggcccgttcgggtaccgtaacgggtacctttaaccgttcccgttacggtaacgttcccggttacggttcccggtagggtacgggtccgggtcgtaccgggg

SEQ ID NO: 129397 - DNA, 589 bp, Homo sapiens
  misc_feature: GYAE6OF02HSL50.45.78.H01.1.454.CMB.1.raw
tcagacgcgatcgacacgaccggtgctcgatttagtgtgagtagtttgggtttggggctgaggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgaggctgagatctgacgacacggccgtgtatactgtgcgagaggcaggattacgtattttggagtgttagttcggacgtagtggacggtcgtggggaccgaacgggtaccgacgggtcaccgttcctcccgtacgacgccctaccaaccgaacgggccctacgtccggtccttcccccgtggcccacccctcctaccgacgacgaccaccgttaccgtcggggccacgacgccggtcccgtgggcctcggtccgtacggtacgtaacggtactaccgttccgcgtactccggtcgtcgtgacggg

SEQ ID NO: 129398 - DNA, 630 bp, Homo sapiens
  misc_feature: GYAE6OF02IX9PD.45.78.H01.1.454.CMB.1.raw
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctggtaggagacagagtcaccatcacgttgccgggcagtcagagtatagtactggtgcctggtatcagcaagaaaccgagggaacgccctaagctctgctctagtaggctatctaagtttagaaggtcggggtaccatcgaaggttcaggcgacagtggatcgtggacagtactcactctcaccatcgacgcagcctgcagcctagacttgtatttcgacttaactttacttacgtacgtaccctaaagtagttactaggttaacgtttaacggtttacgtttaccggtaccgggttttaaccgggaacccggtaaaggggtaacccgaacggggtttaacggaaaaccgttaaccggtaaaaaccggttaaccgtcgggttacggaccgttacggacctaacccggtattacccgttaccggttacctttaccttaacccg

SEQ ID NO: 129399 - DNA, 721 bp, Homo sapiens
  misc_feature: GYAE6OF02HS56X.45.78.H01.1.454.CMB.1.raw
  modified_base (261)..(261): a, c, t, g, unknown or other
  misc_feature (261)..(261): n is a, c, g, or t
  modified_base (403)..(403): a, c, t, g, unknown or other
  misc_feature (403)..(403): n is a, c, g, or t
tcagacgcgatcgacacgaccggtgctcgatttagtgtgagtagtttgggtttgggggagcatcacccagcaaccacatctgtcctctagagaactcccctgagagctccgttcctcaccatggactggacctggaggatcctcttctggtggcagcagccacaggacgcccactcccaggtgcagctggtgcaggtctggggctggaggttgaaagaacgccgtaggggcctacagtgaaggtctacctgacaaggcttntaggatactacttcaccggctaactagtactacacgtggtcgtacgacgacggccccgtaggacgtaacgggcttaggagttaggagtgggagtaggacgtactaaacccgtaaacgaagtggtaggaccaactaaacgtancgtacaaccgtaagtaacggtttacgaacggggcgtaacggggtacaacccgtaagtaccggaacccgaacgggtaaccgtaccggttaacccgaaacttaccgtaacaacccggtaaccgtaaccgtacccgttaaaccgaacgttacgggaacggttcccgaagggtaccggaacgtaagggttccgtaagtaacggacgttaccgtaccggaacgtaccggacggttccggttaggttaaacgttacgtacggtggaaccggtaggtacggacgtaagggtaacgttttaaccggttaggttttagggttaacgg

SEQ ID NO: 129400 - DNA, 686 bp, Homo sapiens
  misc_feature: GYAE6OF02I0I5D.45.78.H01.1.454.CMB.1.raw
  modified_base (136)..(136): a, c, t, g, unknown or other
  misc_feature (136)..(136): n is a, c, g, or t
tcagacgcgatcgacacgaccggtgctcgatttagtgtgagtagttgggtttgggtgaagaagcctggggcctcagtgaaggtctcctgcaaggcttctggatacaccttcaccggctactatactacactgggtncgacaggcccctggacaagggcttgagtggatgggatggactgaaccctaacaatggtggcacaaactatgcacagaagtttcagggcagggtcaccatcgacagggacacgtccatcagcacacgtcctaacagtggagtccgtgagtcgaggctggagactcgtacgacgacgacggccgtgtacttacgtggtgcgtagaggcgaggtaacttacgtagtttcggagttcggttacgttcggacggttagtacggtacgttcggtacggggtaccaacgggtaccgtaccggtacctaacccggtcttcccgtacgtacggtaccctaccgaaccggtaacggcccgtaagtcccgggttaaccgttcccccggtagtccccgtaccccttacccgtaccgtaacgaccgtcccgtaaccgttaccgggcggggtacctaaccgggtacgccgggtaccgacgggtcgtacgtccgtacgggtaccgaagggtacctaccgtccgttagccgttcgtcgtaccgtacggacgtccgggtctaccggg

SEQ ID NO: 129401 - DNA, 599 bp, Homo sapiens
  misc_feature: GYAE6OF02F6VSN.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgaggcgtcgagacgtctagacgacacggccgtgtattactgtgcgagaggcaggattacgtagttttggagttggttagttcggacggtgtaggtacgtcgtggggccaagggaccgacggtccgaccgtctcctcacgcctaccaccgtaacgggcccagtccggtccgttccccgtcggcctacccctcccgtccaacgcgccgacctcgcggggtaccacgacgccggccgtcgggcctcggtccgtcggtacgaacgggaccttaccgttcccgtcgtaccgtcgtaccggttcgtacggacggtccggcgtacggg

SEQ ID NO: 129402 - DNA, 653 bp, Homo sapiens
  misc_feature: GYAE6OF02JXCDO.45.78.H01.1.454.CMB.1.raw
  modified_base (293)..(293): a, c, t, g, unknown or other
  misc_feature (293)..(293): n is a, c, g, or t
  modified_base (325)..(325): a, c, t, g, unknown or other
  misc_feature (325)..(325): n is a, c, g, or t
  modified_base (332)..(332): a, c, t, g, unknown or other
  misc_feature (332)..(332): n is a, c, g, or t
  modified_base (647)..(647): a, c, t, g, unknown or other
  misc_feature (647)..(647): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaagtggtggcacaaactatgcacagaagtttcagggcagggtcacactgaccagggacacgtccatcagcacacgcctaacatggagctgagcaggctgagactntacgacgacacggcgtagtacttcgtagtcgngagaggngaggtaatacgtagttttgagttaggttagttacgggaggttacgtggtacgttacgtggggaccgaacggggtaccgtacgggtacgtaccggttccctccgttaccacggtcccctacccgaacggaaccggcccgtacgtcccggtcccgtttcccccgtcggtaccctaccccgtccctaaccggtaacgaccgtccgtaacccgtcggtaccggggacctaccgacggtcccgccgtcgggctccggtccgtgtaccggaactacgtcccttacggtcgtaccgttcggtcctcgtacggtaggtccggngtacgg

SEQ ID NO: 129403 - DNA, 793 bp, Homo sapiens
  misc_feature: GYAE6OF02HDW54.45.78.H01.1.454.CMB.1.raw
  modified_base (197)..(197): a, c, t, g, unknown or other
  misc_feature (197)..(197): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtagganacagagtcaccatcactggccgggtccagtcagagtatagtactggtcgctggtatcagcaacgaaaccgaagggtaaacgaccccgtaagcctacccgtgccttactaacgtaacggctaagttaccgtttaaggttaaggtaaacgggtccggggtaccctaacgttacggtaaaggttcgaacgggccggtacgacggtagggaacgttcggtagggaaactacggtaaattacctaccgtccttaccgaacctaagtaccgaacgcgtaacgtaccgtcgaccgtacgtaccttaggacttacggtttaagttaccgttaacgtttaaaccgttttaacttaaccggtccgtaaacccgtaaacgttaaccggttaagttacggttaaacgtttacggttttaaacgtttacccgggttaaccgggtttaaccgggttaaacgggaaaaccgggttaaaacccgggttaaagggtaaccgggttaaaacgtaaccccggtaaaacgggtacgtttaaccggggtaccggttacgtaccgggtacctacccggttaagttccggtttaaccggttccttaacccgttacccgg

SEQ ID NO: 129404 - DNA, 701 bp, Homo sapiens
  misc_feature: GYAE6OF02IJSI6.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaagtggtggcacaaactatgcacagtaagtttcgagggcgagggtcaccatcgacgagggaccacgtccatcagcacacgcctacagtggacgctaggagcgacggctgaagatcgtagacggacaccggcgtcgtattacgtgtcgtcggagacggacaaggtaacttacgtagttttgggagtttggttagttcggaggtagtggtacgtcgacggggtacgacgggaccgacggtctccgtactccgtacgacgtcccgtaccgacgacggacctacgtcccggttacccttccccgtcgacccctccctaccctaccgaaacgccgtacccgtacccggttccggtacggggtaccgaccggaaccgggtcccgggacccggttccggggtaccttccgggtacccggttacgggtacccgtaacgggttacccgttaccgtttacccggttaccgtaaccgttcccggttccgttccggttacggaccgggttcgggccggtaccggg

SEQ ID NO: 129405 - DNA, 618 bp, Homo sapiens
  misc_feature: GYAE6OF02IR35O.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggaccacgtccatcagcacagcctacatggagctgagcaggctgagatcgtgacgacgacggccgtgtacttactggtgcgagaggcaggtaattacggtagtttttggagtttggttacgttcgggaacggttagtacgggtacggtcgtggggacccgaaggggaccctacgggtcacccggttctccgtcacgtccctccaccgacgggcccagtcccggtccttccccgtgcctaccctcctaccacgacgccaccgtcgtcgggcacgcgcggccgtcggcctcggcctcgggtccgtaacggtaccttaccgttacccgtaccggtacgttcccggacggttccgtacggacggtccggggtcgtaccggg

SEQ ID NO: 129406 - DNA, 656 bp, Homo sapiens
  misc_feature: GYAE6OF02HNOSD.45.78.H01.1.454.CMB.1.raw
  modified_base (508)..(508): a, c, t, g, unknown or other
  misc_feature (508)..(508): n is a, c, g, or t
tcagacgcgatcgacacgaccggtgctcgatttagtgtgagtagtttgggttgggggagcatcacccagcaaccacatctgtcctctagagaactcccctgagagctccgttcctcaccatggactggacctggaggatcctcttcttggtggcagcagccacgaggagcccacctcccgaggtgcagctggtgcagtcgtggggctggaggtgaaggagccgtgggcctgagtgaaggtcctcctgcaaggtcttcgtggtataccaccttcgaccggtacctaactatatactacgtgggtcgcgacgaccggtccccgtaggacgaggtactggaggtggagtgggagtacggtactaccgtaaacctaacgtaagtcgggtaggaactaaaccgtaaagtcgtaagacccgaagtaacgtaacggtttacggacgggacggtaacgggtaccaacgtacgtacggaaccggacgggaacgacgtaccaacgtacgagacctaanaccggactaccgagtcggtacgtacgtacggacgcggtaacgtacgtagtaaacgcggtactacggaaccgtacgacgtccgtagtaaccgttagtcgtacgaggaacggtacgtaggacggttaagtttacgttaggttggttacgg

SEQ ID NO: 129407 - DNA, 600 bp, Homo sapiens
  misc_feature: GYAE6OF02HTTX0.45.78.H01.1.454.CMB.1.raw
  modified_base (304)..(304): a, c, t, g, unknown or other
  misc_feature (304)..(304): n is a, c, g, or t
  modified_base (397)..(397): a, c, t, g, unknown or other
  misc_feature (397)..(397): n is a, c, g, or t
  modified_base (556)..(556): a, c, t, g, unknown or other
  misc_feature (556)..(556): n is a, c, g, or t
  modified_base (578)..(578): a, c, t, g, unknown or other
  misc_feature (578)..(578): n is a, c, g, or t
tcagacgcgatcgacacgaccggtgctcgatttagtgtgagtagtttgggtttgggggagtcagacccagtcaggacacagcatggacatgagggtccccgctcagctccgtgggctcctgctgctctggctccaggtgccaaatgtgacatccagatgaccagtctccttccaccctgtctgcatctgacgagacagagtccacagtccacttggcccgggacagtacaggagttattagaacgttggtgccgtggtactcagacagaaccgaaggaacgccctaagcctcctgactacgtanaacggctctacttaagttacgtaaggtcgggtcccaatcgtacggtacagtcggacgtagtaggactcggtaggacaagtaattcaccttacnccgaacacgttcacgtccgataccgtcgctacgtccttaagccgttagttactttcgaatttaaccgttattaccacgtacactaacgtataggtacttagttacgtaccgttcgtaccgtagaacgggtaacaggtacgaacttaggaaacttacggnggttaacgcttgaccctaacgnttaccgtctccgttaactcccg

SEQ ID NO: 129408 - DNA, 682 bp, Homo sapiens
  misc_feature: GYAE6OF02IPVPC.45.78.H01.1.454.CMB.1.raw
tcagacgcgatcgacacgaccggtgctcgatttagtgtgagtagtttgggtttggggagagcatcacccagcaaccacatctgtcctctagagaatcccctgagagctccgttcctcaccatggactggacctggaggatcctcttcttggtggcagcagccacaggagcccacctcccaggtgcagctggtgcagtcgtggggctggaggtgaagaagccgtggggcctcgagtgaaggtctcctgcaaggtcttcgtggactacgtaccttccgaccggtcttaactactaatacaccgttggggtcgacgacgacgggtcccctaggaaccgaacgggtcttaggagtaggagtgggagttaggataccgaaacctaagaagtgggtacggacaacgtaaaactagtacgacgaacgaacgttaaggtttacggaacggggtaccgtaacgggtaccgaaccgtaacgtacggaacccggtaaggggaaccgtaacgtaacgtaacgtacgacgtacacgacgtaccgtaactagtacggagccgtagacgacgacggtacgtaggaacgtagtaccggtagaccggaccggtaacggtaccggttacgttaacgttacgtacgtacggacggacggtacggacgtaacgggtaacgttacggttaggttttaacgggg

SEQ ID NO: 129409 - DNA, 730 bp, Homo sapiens
  misc_feature: GYAE6OF02HSFRD.45.78.H01.1.454.CMB.1.raw
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgctatctgtacggagacagacgtcaccatcactcggccggcagtcagagtattagtaacgtggttgcctggtatcagacaagaaaccgaggaaacgcccctaagcctcctgactactaagtaaggctacttacttaaggtttaaggaaggttcggggtaccctaagtacgtaaggttcgacggcggacgtaggtggaagtcgtagggaacaagttaacttacctactacctaccgacctacgtacacgtacgtaacgccgtacgccgacgtccttaggtacgttacgttagttttacgaaccgttttaacctttaacgtttaccgttaacgtaaccctaaacgttaacgttaacgttaagttaaacgtttaaggtttaccggtttacccggttaaaccgggtttacccggggaaacccggtaaacgggtaaccgtaaacgggttacggaaaacgttacccggaaaaacgttacggttacggtacggtaccggtaacgacccgtaaccgttaccgtaccggtttaccttaccgttaccgttaacccg

SEQ ID NO: 129410 - DNA, 858 bp, Homo sapiens
  misc_feature: GYAE6OF02IYLQL.45.78.H01.1.454.CMB.1.raw
tcagacgcgatcgacacgaccggtgctcgatttagtgtgagtagtttgggtttgggggtgaagaagcctggggcctcagtgaaggtctcctgcaaggcttctggatacaccttcaccggctactatatacactgggtgcgacaggcccctggacaagggcttgagtggatgggatggatcaaaccctaacaatggtggcacaaactatgcacagtaagtttcagggcagggtcaccatagaccagggacacgtccatcagcacagcctacatggagctcgagcaggctgagatcgtagacgacgacggccgtagtattacgtggtcgacgagaggacggaaggtaacgttacggttagttttagggtaaggtttgggtttaacgtttacggggtacgggttaaggttacgggtaccggttcggtttacgggggacccggtaaacggggacccgtaaccgggtaccgtaacccggttccttccccgtacgacccgtcccgtaccccgaaaccgggtaaaccgggcccccgtaacgttccccgggttacccgtttacccccccgttacggggtacccccttaaccccccttaccccgtaaacccgtaaacggaccggttaacccccgtacccgttcccgggtaccggggggtaccctaaccggacccggggttaccccgggtcccccggttacgggggtaccccgtttccgggtccccgttaaccggggttaaacccgggtaaacccgggttaaccccgttttaacccgttccccgggttaaccggtaccggtttacccggcccgggttttaaccggtacccgggtaccggggttcccggggggtaccgttaccgggggg

SEQ ID NO: 129411 - DNA, 585 bp, Homo sapiens
  misc_feature: GYAE6OF02GA253.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtacttactgtgcgaggaggcaggtaattacgtagttttggagttggttagttcggacggtagtggacgtcgtggggaccaagggaccacggtcaccgtctcctcacgcctccaccacgggcccacgtccgtcttcccccgtgcccaccctcctaccaacgcgaccaccgtcgtcggggccacgacggccggcccgtcggccgtcgccgtggtaccgaacggtaccttaccgttcccgtcgtacgttccggccgtccgtcggacggtccgggtcgtacggg

SEQ ID NO: 129412 - DNA, 623 bp, Homo sapiens
  misc_feature: GYAE6OF02I9ELT.45.78.H01.1.454.CMB.1.raw
  modified_base (198)..(198): a, c, t, g, unknown or other
  misc_feature (198)..(198): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtcctccttccaccctgtctgcatctgtagganacagagtcaccatcacttcggccgggccagtcaggactattgaactaattatgtaggctggtatcagacaaaaaccgagggaaacgttaccgtaaggtcttggtctatgctgtctcaactttacgagtttcgggggtccctctacgtattcgagcggcaggtgggtctggggactactctttacacttctacacctataccaactagttctagcagtccctggagtattgttacgacttaacttatttacgcgtaccaaagttcgttttaacccggtcgtttccgaccttacgttaccggttcggaccgggtaaggggaaccctaggggtacgtagacttaccgaaacgtaccgttggtaccggacgtcgacctaccgtacgtttccgtttacgttttccgactttacccggttccccgtaaccg

SEQ ID NO: 129413 - DNA, 775 bp, Homo sapiens
  misc_feature: GYAE6OF02IO28A.45.78.H01.1.454.CMB.1.raw
  modified_base (295)..(295): a, c, t, g, unknown or other
  misc_feature (295)..(295): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaacctaacaatggtggcacaaactatgcacagtaagtttcgagggcagggtcaccatcgaccagggacacgtcatcacgcacacgcctacagtggacgctgacgcgaggctgacgntcgtcgacgacgaccggtccgtgttacttacgtggtcgacgtaaggacggactaaggtaacgtttacggtagttttagggagtttacgggtttacgttcgggtaacggttagtacgggtacggttcggtacggggtaaccgaacggggtaccgtacggtaccgtacccgttccgtaccgtaccgtacgtcccgttaccgaaccgtaccgggtacccgtacgttcccggttcccgttccccgtcggtacccctaaccccttccgtaccgtaaccgaccgtacccgtaccggtaccgggtacggggaccctacggaacccgggtcccggtcccggtaccgggtaccgttccggtacccggttaccgggttaacccggtaaaccggtttacccgttacccggttaccccgttaccgggtaacccgttccggtacccggttacggtacccggggtaccggttacccggggtccgttaaccgggg

SEQ ID NO: 129414 - DNA, 681 bp, Homo sapiens
  misc_feature: GYAE6OF02IKXQ5.45.78.H01.1.454.CMB.1.raw
  modified_base (136)..(136): a, c, t, g, unknown or other
  misc_feature (136)..(136): n is a, c, g, or t
  modified_base (159)..(159): a, c, t, g, unknown or other
  misc_feature (159)..(159): n is a, c, g, or t
  modified_base (166)..(166): a, c, t, g, unknown or other
  misc_feature (166)..(166): n is a, c, g, or t
  modified_base (171)..(171): a, c, t, g, unknown or other
  misc_feature (171)..(171): n is a, c, g, or t
  modified_base (193)..(193): a, c, t, g, unknown or other
  misc_feature (193)..(193): n is a, c, g, or t
  modified_base (211)..(211): a, c, t, g, unknown or other
  misc_feature (211)..(211): n is a, c, g, or t
  modified_base (299)..(299): a, c, t, g, unknown or other
  misc_feature (299)..(299): n is a, c, g, or t
  modified_base (503)..(503): a, c, t, g, unknown or other
  misc_feature (503)..(503): n is a, c, g, or t
  modified_base (666)..(666): a, c, t, g, unknown or other
  misc_feature (666)..(666): n is a, c, g, or t
  modified_base (677)..(677): a, c, t, g, unknown or other
  misc_feature (677)..(677): n is a, c, g, or t
tcagacgcgatcgacacgaccggtgctcgatttagtgtgagtagtttgggtttggggtgaagaagcctgggcctcagtgaaggtctcctgcaaggcttctggatacaccttcaccggctactatatacactgggtncgacaggcccctgagaggacgtntagtagngtagngtagagtactacctaacctaanagtgtcgacaactaactncacacgaagttacgtcggacggacgtacgtaccacctagaccgacggacgacctaccgactacacgacacctaacgacgtacctaacnggtaggactccgtaggacgcggaacggtcaaggaacgtcgtaacgtacggacgaccgtaccggtcgttattaacgttcgtgtaccgagaggacgacgaaggtactttacgtttagtttgggtaaggttggtttaacgtcgggtaagttacgtcgggtaacgtcgggtacggacggaacccggtcgtacgtaccgacgtcctacncgacgccctacgacgccgcgtacgtccgttaccctccgcgcctaccgtccacgacgctaccgtccgtacgggtcgaccgaaccgcggtaccccgcggtacgtccgtcgtacgttcgaaccgtacgtacccttcgttaccgagtcccgtacgtcgttacccggngttacccgggngtcg

SEQ ID NO: 129415 - DNA, 581 bp, Homo sapiens
  misc_feature: GYAE6OF02GBXZW.45.78.H01.1.454.CMB.1.raw
  modified_base (137)..(137): a, c, t, g, unknown or other
  misc_feature (137)..(137): n is a, c, g, or t
  modified_base (274)..(274): a, c, t, g, unknown or other
  misc_feature (274)..(274): n is a, c, g, or t
  modified_base (404)..(404): a, c, t, g, unknown or other
  misc_feature (404)..(404): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtncgacaggcccctggacaagggcttgagtggatgggatggatcaaccctaacaatggtggcacaaaactatgcacagaagtttcagggcagggtcaccatgaccagggacacgtccatccagcacagcctacatgganctgagcgaggctcgagactcgtagacgacgtaacggccgtagtattactgtgacgagagcaggaattactagttttgagtcgttatcggagtagtggacgtcgtggacaaggaccacgtcgacgtcgtcncacgcctaccacgacggccacgtccgtccttaccctcggcccaccgtcccgtactaacgcgaccaccgtcgtacggggccacgacggccgccgtaggccgtacgtccgtacggaccgaacgggaccttaccttccgtaccgtagtaccggtccgtccgtggacggtcggtcgtacgg

SEQ ID NO: 129416 - DNA, 679 bp, Homo sapiens
  misc_feature: GYAE6OF02IYDOK.45.78.H01.1.454.CMB.1.raw
  modified_base (366)..(366): a, c, t, g, unknown or other
  misc_feature (366)..(366): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtgcacaaactatgcacagaagtttcagggcaggtcaccatgaccagggacacgtccatcgagcacagcctacatggagactgagcaggctgagactcgagacgacgacggtccgtagttacttacgtgtggacgaggaggtcaaggtattacgttagttttggagttaggttnttacgggtacgtagtaggtacgtacgtcgggaccgtaagggaccgtacggtcctaccggtcctaccgcgacgtcccgtaacccacggtaacggccctacgttcccggtccctttccccgcggttcccctacccctcctaccgaaggtacctcccgtaccgttccggggtaccgggccgtaacccgaccgggtcccgggtcccgtacgggtccgttccggtaccgtgggtaacccgtaacggttacccttacggttccccgtacggtaacgttccggccgttggttacggccgggttaccgggtcgtaccgggg

SEQ ID NO: 129417 - DNA, 648 bp, Homo sapiens
  misc_feature: GYAE6OF02F89FP.45.78.H01.1.454.CMB.1.raw
  modified_base (261)..(261): a, c, t, g, unknown or other
  misc_feature (261)..(261): n is a, c, g, or t
tcagacgcgatcgacacgaccggtgctcgatttagtgtgagtagtttgggtttgggggagagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcgagtgaaggtctcctgcaaggctctggatacnccttcaccggctactatatacactgggtgcgacacggcccctggacgaagggtcttgagtggagtgggatggataccaaccctaaacaagtcgggtagacaacaaactagtagacaacgaaggtaacgtttcgaagggcgtacgggtacacgtagtacggaccgtaagggtaccaccggtaccaacgtaccgagcctaacacggtacccttaagacgtacgggagtaccgttagggaacggtccggacggtcgtagaacggtccgtacgtacgggaaccgccgtaacggggtcccgttaaggttaaccgtttacggtacgggttacggacggaagggtaccggtaacggaacgggtttaacgtttaaccggttaggtttttacgggg

SEQ ID NO: 129418 - DNA, 604 bp, Homo sapiens
  misc_feature: GYAE6OF02H98D1.45.78.H01.1.454.CMB.1.raw
  modified_base (196)..(196): a, c, t, g, unknown or other
  misc_feature (196)..(196): n is a, c, g, or t
  modified_base (226)..(226): a, c, t, g, unknown or other
  misc_feature (226)..(226): n is a, c, g, or t
  modified_base (265)..(265): a, c, t, g, unknown or other
  misc_feature (265)..(265): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaganacagatcacatcacttgccggccagtcagngtatagtaactggttgctgtatcagcagaaacaggaacnccctaagctctgctctagtaggcatctagttagaagtcggtccatcgaagttcagcggacagtggagtcgtggacagtacgtcaacgtcctacgacctactcagcctacgccgtgacacgtccgtagtattcgtattttacgctttacgttttaacttcttacgtctaacgcgtaggtacccgttaccgcccgtaaccgcccgtaccgttccgtaaccggttccggggtacccggggggtaccggtagggggttacgggaacggtaaggttaccggaacggtaaccggtaaccgttcgggtacggaccgtcgtaccgtacccttacgtccgttaaccgg

SEQ ID NO: 129419 - DNA, 579 bp, Homo sapiens
  misc_feature: GYAE6OF02IT08Z.45.78.H01.1.454.CMB.1.raw
  modified_base (495)..(495): a, c, t, g, unknown or other
  misc_feature (495)..(495): n is a, c, g, or t
  modified_base (510)..(510): a, c, t, g, unknown or other
  misc_feature (510)..(510): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtgggctgaggtgaagagccgtgggcctcagtgaaggtctcctgacgaggtcttcgtggataccaccttcgaccggctactatatactacgtggtcgacgacgacggccccgtaggacgaagggtcttggaggtggagtgggatggactaccgaaacctaacgaagtgggtacgacaacgtaaactgtacgactagtaagtaagttcggaggcgacggtacacgtagtacgacggacggacacgtacagtcgacgaccacacgtacctaagtaggcgacgtacgtaggacgacgacgngtagaagtctacggngtaccgacgacgtcgttagtatcgtggacgaggaggacgacgtaaggtagttacggttgttaggtacgg

SEQ ID NO: 129420 - DNA, 521 bp, Homo sapiens
  misc_feature: GYAE6OF02INR7O.45.78.H01.1.454.CMB.1.raw
  modified_base (336)..(336): a, c, t, g, unknown or other
  misc_feature (336)..(336): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagcctggggcctcagtgaaggtctcctgcaaggcttctggatacaccttcaccggctactatatacactgggtgcgacaggcccctggacaagggcttgagtggatgggatggatcaacctaanaatggtgcaacaaactatgacacagaagtttcagggcagggtcaccagtgacgagggacacgtcatcagcacacgcctacagtggacgcgtaggagcggagcgtacgagcgtcgtagacgacgacggcgtaggtacttacgtggtagtacggagacggcgaggtattacggtagtttaggtacgg

SEQ ID NO: 129421 - DNA, 843 bp, Homo sapiens
  misc_feature: GYAE6OF02GB99B.45.78.H01.1.454.CMB.1.raw
tcagacgcgatcgacacgaccggtgctcgatttagtgtgagtagtttgggtttggggtgaagaagccgtggggcctcagtgaaggtctcctgcaaggcttctggatacaccttcgaccggctactatatacacgtgggtgcgacacggcccctggaacaagggcttgagtggagtgggatggatacaaaccctaacaagtgggtggacaacaaacttatgacacaagtaagtttcgagggcgagggtcaccagtcgaccgacggacacgtccatcgagcacacgcctacagtggacgtcgtaggacgactaggactcgaactactcgtacggaaccggaccgaccggtaccttaattttacgtttacgtggtacggacggtaggtacgtttcggtttaccggtcggtcgtttcggttttccgttttaggaccgtaccggtcggggtacccgtacgggtaacccgttcgggtacctaaccgtacgttcccgttcctacgaccgtcccctacccgaaaccggtaaccgggtaccccttacggtttccccggttacccccttaccccggtcggtaccccctacccccgtttccgtaacccgaaacggtccgtaccctacccgggttccgggtcgggggacccctaacgggtccgggtaccccggtcccggggttggtacccgttaccggttccccgttagggtaaacccgttaacggtacccttttaccccggtttacccgaccgggttaacccgttacccgggttccggttcccggtacgggtaacccgggtccgggggttaaccgttaccggggaacccgggtacgggttaccaggttaaccgg

SEQ ID NO: 129422 - DNA, 735 bp, Homo sapiens
  misc_feature: GYAE6OF02HCSWW.45.78.H01.1.454.CMB.1.raw
  modified_base (178)..(178): a, c, t, g, unknown or other
  misc_feature (178)..(178): n is a, c, g, or t
  modified_base (242)..(242): a, c, t, g, unknown or other
  misc_feature (242)..(242): n is a, c, g, or t
tcagacgcgatcgacacgaccggtgctcgatttagtgtgagtagtttgggtttggggacccagcaaccacatctgtcctctagagaatcccctgagagctccgttcctcaccatggactggacctggaggatcctcttcttggtggcagcagccacaggacgcccactcccaggtgcngcgtggtgcagtcgtggggctgaggtagaagaagccgtgggctgagtgagtctctgcgagcttntgatacaccgttcgaccgtctactataactacgacgtggcgacggacgaccggacccgtaggaacgaaggtccgtggacggtggtagtgggatcggataccgaaacctaacgaggtcgggtagacgtaacgtaaaacgtcgtacgaacgtaacgtaggttaacggttacggacggggtacggtaccgggtacctaaccgtaagtccggtaaaccgggtaacgggaaccgtaccggttaaccctaacgtaccggaagtacccgaccgttacgtacccgtaacgtacggtacgggtaactccggttaaggaaccggacggacggtaaccgttaggaacgttacgaccgtacgggaacacccgggttaacgtccggtaagtttaccttgggacggtcggtaacggacggtaaccgggacgttaaaaggttacggttttacggttaacggttttagggtacgggttttagggtttacccggttggggttaaaccggg

SEQ ID NO: 129423 - DNA, 786 bp, Homo sapiens
  misc_feature: GYAE6OF02ISOL1.45.78.H01.1.454.CMB.1.raw
  modified_base (198)..(198): a, c, t, g, unknown or other
  misc_feature (198)..(198): n is a, c, g, or t
  modified_base (203)..(203): a, c, t, g, unknown or other
  misc_feature (203)..(203): n is a, c, g, or t
tcagacgcgatcgacacgaccggtgctcgatttagtgtgagtagtttgggtttgggggagtcagacccagtcaggacacagcatggacatgagggtccccgctcagctccgtggggctcctgctgctctggctccaggtgaccaaatgtgacatccagatcgacccagtcctccttccaccctgtctgcatctgaggngaacngacgtcaccatcactggccggactagcagagttatagtacgtggtcggacgtgtatcagtacgaacggaaacgtaacgggaaacgtacccgtaacgtacttaccgtgacctacgtaacgtaacgtactaacgttacgttaaaggtttaaccggaaaaggttccggggtacctagttacggtaaacgggtttcacgggacggacgttaggggtaacggtaccgttacgggtacggtaaacgtaacggtaactttacctaaccggtttacctaaacccgtaaaccgtcttaaaccgtaagaacccggttacggacccggttacgaacgtaaccggttcggtaacgtaacggttacggtttaacgtttcggttaaacccttaacttttaccgtaacggttccgtaaacctaacttaaaggtacgttagtttaacgtaagtttacgtaaccggttaccgggttaccggtaaaccggtaaaccgggtaacgtaagggtaacgtaaacgtaaaccggtaaacggtacgtacgggtaccgaacgtttaccgacgttaactcttaccgggtactttacgccgtttaacccg

SEQ ID NO: 129424 - DNA, 773 bp, Homo sapiens
  misc_feature: GYAE6OF02JQLXK.45.78.H01.1.454.CMB.1.raw
  modified_base (716)..(716): a, c, t, g, unknown or other
  misc_feature (716)..(716): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggacgcccactcccgaggtgcagctggtgcagtcgtgggctgagtgaagagccgtgggcctcgagtgaacggtcctccgtgacgtaaggcctttcgtacgggtaactaacccgtacccgtttaccggacccgggtaccttaaccttagttaacttaaccgtaaccggttggggttccgtacggaaccgaccgggtcccccgttagggaaccgtaaacgggtccgttacgggtaacggttggggaacgtttggggaacgttacggggtaaccttaaccccggaaaaccccgtaagttaaacgggttcggggttacgggaacctaaaccgtaaacgtaacgtcgactaaacgaaggttaacggttacggacgggtcgtacgggtacctaccgaggtacgaaccggagggtacccaacggtctaacgtactacggaccgttacgaccgtacgacgtagtcgaacgttcgaacgtacgccggtagacgtacggtaacgtcgttacggaccgacggtaaccggtcgtaccgtacgttaacgtacgttgggtaaccgnggttaacggacggtacggtaaccggtttaattaccgggtttaggtttaggtaccggg

SEQ ID NO: 129425 - DNA, 790 bp, Homo sapiens
  misc_feature: GYAE6OF02FOA7U.45.78.H01.1.454.CMB.1.raw
  modified_base (327)..(327): a, c, t, g, unknown or other
  misc_feature (327)..(327): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagtaagtttcagggcagggtcaccatgaccagggacacgtccatcagcacacgcctacatggagctgagcaggctgagatctaggaccgacgaccggccgtgtaattacgtggtcgngaggagggcgaaggtaagttacggtattttcgggagttggttagttcgggacggttagtcgggtacggttcggtacgggggtaccgaaacggggtacccgtaacgggtacccgacccgttacccgtcccgtaccgaccggtaccccttacccgaaacccggtaaccggggtacccccgtaacggttccccgggtttaccccgtttcccccccggtacgggttaccccgtaaccccccgttaccccgtaccccgtaaaccggtaacccggtaccccggttaaccccgtcccggggttaccgggggtacccgaccggtaaccgggcccccgggtccccggttacgggggtccttcccgggtaccgttccgggtaaccggtaaccgggtacccgttaacccgttacccggtaccgtaaccggttccggttaccgtccggttacggaccgggtcgggccgtacgggg

SEQ ID NO: 129426 - DNA, 633 bp, Homo sapiens
  misc_feature: GYAE6OF02I6IXX.45.78.H01.1.454.CMB.1.raw
tcagacgcgatcgacacgaccggtgctcgatttagtgtgagtagtttgggtttggggagagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctcgagtgaaggtctccgtgcaaggcttctggatacaccttcaccggctactatactacacgtgggtgcgacgacggcccctgggacaaggggcttggagtggagtgggatggataccgaaaccctaaacaagtgggtaggacaactaaaactagtagaccgtacaaggtaacggtttccgaaggggacgtaggggtaccaaccgtagtacggaaccgaagggaccaacggtaacaacgtcgaaggccaacgtacggcctaacacgtgggaacgtcgtaggacggacgtaggcgtaggaagacgtcgtacggaaccggtaccgacggtcccggttagttactttaacggtggtagacgggtaaggacggacgtaaagggtaacgtttaggttaggttttaacgggg

SEQ ID NO: 129427 - DNA, 608 bp, Homo sapiens
  misc_feature: GYAE6OF02IBZN4.45.78.H01.1.454.CMB.1.raw
  modified_base (249)..(249): a, c, t, g, unknown or other
  misc_feature (249)..(249): n is a, c, g, or t
  modified_base (332)..(332): a, c, t, g, unknown or other
  misc_feature (332)..(332): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggacgcccactcccgaggtcgcagcgtggtgcagtcgtgggctgaggtgaagagcgtggggctcagtgaagtctctgcagcttgngatacacctcgaccgctactatatacacgtgggtcgcgacgccggtcccgtaggaacgtagggtccgttggaaggtcggtagnggggtatggacgtaccaacccgtaacgtaacgtgggtacgacgaacaacgtacgtacgacctaacgaaggtacgtttacggaagggtacgtacgggtaccacgacgtcgaaccggcggaacctacgtacacgtccaagtccacgtaccgaccgtagacgtggacgtcgtagacgcgacgtgagacgtcacgtacgacgtaccgtagtcggtagttacgtcgtgagtacgtacgcggaagaaccggttaagttacggtttagggtttggttaacggg

SEQ ID NO: 129428 - DNA, 556 bp, Homo sapiens
  misc_feature: GYAE6OF02FV8GL.45.78.H01.1.454.CMB.1.raw
  modified_base (377)..(377): a, c, t, g, unknown or other
  misc_feature (377)..(377): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtgggcctcgagtgaagtctcctgcgaaggcttcgtggactacaccttcaccggtctactaatatacacgtgggtgcgacacggcccctggaccgaagggtcttggagtggagtgggatggataccaaccctaacaagtggtggacaacaaatatgacanagtaagtttcgagggcagggtcaacgatacgacgaggacacgtaccatcgagccaacgacgtcctagacgtggaacgcgtaggagcgaggtcgagagactcgtagacgtagtacgggcgttaggttattaccgtagtcgaggtagcggacgtaggtaacgttacgttagtttaggtagg

SEQ ID NO: 129429 - DNA, 577 bp, Homo sapiens
  misc_feature: GYAE6OF02FP3KE.45.78.H01.1.454.CMB.1.raw
  modified_base (253)..(253): a, c, t, g, unknown or other
  misc_feature (253)..(253): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatcgacccagtctccttccaccctgtctgcatctgtaggagacagagtcaccatcacttgccggcagtcagagtatagtactggttgcctggtatnagcaagaaaccgagggaaacgcccctaagctcctgctctagtaaggcatctaagttagaaggtcgggtccatcgaagttcagcgcagtggatgtaggacagtaattcactctacaccatcagcacgtcctgcacgtcctagtacttgtactttcgacctaaacttttagttaacctcgaacctaacgtagttacagttaacgttagtttaccgttacgttacggttaccggaccggaaacgggtaccgaagggtacgaaataccgaaaaccggtagtcggtagtaccttaggacctaacgttctcttacgttaccttgtacccg

SEQ ID NO: 129430 - DNA, 703 bp, Homo sapiens
  misc_feature: GYAE6OF02ISX2K.45.78.H01.1.454.CMB.1.raw
  modified_base (203)..(203): a, c, t, g, unknown or other
  misc_feature (203)..(203): n is a, c, g, or t
  modified_base (259)..(259): a, c, t, g, unknown or other
  misc_feature (259)..(259): n is a, c, g, or t
  modified_base (282)..(282): a, c, t, g, unknown or other
  misc_feature (282)..(282): n is a, c, g, or t
tcagacgcgatcgacacgaccggtgctcgattagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaaaatggtgcacaaaactngcacaagtaagtttcgagggcagggtcaccatgacgagggacacgtccatcagcanacgtaccacagtcggagctaggngacacgggctagagaactcgtacgacgacgaccgccgtagtatttaccggtgtcgacggtaagaggccgaaggtaacgtttaacggtagtttttggggaaaggttttgggttaagttacggggtaacgggttataggtaccggttcgggtacggggaaccggtaaacggggcctaaccgggtccgtaccggtaccgtccgtacgtccgtcccgtaccgaccgtaaccgggtaccctaacgtcccggttcccttaccccgtcggaccctacccgttaccctacgaaacgctaccgaccgttcggcgggactacgaccggccggtccgtacggtaccgtcgccgttaccggtacggtaaccggtccttaccgttaccgtcggtaacgtcggtacgtccgtacggtacgtccgggacgtccggg

SEQ ID NO: 129431 - DNA, 833 bp, Homo sapiens
  misc_feature: GYAE6OF02I6ZX4.45.78.H01.1.454.CMB.1.raw
tcagacgcgatcgacacgaccggtgctcgatttagtgtgagtagtttgggtttgggggagcatcacccagcaaccacatctgtcctctagagaatcccctgagagctccgttcctcaccatggactggacctgggaggatcctcttcttggtggcagcagccacaggagcccactcccgaggtgcagcgtggtgcagtcgtggggctgaggtgaagaagccgtggggcctcgaggtgaacggttctccgtggacaacgggtccttctggactacgtaccttcgaccggacttaactacgtactactaccgtgggtcgacggtaaccgtacggcccccgttagggaaccgtaaagggtccttaggacgtgggtaagtgggtacgtagggactaccgtaaaccgtaactaaggtacgggtacggtacaaacgtaaacgtagtacgtacgtaacgtaacggttaacggtttacgaacgggtacgtaccggggttacaacccgtaacgttaccgggaaacccgtacggggtaacccgtaccgtaaccgtaacgtaaccgtaccggtaaccgtaaaccgtaacggtaacccgtaaacgtaaacggttaccgggaacgtaccgttacggtaaacccggaccggtaaccgggttacccggtaagggtacgttaaccggttaaccggttaaccggacccggttaaccgggaacccggttaccgggtttaggttaaaccggtttaaccgtaagggttcccggtaaccgggttaacggtaacggggtacggttaaacgggtttaaaccgtttaacgggttttacggttttaacgggttaaggg

SEQ ID NO: 129432 - DNA, 712 bp, Homo sapiens
  misc_feature: GYAE6OF02GXBNI.45.78.H01.1.454.CMB.1.raw
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatcgaccagtctccttccaccctgtctgctatctggtagagacagagtcaacatctacttcggccggaccagtcagtagttaattacgttaacgtgggttcggtaccgttggtaactcgaagtaccgaagaaaacccggaagggaaaccgaccccgtaacgtccttccctaggcttactaagtaacggtactacgttacgttaaggtttaaggtaaacggttcggggtaccctagtaccgaaggttcgacggcggtgtaggtagtacgtcggaggtacaaggttactccgtacgttactaccgactactcgaacgcgtacgcctagacgtacgtccgtagtacttgttaacgtttcaaaccttttaacttagttaccgttagttaccgtaattaaccgtttaatttaaccgttaacctttacccgttaaccggtctaaccggttccggaaccgtaacgggtaacgtaaggttacgaaacggttaacctaaacgggtactcgggttacgacgttacggacctaccgtagttcccggttcttaccctattaaccccg

SEQ ID NO: 129433 - DNA, 634 bp, Homo sapiens
  misc_feature: GYAE6OF02HAF39.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatcgacaggacacgtccatcagcacagcctacatggagctgagcgaggctgagatctacgacgacaccggccgtgtacttactgtgcggagaggcgaaggtaattacgtacgttttggagttggttagttcggtacggttagtggtacgtcggtcgggaccgaacgggccacgggtcacccgtcctcctcgacgccctaccaccgaacggcccacgttccggtcccttccccgtcggccctacccctccctaccgaacgccgtaccacccgttaccggcggggaccacggtacgcccgggtacccgcgggtccgtcggtccgtcggtaccaaacgggttaccctacgttacccgtacgtacgtccggtaccttcggtaccggcggccgggtgtaaccgggg

SEQ ID NO: 129434 - DNA, 689 bp, Homo sapiens
  misc_feature: GYAE6OF02JQGWM.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagtaacgtttcgagggcagggtcaccatcgaccgagggacaccgtcatcacgacacacgacctacagtggagctcggacgcgaggctaggacgtactacgtcgacgacgacggtccgttggtattacgtggtcggacggaggtaggacgtaacggtaactttacggtagtttttacgggtaggttagggtttactacgggtacggttagtgggtacggtacggtcggggaccgaacgggtaccgacggtaccaccgttcctaccgtccaccggtcctaccgacgacgggtccctacgtcccggtcccttaccccggtcggtaccctaccccgtcctaccgaaccgacgccttaaccggcgggtaccgggacctaccgcgtaccgtccgaccggttcgcccgtgtcccggtaggtaccgtacgttacctaccggtttcccgaggtacccttccggacgttcggcggtacggcggtaccgg

SEQ ID NO: 129435 - DNA, 834 bp, Homo sapiens
  misc_feature: GYAE6OF02FYLJ2.45.78.H01.1.454.CMB.1.raw
tcagacgcgatcgacacgaccggtgctcgatttagtgtgagtagtttgggtttgggggagtcagacccagtcaggacacagcatggacatgagggtccccgctcagctctggggctcctgctgctctggctcccaggtgccaaatgtgacatccagatcgaccctagtcctcctccaccctgtctgctatcgtgtaggagacagagtacacctatcacgttcggccgggaccagtcgagagtattagtaactggttcggccgttggtatacgtacgacgaacgaaaccgaacgggaaacgacccccgtaagtcctaccgttagaccttacgtaacgtaacgggacctaagttaccgtttaagtttaaacggtaaaagggttccggggttaccctaacgtacgtaaacggttacgaacggtccggtacgtaggtacggtagttaccgggtaacgggtaacgtaaacggttaaacgtttaccgtaacccgttaccgtaacctaaccctaacgttaccgtaaacggtacccgaacggtaccccgttaccggaccgacccggtccgtagggtaacctttacggttacgttttacggtaaacctttaaaccgttttaattacccgttaacgtacccgtaaagtaccgttaagttacgtttaagttttaaccgtttaaggtttcccggttaaccgggtttcccggaaaccggttaaccggggtaaaccgttaagggttaacggtaaacgtaccgtaaaacgggtaaccttagggttaccggtaacgacccggttaactaccggttacgtacggtttccttaccgtttacccgttaccccg

SEQ ID NO: 129436 - DNA, 833 bp, Homo sapiens
  misc_feature: GYAE6OF02GLP17.45.78.H01.1.454.CMB.1.raw
tcagacgcgatcgacacgaccggtgctcgatttagtgtgagtagtttgggtttgggggagtcagacccagtcaggacacagcatggacatgagggtccccgctcagctcctggggctcctgctgctctggcctcccaggtgaccaaatgtgacatccagatcgacccagtctccttccaccctgtctgcatctgtaggacgacagcgtcacatcacgttcggccggactagtcagagttattagtacgttggttcggcgtaggtatcgagacgaacgaaaccgagggaaaccaccccgtaaggcctaccgtcggtaccttacgtaacgtacggctagtttaccgttaaggttttaacggaaacgggttccggggtaccctaagttaccggtaaacggtttcgaacggtaccgggtacgtaagggtacgggtacgttaccgggtaacgggaaacttaacggtaacctttaccgtaccttacccttacccgaaacccgtagtaccgaacggtaccgtaccggtaccgttcggaccctaccggtaccgtaggtaagtttacgttagttttaccggaacctttaaacgtttaccgttaaccgtaccgaaaccgttaaacgttaacggttaacgtaagtttaacgtttaccggtttacggtttacccgggttaacccgggtaaccgggtaaacccggtaaacgggtaaaccgggtaagggttaacggtaaaaccgtaaaccgggtaaaaccgtaacgggttcggtaaccgggtaccgttaccgaacccgttacccgttaacgttccgtttaccggtttacccttaacgtttaccccgg

SEQ ID NO: 129437 - DNA, 664 bp, Homo sapiens
  misc_feature: GYAE6OF02GIFA2.45.78.H01.1.454.CMB.1.raw
  modified_base (437)..(437): a, c, t, g, unknown or other
  misc_feature (437)..(437): n is a, c, g, or t
tcagacgcgatcgacacgaccggtgctcgatttagtgtgagtagtttgggtttggggctgaggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctcgaacgacgacggccgtagtattactgtgcggagaggcaaggtaattacgtagttttaggagttaggttagttcggacggttagtaggtacggtcgtcggggtacgaacgggtaccgacggtacgaccgtcgtcccgtacncgccctaccaccgaacgggtcccacgttaccggtcccttccccgtcggcctacccctcctaccgtaagccgtacacccgtaccggtggggaccctaacggaccggtcccggggtaccctcggggtccgtcccgggtaccgtcgggtaacccggtaacggttccccgttaacccgttcccgtcccggtacggttacccggtccggttacccggtcgggtaacccgggg

SEQ ID NO: 129438 - DNA, 593 bp, Homo sapiens
  misc_feature: GYAE6OF02FZGJ9.45.78.H01.1.454.CMB.1.raw
  modified_base (351)..(351): a, c, t, g, unknown or other
  misc_feature (351)..(351): n is a, c, g, or t
tcagacgcgatcgacacgaccggtgctcgatttagtgtgagtagtttgggtttggggagagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctcagtgaaggtctcctgacgaaggcttctggactacaccttcaccggctactatactacactgggtgcgacacggcccctggacaagggcttgacgtggatgggatggatacgaaccctaaanagtggcggacaacaaaacgtatagcaacgagtaacgtttcgaagggacgagggtacaacctagtacggaaccgagggaacacgtaccactcgacgtacactacgcaacagtcgaagcgtaggacgacgacggcgtcggaatacgtacgtacggtaaccgacgaaccggtacgttaggtaactttaacgtggttacgacggtagacgggtacgaacggtaactttaacggtagtttttacggg

SEQ ID NO: 129439 - DNA, 795 bp, Homo sapiens
  misc_feature: GYAE6OF02FE60K.45.78.H01.1.454.CMB.1.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggactcctcttcttggtggcagcagccacaagacgcccactcccaggtcgcagctggtgcagtcgtggggctggaggtgacggaagccgtgggcctcgagtggaacggttctccgtgactaaggtccttacgcggtacctacgtacccgttaccgaccggtacttaactactaactaaccgtacggttgggtacgaccgaccgaccggtccccgtaggaaccgtaacggggtcctttaggaacgggttacgggaaggttacggggtacgttaccggggtaacctaacccgtaaaacccgtaaacgtaaacgggttcggggtaccgtaaccgtaaaaccgtaaaccgttacggtaccgtaacccgtaaaccggttaaggttaaaccggtttaccggggaacgggtaccggtaacggggttaacccaaccgtaacggttacccgggaaaccgggtaaccgggtaacccgtacccggtttaacaaccggtaccgacggaaccgtacgaaccctacgaacgtacgtcggacgtcgtacggacgtacgtgacctaggacctactacggacgaccggaaccgtcgggaacgttaggttaactacggtacggtacggacgtaacggcggtaacgtaacggttatttacggttacgtttagggtacgg

SEQ ID NO: 129440 - DNA, 704 bp, Homo sapiens
  misc_feature: GYAE6OF02HN2B6.45.78.H01.1.454.CMB.1.raw
  modified_base (274)..(274): a, c, t, g, unknown or other
  misc_feature (274)..(274): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatgggtgcaacaaactatgcacagtaagtttcgagggcagggtccaccatcgaaccgagggaccacgtccatcagcacagcctanatggagctgagcaggctgagatctgacgacgaccgggccgttagtatttactgtcgcgagacggcaggtaattacggtagtttttggaggttggttaagtttcgggaacggttagtcgggtacgttcgtggggaccgaaagggacccacgggttccaccgttcctaccctcgacgccctacccgaccgaacgggcccacgtccggttaccttcccccgtgtccctacccctcctacccaacgtacgacctacccgttcggaccgggggtacctaccggacggtacccgggtcccgttcggggtaccgttcggcccgggttacgggtaccggtaaaccgggttccctttaaccggttccccgttaccggttaacgttccggttacccggttaccggttaccggtacgggtaccggggtccggttaccgggg

SEQ ID NO: 129441 - DNA, 763 bp, Homo sapiens
  misc_feature: GYAE6OF02HGOFI.45.78.H01.1.454.CMB.1.raw
tcagacgcgatcgacacgaccggtgctcgatttagtgtgagtagtttgggtttgggggagcatcacccagcaaccacatctgtcctctagagaatcccctgagagctccgttcctcaccatggactggacctggagatccttcttcttggtggcagcagccacaggacgcccactcccaggtgcagcgtggtgcagtcgtgggctggaggtagaagaacgtccggtcggggtacctacgaggttaggaacgggttcctacccgtgacgaacggttcttcgtaggtaactaccgtaccctttaccgaacccggtacttaacttaagttactaaccgtacggttcgggggtagaccggtaacgtaccggtaccccggtaggaaccggtaacgggtccgtttaggtacgggttaggtacggtggggtaagtagggtacctaacccgtaaacccgtaaacgtaacggttacggtacggaacctaaaccgtaaaacttacgtacggaacccgtaaacgtaaacggttaaccggtttacgggaacggggtacccggtaacggggtaacccaacgttacggtaaccggaaccggtacggggaaccctaccgtaccgtaacgtacgacgtaccaacgaccgtactaccgaggtcgagtcgtaggacgcgggaccgtaggacgaacgtcggtacgtacggacgtacgacgtacgtcggtagtaccgtggtactaggaccgaggaccgtggaacgttcgttagtccggttaag

SEQ ID NO: 129442 - DNA, 882 bp, Homo sapiens
  misc_feature: GYAE6OF02GG5CY.45.78.H01.1.454.CMB.1.raw
  modified_base (142)..(142): a, c, t, g, unknown or other
  misc_feature (142)..(142): n is a, c, g, or t
  modified_base (250)..(250): a, c, t, g, unknown or other
  misc_feature (250)..(250): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatccncttcttgggtggcagcagccacagggagccccactccccgaggtgccagctgggtgcagtcgtggggctggaggtgaagagccgtgggcctcgagtgaggtctctganaggtcttgtggactacgaccttcgacccggtctacttagtactaccacgtgggtcgacgacgtacgggcccctaggaaccgagggtccgttaggacgggttggtacgtggggtatagggtaacgtaccaaaccccgttaaagtaaggttcgggttacgggacctaaacgttaaaaccggttacgtacggacccgtaaacgtaacggtttaaacgggttttccggaacggggaccgtaacgggggttaccaaaccggtacgtaaccggggtaacccggaacgggggttacccctaaacccgggttaccgaacccgtttacgaaacccggttacccgaaacggttaaaccccggtaaccccgtttaaaccgggagggtttaaacccgggaccggttaaccggtaccgggtaacgtacccgggtaaacgggtcccgggtttaagggaccgttaaccggtttaacccggaacgggtaacccccgggttaaaaccgggtcccggggttaaccccggtttagggtttaacccggtttaacggtacgggttacccgggtacgttaacgggaacggggttaaccggtaccggggtttttaaactaccgggttttttagggttacggttttaaacgggggg

SEQ ID NO: 129443 - DNA, 748 bp, Homo sapiens
  misc_feature: GYAE6OF02JT413.45.78.H01.1.454.CMB.1.raw
  modified_base (281)..(281): a, c, t, g, unknown or other
  misc_feature (281)..(281): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagtaagtttcgagggcagggtcaccatcgaccgagggacaccgtccatccagcacagcctaacatgggacnctgagcacggctggaatactctggaccgacgaccggcgtattattcgtagtgcgaagacggacgaagtattacgtagttttgggaacgttggttagtcgggacgttagtcgggtacgttcgtaggggaccaaggggaccctacggtccgtaaccgtcccgtaccgttaccgtccgtacccgtacccaaccgtaacccggggtccctaacgttcccggttaccccgttcccccggttccggtaccccgtaacccccgttaccccgttaacccggaaccggtaccggtacccgtaaccccgtaccgggttcccgggggtaacctaacccgaccgggtccccgggtacccggttccgggtccgttaccggtcccggttagggttacccgtaaacgggtacctttaacccgttcccgtaccggtaccgttaccggtccgttccgttacggacggtccggtaccggtccggg

SEQ ID NO: 129444 - DNA, 636 bp, Homo sapiens
  misc_feature: GYAE6OF02GZZ9Z.45.78.H01.1.454.CMB.1.raw
  modified_base (497)..(497): a, c, t, g, unknown or other
  misc_feature (497)..(497): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacgaggacgcccactcccgaggtgcagctggtgcgagtcgtggggctggaggtgaagaagccgtcggggcctcgaggtgaaggtcctccgtgacgaaggtcttcgtaggatacctaccttaccgaccggtcttaactataactacacgtgggtcgacgacgacggcccgtaggaacgagggctggagtggagtcgggataggactacaaccctaagaagtcgggaggaccaaacgtaatagtcgacaacgtaagtaacgtttacggagggtacgaacggtacaccgtagtacgaaccggacggacctaccgtacactacgacgacacgactccaancgtggacgtctaggacgacgacgtaccgagaacgtcgtacggtacgaacgtaccgacgggtcgttacgttacgttacggtcggacgaccggagtaacgggagttaaggttacgttacgggttttagtttagggtaacgg

SEQ ID NO: 129445 - DNA, 678 bp, Homo sapiens
  misc_feature: GYAE6OF02GMBOS.45.78.H01.1.454.CMB.1.raw
tcagacgcgatcgacacgaccggtgctcgatttagtgtgagtagtttgggtttggggagagcatcacccagcaaccacatctgtcctctagagaatcccctgagagctccgttcctcaccatggactggacctggaggatcctcttctggtggcagcagccacaggagcccactcccaggtgcagctggtgcagtctggggctgaggtgaagaagccgtggggcctcgagtgaaggtctcctgcaaggcttcgtggatactaccttcaccggctactatatacacgtgggtcgcgacacggcccctggacgaagggcttgagtggagtgggatggataccaaacctaacaagtggtcggacaacgtaaactagtcgacaactaaggtaacgtttcgaaggggtcgtaacggggtaccaaccgtatacgggaacccgaacggggtaacctaaccggtacccaacgttccaaacggtccgaacctaacggaccctaaacgacgtagggaacgtcggtagacggaccgtacgggtaccgtaggtaaggtacttaccggacgtaaccggaccggtaccgggtacccggtaaggtttaacgtttaccggttgggtaccggtaggaacgggtaacggaccggttaaagggtaacggttttacccgtttagggtttttaacgggg

SEQ ID NO: 129446 - DNA, 660 bp, Homo sapiens
  misc_feature: GYAE6OF02GI2LG.45.78.H01.1.454.CMB.1.raw
  modified_base (261)..(261): a, c, t, g, unknown or other
  misc_feature (261)..(261): n is a, c, g, or t
  modified_base (411)..(411): a, c, t, g, unknown or other
  misc_feature (411)..(411): n is a, c, g, or t
  modified_base (649)..(649): a, c, t, g, unknown or other
  misc_feature (649)..(649): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtcctcccttccaccctgtctgctatctggtaggagacagagtcaccatctacgttgccgggccagtcagagtattagtactggttggcctggtancagcagaaccgaggaacgcccgtaagctcctgtctactagtacgcattacgttagtttaaggaaggtcgggtacctacgtacgtacgttcgacgcggtacgaggtacgtatcggtaggactaagtatcctactctactaccactacgacncgacgtccgagccgtaacggtcctagggtattacggttagtttcggaaccttttaactttacttaccgtactaaccctaacgttagtaacttagttaagtttacggtttaacttacggttaacccggtttcggaacccggtaaagggaacccggttaagtaacgtaacgttaacccgaaggttaaccgttggtaccggtctaaccggaccctaacgttccgtccgtttgttacccttntttaaccccgg

SEQ ID NO: 129447 - DNA, 602 bp, Homo sapiens
  misc_feature: GYAE6OF02IMAL7.45.78.H01.1.454.CMB.1.raw
  modified_base (231)..(231): a, c, t, g, unknown or other
  misc_feature (231)..(231): n is a, c, g, or t
  modified_base (252)..(252): a, c, t, g, unknown or other
  misc_feature (252)..(252): n is a, c, g, or t
  modified_base (256)..(256): a, c, t, g, unknown or other
  misc_feature (256)..(256): n is a, c, g, or t
  modified_base (269)..(269): a, c, t, g, unknown or other
  misc_feature (269)..(269): n is a, c, g, or t
  modified_base (344)..(344): a, c, t, g, unknown or other
  misc_feature (344)..(344): n is a, c, g, or t
tcagacgcgatcgacacgaccggtgctcgatttagtgtgagtagtttgggtttggggggagtcagacccagtcaggacacagcatggacatgagggtccccgctcagctccgtggggctcctgctgctctggctcccaggtgccaaatgtgacatccagatgacccagtcctccttccaccctgtctgcatctgtaggagacagatcaccatcacttcgccggcagtcagntattagtactggtgctgtatnaganagaacgaggaacnccctaagctctgctacgtagtaaggctatcttaggttaacgaagtcgggtaccctatacgtaaggtacgagcggngagtgtatcggtaggaactaagtaagttccacgtctacacacgtacacgacacgtcctagacagtaccgtgtacgttgttacgtttagaccttaaatttattaaccgtcaacgtaaactagtaataggttaattacgtttaacgtccgtaacgttccgggaaaccgtaacgggactaaaggggtacgaaactaccggtaaacgtacgttgggtacacgtaccgtaacgaccgttacttagttcgttactacgttaccc

SEQ ID NO: 129448 - DNA, 687 bp, Homo sapiens
  misc_feature: GYAE6OF02FTJEU.45.78.H01.1.454.CMB.1.raw
  modified_base (281)..(281): a, c, t, g, unknown or other
  misc_feature (281)..(281): n is a, c, g, or t
tcagacgcgatcgacacgaccggtgctcgatttagtgtgagtagtttgggtttgggggagagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagagcctgggcctgagtgaggtctctgcgagcttcgtggatacaccgttcaccggtctactatatacncgtgggtgcgacgcggccccgtggacgaagggtcttggaggtggagtgggagtagggactacctaaccgtaaacgaagtaggtacggtaccaacgtaaactagttacgacgaacgtaagtaacggtttacgagggtacgtaacgggtacaaccgtacgtacggaccgacgggaaccgtaccgtacccaacgtaccgaagggaccaaccgaacgtaccccgtaactacggtacgggtaacgtcgtacgggtacggccgtaagggtaccgtagggtaacggtaaccgttcgtaccgggaaccgacccgggtaccgggaccggtttaacggtaacggttttaccggtggtacggtaccggaaggtaacggcggtaacggtttaacgttacggtttaggttttaacgggg

SEQ ID NO: 129449 - DNA, 558 bp, Homo sapiens
  misc_feature: GYAE6OF02JI5GT.45.78.H01.1.454.CMB.1.raw
  modified_base (282)..(282): a, c, t, g, unknown or other
  misc_feature (282)..(282): n is a, c, g, or t
  modified_base (304)..(304): a, c, t, g, unknown or other
  misc_feature (304)..(304): n is a, c, g, or t
  modified_base (371)..(371): a, c, t, g, unknown or other
  misc_feature (371)..(371): n is a, c, g, or t
  modified_base (420)..(420): a, c, t, g, unknown or other
  misc_feature (420)..(420): n is a, c, g, or t
  modified_base (424)..(424): a, c, t, g, unknown or other
  misc_feature (424)..(424): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagacgtcacatcacgttgccgggccagtcagtagtattagtaactggttggccttggtatcagacaaggaaaccagggaaacncccctaagctcctgactctaanaggcatactagtttagaaggtcgggtcccatcgaagttcaggcgacaggtgatcgaggacagtactnactcacacatcagcagtctagcagctagatagttatttgacttaacttntacngaccaatagtatagacttagttcgtacgtacgttacggaccgaaaggtaccgaagtaggaactaacgtaaacggtaccttaggggtacgtaccgtagtacccaacggttctacgttcgtacctttacggtaccc

SEQ ID NO: 129450 - DNA, 810 bp, Homo sapiens
  misc_feature: GYAE6OF02I524J.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaacctaacatggtggcacaaactagtgcacagtaagtttcgagggtcagggtcaaccgatagaccgacgggacaccggtcccagtccgaagccaacgacgtaccttaccaagtcggaagtcctaggagcgaggctaggacgtattcgtacggaccggtaccgaccgggtcccggttagttaacctttacgtacggtacggtaccggaagggtacgggacgtaaggggttaaactttacggtttaggtttttacggggtacggtttacgggtttaacggttacggggtacgggtttaaggttacggggtaacgtttccgggtacggggggaaccccggtaaagggggtaccccggtacggtacccggtaacccggttacctacccgtaccgtaacgtccccgtaacccggtaccggaaaccggggtccctaccggttcccggttacccgtttcccccgtacgggtacccttaaccccggtccccgtaaccgtaaaccgggtcctaacccgtacccgttacgggtaccggggacctaacggccgtaccgggcccgtacggtcgtacgccgtacggtacgacgtacttaccgttaccgagtccgtacgtcgtacgtcggacggtcggtcgtcgg

SEQ ID NO: 129451 - DNA, 634 bp, Homo sapiens
  misc_feature: GYAE6OF02G8DBD.45.78.H01.1.454.CMB.1.raw
  modified_base (499)..(499): a, c, t, g, unknown or other
  misc_feature (499)..(499): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacgacggccgtgtattacgtgtgcggagaggcgaggtaattacgtagttttagggagttggttagttcgggtacggttagtggacggttcgtcggggaccgaaggggaccacggtcaccggtctccgtcctacgcccttacccgaccgaacgggacccacgtccggtccgttccccctcggccctaccccgtccctaccacgacnccacccgtcgtcggggcctacgacggccggtcccgtgggccttcggcccgttgggaccgtaacgggtaccttaacccgtttcccgtaccggtacgttcccggtacggtccgtacggacggtccgggcgtaccggg

SEQ ID NO: 129452 - DNA, 737 bp, Homo sapiens
  misc_feature: GYAE6OF02JCND2.45.78.H01.1.454.CMB.1.raw
  modified_base (261)..(261): a, c, t, g, unknown or other
  misc_feature (261)..(261): n is a, c, g, or t
  modified_base (269)..(269): a, c, t, g, unknown or other
  misc_feature (269)..(269): n is a, c, g, or t
  modified_base (288)..(288): a, c, t, g, unknown or other
  misc_feature (288)..(288): n is a, c, g, or t
  modified_base (327)..(327): a, c, t, g, unknown or other
  misc_feature (327)..(327): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaacgtttcagggcagggtcaccatgaccagggacacgtccatcagcacngcctacanggagctgagcaggctaganatcagacgacgaccggccggttagtacttacgtgtcggnggaaggaggagtaagggtaacttaacggttagtttttagggaggttagggtttacgttcgggtacggttagtacgggtacgttccggtagggggaccggtaaacggggtaccgtaacgggtccgtaaccgtcccgtcctacgaccgcccgtacccaaccggacggacccgtacgtcccgttcccgttaccccgtcggtcccctaacccctcccgtacccaacggtaccgtcccgtaaccccgttcgggaccgggggtccaaccggtacggccccgggtcccggtagggccccgttcggcccggttacgggtaccgtaaacggggtaccctttaccggtttaccctaccggttacgtacccggttccggttaccggtaccgggtaccgggtccggggtccgtaacccgggg

SEQ ID NO: 129453 - DNA, 585 bp, Homo sapiens
  misc_feature: GYAE6OF02G4BDQ.45.78.H01.1.454.CMB.1.raw
  modified_base (466)..(466): a, c, t, g, unknown or other
  misc_feature (466)..(466): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctcagtgaaggtcctcctgcaaggcttcgtggatacaccttcaccggctactatatacacgttgggtgcggacacggcccctaggacgaagggcttgagtggagtgggatggataccaaacctaacaagtgggtcgacaactaaactatacgacaacgagtaacgtttacgagggcgagggtccaaccgagtacgaaccggagggaaccacggtacacgtcgacgactacacgaccgtanggtaggacgtccgtagacgtacggaggcgtaggacgtactacgacgacgacgacggtccgtagttacttacgtgtcgacgaggaggtacgaaggttaacttacggttgtttagtacggg

SEQ ID NO: 129454 - DNA, 791 bp, Homo sapiens
  misc_feature: GYAE6OF02JNM96.45.78.H01.1.454.CMB.1.raw
  modified_base (189)..(189): a, c, t, g, unknown or other
  misc_feature (189)..(189): n is a, c, g, or t
  modified_base (199)..(199): a, c, t, g, unknown or other
  misc_feature (199)..(199): n is a, c, g, or t
  modified_base (255)..(255): a, c, t, g, unknown or other
  misc_feature (255)..(255): n is a, c, g, or t
tcagacgcgatcgacacgaccggtgctcgatttagtgtgagtagtttgggtttgggggagtcagacccagtcaggacacagcatggacatgagggtcccgctcagctcctggggctcctgctgctctggctccaggtgccagatgtgccatccagatgacccagtcctcattcctccctgtctgcatcnggtagagacngtacgtaccagttactgccggacagtcaggattatagaactgtagtagctggtacncgacgtacaggacgaccggtagggaccgtcccctaacgtcctacgtcgtagtcgtacggtccttacggtaacggtaacgtaacgggttcgggtaacccagggttactacgggttactacggggtacggtcgggtagggtacccgtgggtaccgtaacgtacgggttaaccttaccgttacgttaccgtacccgtaaccgtacgtaacccggtaccgggtcccgtcggtacggtaccggaacccgggtaacccttaaagggtttcgtttaaacgtaaccttttaacccggttatttaccggttaacgttaaacccgttaaccggtttaacgttaacttaactaaccccggtttaccgttacggttaaacccggtagtttaaccccgggaacggttaaccggtaaccgtacgtttaccgaaccggttagtaaccgttaaccgtaaacccggacggtttaacggccgttaacgtaccgtacctaaccgtacgttaccgttacccgtttaggacccctttaaccttccccgggttaaccc

SEQ ID NO: 129455 - DNA, 566 bp, Homo sapiens
  misc_feature: GYAE6OF02I9LCK.45.78.H01.1.454.CMB.1.raw
  modified_base (282)..(282): a, c, t, g, unknown or other
  misc_feature (282)..(282): n is a, c, g, or t
  modified_base (487)..(488): a, c, t, g, unknown or other
  misc_feature (487)..(488): n is a, c, g, or t
  modified_base (490)..(490): a, c, t, g, unknown or other
  misc_feature (490)..(490): n is a, c, g, or t
  modified_base (492)..(492): a, c, t, g, unknown or other
  misc_feature (492)..(492): n is a, c, g, or t
  modified_base (494)..(494): a, c, t, g, unknown or other
  misc_feature (494)..(494): n is a, c, g, or t
  modified_base (496)..(497): a, c, t, g, unknown or other
  misc_feature (496)..(497): n is a, c, g, or t
  modified_base (499)..(499): a, c, t, g, unknown or other
  misc_feature (499)..(499): n is a, c, g, or t
  modified_base (501)..(501): a, c, t, g, unknown or other
  misc_feature (501)..(501): n is a, c, g, or t
  modified_base (503)..(503): a, c, t, g, unknown or other
  misc_feature (503)..(503): n is a, c, g, or t
  modified_base (505)..(505): a, c, t, g, unknown or other
  misc_feature (505)..(505): n is a, c, g, or t
  modified_base (507)..(507): a, c, t, g, unknown or other
  misc_feature (507)..(507): n is a, c, g, or t
  modified_base (514)..(514): a, c, t, g, unknown or other
  misc_feature (514)..(514): n is a, c, g, or t
  modified_base (516)..(517): a, c, t, g, unknown or other
  misc_feature (516)..(517): n is a, c, g, or t
  modified_base (519)..(519): a, c, t, g, unknown or other
  misc_feature (519)..(519): n is a, c, g, or t
  modified_base (522)..(522): a, c, t, g, unknown or other
  misc_feature (522)..(522): n is a, c, g, or t
  modified_base (524)..(524): a, c, t, g, unknown or other
  misc_feature (524)..(524): n is a, c, g, or t
  modified_base (527)..(527): a, c, t, g, unknown or other
  misc_feature (527)..(527): n is a, c, g, or t
  modified_base (531)..(531): a, c, t, g, unknown or other
  misc_feature (531)..(531): n is a, c, g, or t
  modified_base (535)..(535): a, c, t, g, unknown or other
  misc_feature (535)..(535): n is a, c, g, or t
  modified_base (539)..(539): a, c, t, g, unknown or other
  misc_feature (539)..(539): n is a, c, g, or t
  modified_base (545)..(545): a, c, t, g, unknown or other
  misc_feature (545)..(545): n is a, c, g, or t
  modified_base (549)..(549): a, c, t, g, unknown or other
  misc_feature (549)..(549): n is a, c, g, or t
  modified_base (560)..(560): a, c, t, g, unknown or other
  misc_feature (560)..(560): n is a, c, g, or t
tcagacgcgatcgacacgaccggtgctcgatttagtgtgagtagtttgggtttgggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcaacaaactatgacacagaagtttcgagggcagggtcaccatgaccgagggaccacgtccatcagccacacgacctaacatggancagacgcgaggctcgagatcgtagacgaacgacggtccgtagtattacgagtagtacgagacggacaaggtaattacgttactttttgggaagtttagggttaacttcgggaagggttagtgggtacgttacggtacgggggaccgtaaacgggacccgtaacggtaccgtaccggtaccttaccctacgtaccgtaccccgtannananananncnanananangagaganannanagnanagnaganacanaganacacanacanacactagaganagagac

SEQ ID NO: 129456 - DNA, 760 bp, Homo sapiens
  misc_feature: GYAE6OF02H7O5E.45.78.H01.1.454.CMB.1.raw
  modified_base (143)..(143): a, c, t, g, unknown or other
  misc_feature (143)..(143): n is a, c, g, or t
  modified_base (295)..(295): a, c, t, g, unknown or other
  misc_feature (295)..(295): n is a, c, g, or t
  modified_base (313)..(313): a, c, t, g, unknown or other
  misc_feature (313)..(313): n is a, c, g, or t
  modified_base (322)..(322): a, c, t, g, unknown or other
  misc_feature (322)..(322): n is a, c, g, or t
  modified_base (338)..(338): a, c, t, g, unknown or other
  misc_feature (338)..(338): n is a, c, g, or t
  modified_base (510)..(510): a, c, t, g, unknown or other
  misc_feature (510)..(510): n is a, c, g, or t
  modified_base (518)..(518): a, c, t, g, unknown or other
  misc_feature (518)..(518): n is a, c, g, or t
  modified_base (715)..(715): a, c, t, g, unknown or other
  misc_feature (715)..(715): n is a, c, g, or t
tcagacgcgatcgacacgaccggtgctcgatttagtgtgagtagtttgggtttgggggagtcagacccagtcaggacacagcatggacatgacgggtccccgctcagctccgtggggctcctgctgctctggctcccgaggtnaccaaatggtgacatccagatgacccagttcctccttaccaccctgtcctgcattcctaggtaggagacagtacgtaccaaccatcctacgttcggcccgggactagtacgaagtagtagttacgtaacgttggggttcggccttaggtacngaagcaaacggaaaccgngggaaaccnccccgtaagccttccngtcctacgtaataacggcacgttcgtaaggtttaaaggaaccgggtcgggttacccaaagttccggaaacggtttcgacggtacggagtaacggttgggtaactccgggtaggaaacgtagtaaactttacccctaacgtcctaaccggtacctaacgccgtaaggcctacncccgttanacccggatccggtaataccggttattaaccgttttcggaaacctttaaccgtttaagttaccgtacgtaaaccaaacgttgggtaacttaggttaagtttaagtttccgtaacccgtagggtttccccggaaacgggaaaccggtaaccgaagggttaaggtaaacctaaccgtaaaaggtccggtggtaccggttnccggttaaccaactttacggttacttacgtttcctagttaacccc

SEQ ID NO: 129457 - DNA, 617 bp, Homo sapiens
  misc_feature: GYAE6OF02F9VDY.45.78.H01.1.454.CMB.1.raw
  modified_base (271)..(271): a, c, t, g, unknown or other
  misc_feature (271)..(271): n is a, c, g, or t
tcagacgcgatcgacacgaccggtgctcgatttagtgtgagtagtttgggtttggggacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctcctgcaaggcttcgtggataccaccttcaccggctactanatacactgggtgcgacaggcccctgggacaagggcttggagtggagtgggatgggatcgaatacctaacaatggtcggcaactaaactatagcacagaagtttacagggcgaggtacacgatgaccgaggaccgacgtaccatcagccacgacgacctacagtaggacgtcgtagtacgcgaacgggctaggagacgtcgtacggaaccgtaccgaaccgggtccgttaggttacgtttaccgtggttcggaccggaacgggtaacgggacggtaacgggttaaacgtttaaccggttaggttttttaggggtaaggtttcgggttttaacggttttaaccggggg

SEQ ID NO: 129458 - DNA, 876 bp, Homo sapiens
  misc_feature: GYAE6OF02FVQ3P.45.78.H01.1.454.CMB.1.raw
tcagacgcgatcgacacgaccggtgctcgatttagtgtgagtagtttgggtttggggacccagcaaccacatctgtcctctagagaatcccctgagagctccgttcctcaccatggactggacctggaggatcctcttcttggtggcagcagccacaggacgcccactcccaggtgcagctggtgcagtcgtgggctggaggtgaagagccgtgggcctcgagtgaagtctcctgacgaggtcttcgtaggactacctaccttccgaccggtctaccgttataacgtacccgtacggttcggggtacgccggtacgaccgggtcccccgttagggaaccggtaacgggtcgtttacgggacggttagggaacggtgggtagtacggtaaccgttaacccgtaaaaccccttaaaggtaagttcgggtacccgtaaccgaaaacgtaaaccgtttagtaccggtaacctaacggttaaacggtaaaccgtttacgggaacgggtccggtaaccgggtaccaaccgtacggtaccggtaaccggaagggtacccgttacggtaaccctagtaccgaacgtaccaccgtacggtaccttaacgacgggtacggttaccgacgtagggtaccgtaccggaaagtccggtaagtaccgtacgtacccggttaacgggaaaccgacccgggttaaccggtaacccgggttagtttaacccggtttacggtacggttaccggggtaacgggaaccgggttaacggtaaaccgggtttaacgtttaaacccggggttttaggtttaaccgggttttttaacgggggtaacccggggtttttaaacggttttttacccggggaaggggtttttaaaaccccgggg

SEQ ID NO: 129459 - DNA, 732 bp, Homo sapiens
  misc_feature: GYAE6OF02GCKDP.45.78.H01.1.454.CMB.1.raw
  modified_base (261)..(261): a, c, t, g, unknown or other
  misc_feature (261)..(261): n is a, c, g, or t
  modified_base (269)..(269): a, c, t, g, unknown or other
  misc_feature (269)..(269): n is a, c, g, or t
  modified_base (275)..(275): a, c, t, g, unknown or other
  misc_feature (275)..(275): n is a, c, g, or t
  modified_base (279)..(279): a, c, t, g, unknown or other
  misc_feature (279)..(279): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaacctaacaatggtgacacaaactatgcacagtaagttcgaggcagggtcaccatacgaccgagggcacgtccatcagcacncgcctacngtgganctgngcgaggtcagagactcgtacgacgacgaccggtcgtgtacttacgtggtagcggagacggtacgaaggtaacctttgttaaggttttggaacggtttggtttaacgttagggtacggttaggtcgggtaacggttcggtaccgggggaccgtaaacggggtacccgtaacggtcccgtccggtacccttccgaccgtaccggtaccctacccggtaacccgtaacccgggtaccctaccgttccccggtttcccgttacccctaccgggtaccccttaccccgtccctaaacccggtaacggacccgttacccgtacccggtcgggtaccgggtacctaccgggtaccgcccggtaccgtccgggtaccgtccggtccgtacggttaccgaccggttccttaccgtcgtaccgtcggttacgtccggtaccgtggtcccgggtcgcggtacgg

SEQ ID NO: 129460 - DNA, 828 bp, Homo sapiens
  misc_feature: GYAE6OF02JU2Z9.45.78.H01.1.454.CMB.1.raw
  modified_base (202)..(202): a, c, t, g, unknown or other
  misc_feature (202)..(202): n is a, c, g, or t
  modified_base (323)..(323): a, c, t, g, unknown or other
  misc_feature (323)..(323): n is a, c, g, or t
  modified_base (340)..(340): a, c, t, g, unknown or other
  misc_feature (340)..(340): n is a, c, g, or t
tcagacgcgatcgacacgaccggtgctcgatttagtgtgagtagtttgggtttggggagagcatcacccagcaaccacatctgtcctctagagaatccctgagagctccgttcctcaccatggactggacctggaggatcctcttcttggtggcagcagccacaggacgcccactcccaggtgacagctggtgacagttcgngggctggaggtagaaacggacgtccggtggggtccctgaacggttggaacgggttcctctcggacgaacggtctttccgaggtactaccaccttacgaccggtactacgtatacgttaacncgtcggtacgcgaaccncggacccgtacggacgtaaggggtctttacggtacggtaaggggtcgtacggggtactacgggtacctaaccctaaacccgttaactaaagggttcgggttacggaaccctaaaagtaaaccgttaacgttgaaaccgtaacttaaacgggtaacttttcggggaacgggtaaccggtacggtaaaccgtacccgttaaggaccgggtaacccggtagggtaaccgtaaccggtccgtaaaccgttacaccggttacgacccgtaacgtaacccgtacgtaacgttccgggtaacgtaccgaaccgggtaccgtacggtacggtaacggtaccgtaacggttacggtaacccggtaacgggaacccggtacgggaccggtacgttaaccgggtttacgtttaccggtaaggttacccgggtaggttaaccgggtacgggaaggtttaaccccggtaaaggtttttacggttaccgggtttttaacggg

SEQ ID NO: 129461 - DNA, 701 bp, Homo sapiens
  misc_feature: GYAE6OF02JZGUE.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccgtacaagtgtggcacaaactatacgcacgagaagtttcgagggacagggtccacatgaccgaggacaccgtcaatcagcacagacctacgatggagcgtgagcgtaggcgtggagtatcgacgacgtacgacggccgtgtattacgtcggtgacgagacggcgaaggtattacggtagttttcggagttggtacttacgggtacggtagtacggtacgtcgtacggggaacggtacgggtacccgtacggtaccgtaacggtcctacccgtcacggtcctaccgacccggtaacggaccgtaccgttaccggtccggttaccccgtcggaccctacccgtacccgtaccgaccgtaccggtacccgtaccgttaccgggcggggtaacccgtcgaccgggtaccggtcccggtaaccgggtcccttaggaccggttaccggtaccggaacggttaacccgttacgtcccgtacggtacgcccgttggaccgacggtttaccgggcggttaccggacgg

SEQ ID NO: 129462 - DNA, 814 bp, Homo sapiens
  misc_feature: GYAE6OF02IKKIQ.45.78.H01.1.454.CMB.1.raw
  modified_base (192)..(192): a, c, t, g, unknown or other
  misc_feature (192)..(192): n is a, c, g, or t
tcagacgcgatcgacacgaccggtgctcgatttagtgtgagtagtttgggtttggggagagcatcacccagcaaccacatctgtcctctagagaatcccctgagagctccgttcctcaccatggactggactggaggatcctcttcttggtggcagcagccacaggacgcccactcccaggtgcagctggtncagtcgtggggctggaggtagaagaacgccgtaggggccctacgagtgaacggtcctcgtgacgaacggtctttacgtaggaactaaccctaccgtttaccgaaccggtactaacttaacttaactaacctacggttagggtacgccggaaccgtaccgggtcccccgtaggaaccgaaacgggtcttagggacggttaggacggttagggtagtacgggtaactaccgtaaaacccgttaaacgaaacgttcgggtacggaactaaacgaaaacttagtacgacaaacgtaaggttaacgtttacggacggacgtagggtaccaaccgtagtacggaacccgtagggaacctaaccggtacctaacgtacgaacgtaccaacgtaaccgtaacctaacgtacgggtacggacgtaccggtacgtaacggaccggtaacgggtaactacgggaaacgtacgtttaacccggaggtaaacccggtaaccggtacccgggtttaccggtaaacgtttaaccgtttaaccggttacgggaaccgggttaacggaaccgggtaacgggtaaaccggttaaagggttaaaaccgtttttacgggtttaacgttttttaaccgggggg

SEQ ID NO: 129463 - DNA, 829 bp, Homo sapiens
  misc_feature: GYAE6OF02FUGZ1.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtgcacaaactatgcacagaagtttcgagggcagggtcaccgtatacggaaccgaaggggaccacgtcccgataccgacgcacgacgccctacgtagtcggtacgcgttagacggaccgaacgggtctacggaggtacttccggtagaacccggtacggacccgggtaccggtttaggtacgttttaacgtcgggttacggtacggtagggtacgggacgtaaaggtaacgtttaaccggtttaagttttttagggacggtttagggtttaacgtttacggggtaacggttagtacggggttaccgttacgggtcggggtaacccggtaaaacgggtcccgaaccggggtccgtaacccgggtttcctcccgttaccgaccgtacccgtacccgaacccgaaccgggtacccctacggttcccgtttcccttcccccggtacggtcccctaccccgttcccgtaccgaaccgacgtccctaacccggttcggccggggtacccgacgtaccgggcccggtcccgtcggggtacccgttcgtcccggttacggtacccgaaacggttcccgtaaaccgtttcccgtacgtacccgtcggttacccgtacggtacgggaccggttccgggacgtacggg

SEQ ID NO: 129464 - DNA, 672 bp, Homo sapiens
  misc_feature: GYAE6OF02GVMPR.45.78.H01.1.454.CMB.1.raw
tcagacgcgatcgacacgaccggtgctcgatttagtgtgagtagtttgggtttgggggaggcatcacccagcaaccacatctgtcctctagagaatcccctgagagctccgttcctcgaccatggactggacctggaggatccctcttcttggtggcagcagccacaggagcccactcccaggtgccagctggtgctagtcgtggggctaggaggtgaagaacgccgtggggcctcgaggtgaaggttctacctgacgtaaggtctttcgtggacttacgaccttcgaccggtactaactatactaccgtacgtgggtagacgaacgcggtaccccgtgggaaccgtaaggggtccttagggaaggttagggtacggttagggtagttaggggacttaccgaaacccgtaagtagtcgggttaggaccgaaactaaacgttagtcgacaacgtaggtaaacgtttacggagggaccgtaacggggtaccaacgtagacggaaccgaaggggtacctacgtaccaagttacgacgctaaacgcgtaacctacgagtcggaagtccgtaggacgtcgaggtacgagagtactacggtacgacgaccgtcggtcctaggttactacgtgtacgacgaggacggacgtacggtaacgttcggttagttaggtacgg

SEQ ID NO: 129465 - DNA, 693 bp, Homo sapiens
  misc_feature: GYAE6OF02IZDOQ.45.78.H01.1.454.CMB.1.raw
  modified_base (301)..(301): a, c, t, g, unknown or other
  misc_feature (301)..(301): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagagccgtgggcctcgagtgaacggtctccgtgcgaggtcttcgtggataccaccttcgaccggtctaactatactacgacgttggggtnccgtacgaccggtccccgtagggaacgagggtcttggacggtggagtagggatggactaccgaaaccctaaacgtaggtcgggtacggactaactaaacgtagtacgacgtaacgtaaggtaacggtttacggaaggggtacgtaacggggtaccctaaccgaggtaccggaacccggagggaacccgtaccgtaccgtaacgtaccgaacggacctaaccgaccgtacccgtaacgtaacggtcgggaacgtcgtacggacggacggtacgacgtaggacgtacgttcgaacggtacgaccggtaccgggtacgttacgttaacgttacggtgtacggagacgggagtacggtaaggttaacggtttacggtttacggtttagggtaacgg

SEQ ID NO: 129466 - DNA, 881 bp, Homo sapiens
  misc_feature: GYAE6OF02HOL19.45.78.H01.1.454.CMB.1.raw
  modified_base (260)..(260): a, c, t, g, unknown or other
  misc_feature (260)..(260): n is a, c, g, or t
tcagacgcgatcgacacgaccggtgctcgatttagtgtgagtagtttgggtttggggagagcatcacccagcaaccacatctgtcctctagagaatcccctgagagctccgttcctcaccatggactggaccgtggaggatcctcttcgttggtggcagcacgccacgaggacgcccacctcccgaggtcgcagctggtgcgagtcgtgggtcgtggaggtgaaagacgccgtcgggcctgagtaggaacggtcctccgngacgaggtcttcgtaggtactaccgaccgttaccgaccggtacttaactaattaacgtaccgtacggttcggggtacgtaccggaccgtaccgggtcccccggtaacgggaacggtaacggggcggttttagggaacgggtaggggtaggtacgggggtagttacggggtaacttaacccgtaaaaccccttaaacggtaacggttacgggggtaaccggaacctaaacggtaaaaacttaacggtacgaaacgtaaacgtaaacgggtttaaacggtttacgggtaacgggggtacccggttaacggggttacccgtaaacggtaaccgttaacgggaaccgggtaaaccggggaacctaaccgggtacctaaccggtaccgaaccgtaccgaaaccgtaccggtaccgtaacgtaggttacggggaacttccggtaaggacggtacggtacggacggttacgggaaacgttcggtaaccgtaccggaaccggtaacccgggtccgggttaaccgggtttaacgtttaccggttacggttcgggacgggtaacggcgggttaaacggtaccggggttaacgggtttaaacggtttaacgggttttaggttttaacggggg

SEQ ID NO: 129467 - DNA, 658 bp, Homo sapiens
  misc_feature: GYAE6OF02I1Q3L.45.78.H01.1.454.CMB.1.raw
  modified_base (149)..(149): a, c, t, g, unknown or other
  misc_feature (149)..(149): n is a, c, g, or t
  modified_base (197)..(197): a, c, t, g, unknown or other
  misc_feature (197)..(197): n is a, c, g, or t
  modified_base (362)..(362): a, c, t, g, unknown or other
  misc_feature (362)..(362): n is a, c, g, or t
  modified_base (366)..(366): a, c, t, g, unknown or other
  misc_feature (366)..(366): n is a, c, g, or t
  modified_base (387)..(387): a, c, t, g, unknown or other
  misc_feature (387)..(387): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtnacatccagatgacccagtctccttccaccctgtctgcatctgtagganacagagtcaccatcacgttcgccgggccaagtccaagacgttaattacgtaactggttaggcctggtatcagcagaaacgaggaaacgccctaagctcctagactctataaggctatactagttagaaagtcgggtaccatacgaagttcagcgagagtgatcgngganagtaacttcactcacaccganacgtagacacgacccgtgcacggtacctggaagtcgtaactttttcggaacttaaccgtttaattaccttacgacccgaaaatcggttaaattacggtaagtttaacgttaaacgttttccggaaaccgtttccgggaaccgtaaacggggtaaacccgtaaacgggtacgtaaaacggttaaaccgtaaaacgtaaccggttaacggtcggtttaaccggcgttaacccgtacgtaacttaccggttcgggttaccctttacgttaaccc

SEQ ID NO: 129468 - DNA, 708 bp, Homo sapiens
  misc_feature: GYAE6OF02FMIVI.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaaccctaacaatggtggcacaaactatgcacagaagtttcagggcagggtcaccatgaccagggacacgtccatcagcacagcctacatggagctgagcgaggctcgagatctagacgacgacggccgtgtacttactggtgcgaggaggcgaaggaattacgtagttttgggaagttggttaagttcgggtaacggttagtcgggtaacgtcggtcgggggaccgaacggggtaccgtaccgggtaccgtacccggtccgtacccttcgaccgtcccgtacccgaaaccgaacccggggtacccctaaccgtcccgggttaccctttcccccggtaccggtcccgtacccccttcccgtacccgtaacgacgtacccacccgttacccgaaggaccgaccgaaccgtacggcccggtcccgtgggtacccgtcggtcccgtagggtaccggtaaacgggtacccttaccgttcccgtacggtaccgtacggtcccgttacgtacgggttccgggaccgggtaccggg

SEQ ID NO: 129469 - DNA, 760 bp, Homo sapiens
  misc_feature: GYAE6OF02JGKUG.45.78.H01.1.454.CMB.1.raw
  modified_base (137)..(137): a, c, t, g, unknown or other
  misc_feature (137)..(137): n is a, c, g, or t
  modified_base (192)..(192): a, c, t, g, unknown or other
  misc_feature (192)..(192): n is a, c, g, or t
  modified_base (196)..(196): a, c, t, g, unknown or other
  misc_feature (196)..(196): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtncgacaggcccctggacaagggcttgagtggatgggatggatcaacctacaatggngcanaaactatgcacagtaagtttcagggcagggtccaccatcgaccgaggacacgtccatcagcacacgcctacagtcggagtctcgacgcgaacgggtctaggtacgaagtcgtcgaccggaacgaccggtccggttataagttaccgtggtacggcggtaaggtacggacgaagggttaactttaacggttagtttttaggggaaggtttagggtttaagttacgggtacggtaacggttcgggtacggtttacgggtaccggggtaccggtaaacgggtacccggtttaacgggtacccgtacccggttacctacccgttcgtaaccgtacccgtacccgaaccgtaaccgggccctacggttcccgttacccgttaccccgttcgacccgtaaccccgttccctaaaccgacggtacgccggtacctaccggtcgggggaaccctaccgaccggggtccgtcccggtccgggtactcccggtaccgtcgggtaccaacggtacccgttacgttcccgaacgtcgtccggtacgttccgcggtacgggtccgggtaccgtacgg

SEQ ID NO: 129470 - DNA, 734 bp, Homo sapiens
  misc_feature: GYAE6OF02HIZWZ.45.78.H01.1.454.CMB.1.raw
  modified_base (169)..(169): a, c, t, g, unknown or other
  misc_feature (169)..(169): n is a, c, g, or t
  modified_base (347)..(347): a, c, t, g, unknown or other
  misc_feature (347)..(347): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggacnccccacctacccagggtcgcagtcgtggtcgcaggtcgtggggctggaggtagaagaacgccgtgggcctacgaggtacgacggttcctccgtgacgaggtcttcgagactaccaccttcgaccgtctactatatactcgtggcgcgacgccggccgtaggacgagggcttaggaggnggtagtagggtagtcggactaccaaaccgtaacaggtggacgtaccaacgtaactatacgtacaacgtaggtaacggttacgacgggtacgacgggtacaaccggtagtaaccggaacccgggtaaccggaaccgtaccgtacctacgtaccgaccgtaaccaacgtaccgaccgttacgacgggtacggtacgaccgttacgggaccgacgtacgggtacgtagtaacgttaaccgttacgaaccggggtaacccgaaccggggtaccggttactttaaccggttaacggttacggttacggtaacccggagggtaaccggacgggttaacggttaaccgggtttaaagttttacgggttttacgggttttaacggttaacggggg

SEQ ID NO: 129471 - DNA, 762 bp, Homo sapiens
  misc_feature: GYAE6OF02F18HI.45.78.H01.1.454.CMB.1.raw
  modified_base (296)..(296): a, c, t, g, unknown or other
  misc_feature (296)..(296): n is a, c, g, or t
  modified_base (353)..(353): a, c, t, g, unknown or other
  misc_feature (353)..(353): n is a, c, g, or t
tcagacgcgatcgacacgaccggtgctcgatttagtgtgagtagtttgggtttgggggagagcatacacccagcaaccacgatctgcctctagagaatcccctgagagcttccggttcctcaccatggactgggaccctggacggatccgtcttacttggtggcagcagccacaggagccctactccgaggtgcacgcgtaggtgacacgtcgtaggggctggacggtcgaacgaaggccgtaggggccctacgaggttacggaaggtccttaccgtggcgaaacggtccttacgngggaatacctaccgttccgaaccggtcctaactatactacacgtcgggtagcgaacncggccccttaggactaacgggtcttgacggtgacgtgggtatggacgtaccaaccgtagacgtgggtacgacaacaacgtatacgacaacgtaagtacgtttaccgaggggtaccgtacgggtaccaccgtagtcggaacccgagggacctaccggtacctaatacccgtacggacctaacgacgtaccgtaaacgtacgtaacgggtaacgtccggttacggaacggtccgggtaaacgggtccgtttaacgggaccgttaacggtaccggttaccgggaaccgtaccgggtacccgggtacggtttaaccgtttacggtaaacccggtttgggtaccggttaacggacgggtacccgggtaaggtaaccgggtttacgtttaaccgggttttaccgttttaacgggg

SEQ ID NO: 129472 - DNA, 877 bp, Homo sapiens
  misc_feature: GYAE6OF02G325V.45.78.H01.1.454.CMB.1.raw
  modified_base (187)..(187): a, c, t, g, unknown or other
  misc_feature (187)..(187): n is a, c, g, or t
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaacctaanaatggtgcanaaactntgcacagtaagttcgaggcaggtcaccatgaccagggacacgtcatcacgcacacgtcctaacatcggagctgagcgaggaccgtagacgtatacgtacgacggtaccgaaccggaccgttcgttaacttacgtacggtacgaccgggtaaggagggtaaccgaagggttaaacttacggtttagttttagggaacggttttggtttaaccggttacgggttacggtaaggtttaccgggtacggttccgggttacggggggaccgtaaacgggggtaccccgtaacggggttccgtacccggttccgtaacccgtaccgtaacccgtaccccgtacccgtaaaccgggtaaaccgggtacccctacggttacccccgggttccccgttttaccccccgggtaccgtaccccggttacccccgttaccccgtaacccggtaaaccggacccggttaacccggtaccccggttacccgggtaccggggggtacccttaaccggacccggggtcccgggtaacccccgggtcgggtaacccgttcccggtccggtttacccgggtaacccgggttaacggtaaccccttttaccgggtttacccgtacccgggtacgtttacccgggtccggttaccgtttcggggacccggggtacgggtccggttaacccgggg

SEQ ID NO: 129473 - DNA, 634 bp, Homo sapiens
  misc_feature: GYAE6OF02JKRFT.45.78.H01.1.454.CMB.1.raw
  modified_base (608)..(608): a, c, t, g, unknown or other
  misc_feature (608)..(608): n is a, c, g, or t
tcagacgcgatcgacacgaccggtgctcgatttagtgtgagtagtttgggtttgggggagtcagacccagtcaggacacagcatggacatgagggtccccgctcagctcctgggctcctgctgctctggcctccaggtgccaaatcgtgactatccagatgacccagtcctcccttccaccctgtctgcatctgtaggagacagagtcacctatcgtacttcggccggcagtcagagttatagtaacgtggtcgcgtggtatagagacaagaaccgtaaggaacgtacccctaagcctccgtgctacgtataacgctatcttagtagtaacggtcggtaccagtacgtaacggttacgagcggtacgaggtagacttagtacggagtaacgtaattcctactccgacacctagtaccgacgacacggcctagaccgtacgtctgtacgttagtatttacgtactaactttacttaccgttacgaacctacgtagtagttacgtaacgttacgtttacgttaccggtaccgttaccgggaacggaaaccgggttaccgtaagggttaactaacgtaacgaacggtaaacgttgtaccggtactgtaccncggttaactcgtcgttcttacgtacc

SEQ ID NO: 129474 - DNA, 616 bp, Homo sapiens
  misc_feature: GYAE6OF02F7ZRN.45.78.H01.1.454.CMB.1.raw
  modified_base (196)..(196): a, c, t, g, unknown or other
  misc_feature (196)..(196): n is a, c, g, or t
  modified_base (484)..(484): a, c, t, g, unknown or other
  misc_feature (484)..(484): n is a, c, g, or t
  modified_base (490)..(490): a, c, t, g, unknown or other
  misc_feature (490)..(490): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaganacagagtcaccatcacttgccggcagtcagtagtatagtactggttcgcctggtatcgagactaagaaaccgagggaaacgccccgtaagcctcctgcctactagtaaggctactcgttaagtttaggaaaggttcgggtccctaagtcgtaacggttcgacggtcggacaggtcggactcgtacgggaactaagtaattccacgtcctaccacctatacgacgtcgacgtcctcggacctacgcctagtaactggttatttgactaactttctacctacgacctaanagttanacgtaagtttagttagttacgtacgtttaccgaccgtaaagggtaccgtagggtacgaaaccgtacgaaacggtactcgggtcgtacgtcgaactaccgtacgtcgttacgttccttacgtacccg

SEQ ID NO: 129475 - DNA, 645 bp, Homo sapiens
  misc_feature: GYAE6OF02HPX8R.45.78.H01.1.454.CMB.1.raw
  modified_base (192)..(192): a, c, t, g, unknown or other
  misc_feature (192)..(192): n is a, c, g, or t
  modified_base (199)..(199): a, c, t, g, unknown or other
  misc_feature (199)..(199): n is a, c, g, or t
  modified_base (354)..(354): a, c, t, g, unknown or other
  misc_feature (354)..(354): n is a, c, g, or t
  modified_base (518)..(518): a, c, t, g, unknown or other
  misc_feature (518)..(518): n is a, c, g, or t
tcagacgcgatcgacacgaccggtgctcgatttagtgtgagtagttgggtttgggggagcatcacccagcaaccacatctgtcctctagagaatccccctgagagctccgttcctcacccatggactggacctggaggatcctcttcttggtggcagcagccacaagagcccactcccaggtgcagctggtncagtcgngggctggaggtgaggaagccgtgggcctcgagtggaaggtctcctgacgaacggtcttcgtggcctaccacccttcgaccggcgaccttatcctaccgtaacgtgggtcgacgaccgacggtcccgtggaacggaggtctggacgtggagtgggngtaggactaccgtaacctaagacgtggtacggaactaaccaaacgttagcggaccctaaataaggtaacggttacgacggggtcgtaacggtcaaaccgtacgttacggaccgaagggaccctacgggtacccagtaccgagtacaaccgacgacctagaacgnggtagcgtagaccgagacgtatacggaactgtacgaacgtaccgaacggtccgtacttaattttaccgagtggtacggacggacggtttagtccgggttcggttcggtgttttccgttgttaccggg

SEQ ID NO: 129476 - DNA, 656 bp, Homo sapiens
  misc_feature: GYAE6OF02GFLQR.45.78.H01.1.454.CMB.1.raw
  modified_base (143)..(143): a, c, t, g, unknown or other
  misc_feature (143)..(143): n is a, c, g, or t
  modified_base (257)..(257): a, c, t, g, unknown or other
  misc_feature (257)..(257): n is a, c, g, or t
  modified_base (262)..(262): a, c, t, g, unknown or other
  misc_feature (262)..(262): n is a, c, g, or t
  modified_base (276)..(276): a, c, t, g, unknown or other
  misc_feature (276)..(276): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctnttcttggtggcagcagccacaggagcccactcccaggtgcagctggtgcagtcgtggggctgaggtgaaggagccgtgggcctgagtgagtctctgacagtctcgtggactacnccttnaccggtctatatanacacgtggtcgcgacacggcccgtggaacgaaggggcttaggaggtcggagtgggatggaactccgtaaaccctaagaagtcgggtacggaccaaacctaaacgtgacgtacaacgtaacggttaaggtttccggaggggtacgtacggggtaccaaccgtaggtaccgaaccggtacgggaacccttaccggtaccactaccgaacggaccaaccgtacgaaccgttaacgacggtacggcgtacggtaggaacgacggaggtaccgtagacgtaacgtccggtaaggaccgaccgtcggttactcggttaacttacgtacggtggtaacgaggtaacggagtaacggttaagttacggtttaggtttaggttaacggg

SEQ ID NO: 129477 - DNA, 680 bp, Homo sapiens
  misc_feature: GYAE6OF02F53J3.45.78.H01.1.454.CMB.1.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtgggcctcagtgaaggtctccgtgcaaggcttcgtggatacaccttcaccggctactatatacacgtggtgcgacgacggccccgtggacgaagggtcttggagtggagtgggatggataccaaaccctaacaagtgggtacggacaacgaaactagtcgacaacgtaagtaaaggttttacgacgggtacgtacggggtacaacccgagtacggaaccgacgggaaccctacggtacccaacgtaccgaacgtaccaacgaccgtacccgtaacgtagtacgggtacgacgtcgggaacggtaccgaagggtaccgtagggaacgtaacttccgtacggaaccgtaacgggacccgggtcccggttaggttaaccgtttacgttaggtaccggacgggtaacggacgggtaacggtaaggttaaacggttaaccggttttaggttttcgggttaaagggg

SEQ ID NO: 129478 - DNA, 739 bp, Homo sapiens
  misc_feature: GYAE6OF02GIMNZ.45.78.H01.1.454.CMB.1.raw
  modified_base (263)..(263): a, c, t, g, unknown or other
  misc_feature (263)..(263): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtgggctggaggtgaagacgccgtagggcctcgaggtgtaacggtcctcctgacgaacggtcttcgnggtactaccgtaccttccgaccggtctaaccgtaattactaccgacgttggggcctacggaaccgtccgggaccccgtagggaccgtaacggggtcttggtacggttagggaacggtggggagttacgggtaactaaccgtaaacccgttaaagtaaggtcggggttacggacctaaaactaaacccgtagacgtaaccgaacgttaacggttaacggtttacggacggggtaacggtacgggtacccaaccgtacgtacggtaacccggagggacccgtaccgtaaccgactaccgaccgaccgaaccgaccgtacctaacgaggtacggagcgtacggacgacgacggacgttacgaccggtacgtacgtacggaaccgtccggtaccggttacgttaggttaacgttccggtggtaccgcggtaaggacggacgttaaggttaaccgttacggtttaggtttagggttaacgg

SEQ ID NO: 129479 - DNA, 757 bp, Homo sapiens
  misc_feature: GYAE6OF02IXNT5.45.78.H01.1.454.CMB.1.raw
  modified_base (258)..(258): a, c, t, g, unknown or other
  misc_feature (258)..(258): n is a, c, g, or t
tcagacgcgatcgacacgaccggtgctcgatttagtgtgagtagtttgggtttgggggagcatcacccagcaaccacatctgtcctctagagaatcccctgagagctccgttcctccaccatggactggacctggaggatcctcttcttggtggcagcagccacaggagcccactcccgaggtgcagctggtgcagtcgtgggctggaggtagaaagaacgtccgtggggacctcgacggtagtaacggtccttccgngtacgaaacgggtctttcgtacggtaacgtaccgtaccttaccgtaacccgggacgttaaccttaaataccgtaaactaccggttaggggtacggaccgaaccgtaaccgggtccccgtaagggaaacgtaaacggggtctttacggaggtacggtaagtaagggtgttaggaacttaaccaaaacccgtaaacgtaaacgttacgggtacggaaccaaactaaaactatacgacaacgtaagtaacgtttacgacgggacgacggtaccacctaagtcgaaccgaacgggaacacgtccaatacgtagaccacacgtacctagtaacgtacggagtacgagtacggacgaacggtctaacgggtaactacggtaaaccggtacggtaaacgaccggacgggttaaccgttggttaaacgttacggtaccgggtaagaccggtaaggaaccggtaggtaaaccgtaaacgtttaacggtttaacgtttagggtaacggg

SEQ ID NO: 129480 - DNA, 704 bp, Homo sapiens
  misc_feature: GYAE6OF02ID1MK.45.78.H01.1.454.CMB.1.raw
  modified_base (405)..(405): a, c, t, g, unknown or other
  misc_feature (405)..(405): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctgggaggatcctcttcttggtggcagcagccacaggacgcccactcccaggtgcagctggtgcagtcgtggggctggaggtagaagaggccgtggggcctcgagtgaaggtctccgtgcaaggtcttcgtggatacctaccttcaccggtctacgtatactactacgtgggtcacgacacgggccccgtagggaacgaacgggtcttaggaggtggacgtaggggataggactaccaaacctaacaagtagggtacggacctaaacaaaacgtntacgaccaagtaaggttaacggtttacgaggggtacgtaacgggtaccaacgtacgtaccggaaccggaacgggaactaacccggtacctaacgtaccgacgaaccaaacgtaccgtaccgtaacgagtacggagtccgtaggacggtacgacgggacctaggaacggtactacgttaacggaaccgtacgtaccgggtaccgttaggttaacgttacccggttaggtcggaaaccgggtaggacggtaacgggtaacgggttaacgttttaacggtttagggttttaggttaacgggg

SEQ ID NO: 129481 - DNA, 821 bp, Homo sapiens
  misc_feature: GYAE6OF02HIT9I.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatggatggatcaacctaacaatggtgcacaactatgacacagaagtttcgagggcagggtcaccatcgacgaggacaccgtccatcagcacgagcctaagagtcggagtctaggacgacacggtctaggaacgtacttaccggtagaaccggaccgtaccggtcccggttagtttacgtttaccggtaggttcggaccggtaggaacgggtaccgtaaaggttaaacgttttaacgttaggtttttagggtacggtttgggtttaacggttacgggtacggttaacggttacgggtacccgggtttggggaccggggtaaccgggtaaaccgggggacccgttacgggtacccgtaccccggtttcgttaccccgttaccgacccggttacccccgtaacccgaacccgggtaaacccgggtccccgttaacccgttccccgggtacccctttacccccggaccggttccccgtaccccgtaccctaccgtaacggacccgtaccgcccggttcgggacgggtacccgaacggtccgggtaccggtccgtccggggtcttccggacccgttagggtacccggaacggttacccttcccgttacgtccgtacgttccggttcggtacgtccgggtaccggtcggtaccgaacggg

SEQ ID NO: 129482 - DNA, 760 bp, Homo sapiens
  misc_feature: GYAE6OF02GWENO.45.78.H01.1.454.CMB.1.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtggggcctcaggtgaaggtctccgtgcgaaggcttctaggactactaccttcgaccggtctactatactacacgtgggtcgacgacgacggccccgtaggacgaacgggcgttaggaggtggagtgggagtcggtactaccgaacctaacgaagtcggtagacgtaactaaacgtagtacgacaagtaacgtaacgttcggacgggtacgaggggtaccaccgtagtaccggaaccgaacgggtaccgtaacgtacctaacgtccgaacgtaccgaacgtacggtacccttaacggtacgtacgggtaacgtacgtaacgggtacggacgtaacgggtacgtaacggaacggttacgttacggtaaccggtaacccgggtaacccggtaacccggggttaccggtttaccggtttaaacgttaacccgggtttacggggtaaccggtaaccgggttacggggttaaacgggtaacccggttaaacggggtttaaacgggttttaacgggtttttaacgggtttttacggggttaaacgggg

SEQ ID NO: 129483 - DNA, 712 bp, Homo sapiens
  misc_feature: GYAE6OF02H1PJY.45.78.H01.1.454.CMB.1.raw
  modified_base (293)..(293): a, c, t, g, unknown or other
  misc_feature (293)..(293): n is a, c, g, or t
  modified_base (603)..(603): a, c, t, g, unknown or other
  misc_feature (603)..(603): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccagtgacgaggacacgtccatcagcaacagcctacagtggagctgacgcgaggctgaagtntcgtagaacgtacgacggtccgttagttacttacgtggtcgacggagacgggactaaggtaaagtttacggttagttttagggaggtttacggttagttacgggtacggttagtcggggtacgttcgggtacgggggaacccgtaaaggggacccgtaccgggttacccgacccggttcctcccgttccggaccgtcccgttacccgaacccgtaccgggaccctaccgggttacccgttcccctttccccgaccggtccctaaccccgtcccgtacgaaaccgcgtaccctaccgtcgggaccgggacnccgtacggcccggtccgtacgggtccgtcggtaccgtacggtaccgaacgggttaccttaccgtccgtaccgtacgttccggacgttgtacggcggtcggtcgtacggg

SEQ ID NO: 129484 - DNA, 739 bp, Homo sapiens
  misc_feature: GYAE6OF02IW8R3.45.78.H01.1.454.CMB.1.raw
tcagacgcgatcgacacgaccggtgctcgatttagtgtgagtagtttgggtttgggggagcatcacccagcaaccacatctgtcctctagagaatcccctgagagctccgttcctcaccagtggactggacctgggaggatcctcttcgttgggtggcagcagccacgaggacgccctaccgtcccgaggtcgcgaggcgtgggtcgcgtcggtcggtggggtctagggtagggtagacgaacggtccggtcggggcctacgaggtacggtaacggtcctccgtgacgtacggtcgtttacgaggaactacctaccgttacgaccggtaccttaacgtataacgtaacgtacggttggggacgaccggacggaccggtccccgtaggaacggggtaacggtcgttaggtaagggtagggtaggtagggtaacgtacggacgtaaacccggtaaacctaacggtaggtacgggtacgtacgaaaacgtaacgtacgtacgactaagtaaaggtacggttaacggacgggacggttacggtaccgaagtacgtaaccggacgggaacggtacgtaaccgtacgactaacgcgtacggaacctaccgtacctacgaaggtggtaacgtcgacggacgacgtcggagtacgtagtacgtacgacgaccgtaacccgtggaacttcggttatacggtggtacgcggaggtacggacgttaagtagttacggttagttggtacgg

SEQ ID NO: 129485 - DNA, 730 bp, Homo sapiens
  misc_feature: GYAE6OF02IIT3C.45.78.H01.1.454.CMB.1.raw
  modified_base (108)..(108): a, c, t, g, unknown or other
  misc_feature (108)..(108): n is a, c, g, or t
  modified_base (119)..(119): a, c, t, g, unknown or other
  misc_feature (119)..(119): n is a, c, g, or t
  modified_base (137)..(137): a, c, t, g, unknown or other
  misc_feature (137)..(137): n is a, c, g, or t
  modified_base (281)..(281): a, c, t, g, unknown or other
  misc_feature (281)..(281): n is a, c, g, or t
tcagacgcgatcgacacgaccggtgctcgatttagtgtgagtagtttgggtttggggtgaagaagcctggggcctcagtgaaggtctcctgcaaggcttctggatacnccttcaccggntactatatacactgggtncgacacggcccctggacgaagggcttggaggttggagttggggatagggtattccaaccctaaacaagtcggtacgtccaacaaacgtatgtaccaacaggttaatttcggagggacgaggtcacaagtcgaccgtacgggacncgtacctagcaacgtacgacacgtaccaactaggtaggaccgtcggtagacggacaaggtccaggtacgtaacgtccgacgtaaccggacgtacggtaccgttgtaactacgttgaccggacggtacggacggtacgaaacggttaacgtcggtttaggttttacggaacggttttggtaacggtttagggcggttaaggtgggtcgtaggttccggggaactaccggggctaacgggtccgtaccgtccctaccgctaacgtccctaccgaccgacggaccctacgtcccggttaccttacccgtcgtaccctacctccgtacgaacgtcgtacctaccgtacggaccggggtactaaccggccggtaccggccgttacgcgttaccggtccgtacggtacctaggtacctacgtcgtacgacggtcgcggtagcggcggtcgtagcg

SEQ ID NO: 129486 - DNA, 821 bp, Homo sapiens
  misc_feature: GYAE6OF02GA74B.45.78.H01.1.454.CMB.1.raw
  modified_base (130)..(130): a, c, t, g, unknown or other
  misc_feature (130)..(130): n is a, c, g, or t
  modified_base (318)..(318): a, c, t, g, unknown or other
  misc_feature (318)..(318): n is a, c, g, or t
tcagacgcgatcgacacgaccggtgctcgatttagtgtgagtagtttgggtttgggggagtcagacccagtcaggacacagcatggacactgacgggtccccgctcagctccgtgggctcctgctgctcnggctccaggtgacaaatgtgacatccagactcgaccctagtcctacccttccgaccgtgtctaggctagttcgtggtaggacgacgtaggtacgtaccaaccctagttccgtaacggtcggcccgggactacgtacgaagttaagttaacgttacgtaacggttcgggttaccggccgttaaggtacncggaacgaaccgtaaacgaaaccgggaaggaaccctaccccgtaagccttaccgtacgtacctaacgtaacgtaacggtctaaggttaacctttaaggtttaacggaaccggggttccggtaaccagttaaccgggtaacgttcggacggggaccggtagtacggtcggtaacgttcgggtaacgggacctaaacggttactacctaacccgttactaacccgaactagaccgtaccgacggtaacctcgtcggacccgtaagtcccgttagtacgtttacgtttacgtttacgaaacctttaaactttacgtaccggaaccgttaaccttaaacgggtacgtttaaatacgggtttaacttacggtttaaccgggtaccgttacggtaacccgtaaaggggaaccggtaacgtaaggttaacgaaccgtaaacgggtaacttacgggtcgtaaccgattaccggaacttacttacgttcggttaccttacgttacctcccgg

SEQ ID NO: 129487 - DNA, 713 bp, Homo sapiens
  misc_feature: GYAE6OF02GEUIO.45.78.H01.1.454.CMB.1.raw
  modified_base (144)..(144): a, c, t, g, unknown or other
  misc_feature (144)..(144): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctgggaggatcctnttcttggtggcagcagccacaggagcccactcccaggtgcagctggtgcagtcgtggggctggaggtggaagaagccgtggggcctcgaggtgaacggtctcctgacgaggtcttctggactacaccttcaccggcttacgtatactacacgtggggtcgacgacgaccggtccccgtggaaccgaagggtcgttggacggttgggagttagggggattacggggaacttacccgaaacccgttaaacgtaagggttacgggtaggaaccgtaaactaaaacgttcgttaggaacctaacgtaaggttaacggtttacggaaggggtaccgtaacgggggttaccaaccgtaacggtaacggaacccgggtaacgggaaccgtaccgttaccgacgtaccgaacggtacaccggaacgtacctaacgtagcggtaacggtccgtaggaacgtacgtaaggtcgtaagtacgagtcgtaacgaccgacgaccggtcgtaggttacgtacggtcgtacggacgacggtacggacgttaggtaacgtttacggtttaggtttaggttacggg

SEQ ID NO: 129488 - DNA, 686 bp, Homo sapiens
  misc_feature: GYAE6OF02HNMHL.45.78.H01.1.454.CMB.1.raw
  modified_base (236)..(236): a, c, t, g, unknown or other
  misc_feature (236)..(236): n is a, c, g, or t
  modified_base (268)..(268): a, c, t, g, unknown or other
  misc_feature (268)..(268): n is a, c, g, or t
  modified_base (305)..(305): a, c, t, g, unknown or other
  misc_feature (305)..(305): n is a, c, g, or t
  modified_base (322)..(322): a, c, t, g, unknown or other
  misc_feature (322)..(322): n is a, c, g, or t
tcagacgcgatcgacacgaccggtgctcgatttagtgtgagtagtttgggtttggggagagcatcacccagcaaccacatctgtcctctagagaatcccctgagagctccgttcctcaccatggactggacctggaggatcctcttcttggtggcagcagccacaggagcccacctcccaggtgacagcgtggtcgcgagtcgtggggctggaggtagaagacgccgtggggcctnagtgaagtctctgacgaagtcttgtgactacnccctacgaccgtctactatactacgtacggtgggtcnccgacgacggaccccgnggtaacgaacgggtcttaggtacggtggaggtagggtagtggactaccgaaaaccgtaacgagttcgggacgaacaaacctaaacgtatacgacgtaacgtaaggttacgttacgggacgggaccgtaacggggtacctaaccggtagtaaccggaacggtaaacgggtaccgtaccgtaccaacgtacgaacgtaccgacgtacgtaacccgtagacggtacggacgttacggtacgaaccgcggtacggtcgttagacgtacgtacgtacgaaccggaccgtacggttaccgtacggttaccgtacggtgttacggaggtaggacggtaacggtacggtaaggttaccgtttagtttacggg

SEQ ID NO: 129489 - DNA, 749 bp, Homo sapiens
  misc_feature: GYAE6OF02JNLDG.45.78.H01.1.454.CMB.1.raw
  modified_base (188)..(188): a, c, t, g, unknown or other
  misc_feature (188)..(188): n is a, c, g, or t
  modified_base (199)..(199): a, c, t, g, unknown or other
  misc_feature (199)..(199): n is a, c, g, or t
  modified_base (211)..(211): a, c, t, g, unknown or other
  misc_feature (211)..(211): n is a, c, g, or t
  modified_base (300)..(300): a, c, t, g, unknown or other
  misc_feature (300)..(300): n is a, c, g, or t
tcagacgcgatcgacacgaccggtgctcgatttagtgtgagtagtttgggtttgggggtgaagaagcctggggcctcagtgaaggtctcctgcaaggcttctggatacacctttcaccggctactatatacactggtgcgacaggcccctggacaagggcttgagtggatggatggatcaaccctaanaatggtgcaanaaactatgacanaagtaagtttccgaaggcagggtccaccgatacgaccgagggacacgtccatcagacacgacgtacctagtagtaggatcgtaggacgngacggctaggaacgtactcgtacgaacgaccgtaccggtcccgttagttaccttaagtcggtaacggtccgaaggtaacggacgtaacggttaacgtttaccggttaggtttttgggaaacggttttacggttacgttacgggtaaggtacgtacgggttcgtaccggtacggaccggaacggtacccaggttccctaccggttactcgtactccgtaccgtccgaccgggacgtaccgtcgtaccggttacccgttcccgtacgacccgttaccctaccgtaccgacggtaccgtacccgtccgtaccggtacgggccgtaccgaaccggtccggtcccggtacgggtccgttaccggtcggttaccggtaaccggtaaacgttccgttaccgttacgtacgttaccggacggttacgttccgagggtacccggtggtccggtaacgg

SEQ ID NO: 129490 - DNA, 701 bp, Homo sapiens
  misc_feature: GYAE6OF02HZ7BP.45.78.H01.1.454.CMB.1.raw
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatcgacccagtccttccttccaccctgtctgcatcgtgtaggagacgagagtccactatcacttgccggccacgtcaagagttattaagtaacgtggttcggtccttggtatccaggaccaaacggaaaaccgtaaaggggaaaccgtacccccgtaaaggcccttaccgtgtaccttacgtaacgtaacggcctaactttcgtaaaggttttaaacggaacgggttccggggttacccagttacgaacggtttacgacggtcggacgtaggtaggactcggtaggactaagtacttcgtactacctaccgtaccagtacacgcctacggtaccgtgacgtacgtaccttgtaagtacgttattttacgacctttaattacttaaccgtacgtacctaagtacgtaagttacgtaagtttacgtttagttaccgttacggttaccggaacgtaacggtaaccgaaggttacgaaaccgtaacgtaaaccgttacgtaggttcgtacgtacgactaccgtacgttacgttacgtccttctaaccg

SEQ ID NO: 129491 - DNA, 979 bp, Homo sapiens
  misc_feature: GYAE6OF02F2P2J.45.78.H01.1.454.CMB.1.raw
  modified_base (189)..(189): a, c, t, g, unknown or other
  misc_feature (189)..(189): n is a, c, g, or t
  modified_base (208)..(208): a, c, t, g, unknown or other
  misc_feature (208)..(208): n is a, c, g, or t
  modified_base (280)..(280): a, c, t, g, unknown or other
  misc_feature (280)..(280): n is a, c, g, or t
  modified_base (305)..(305): a, c, t, g, unknown or other
  misc_feature (305)..(305): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaaccctaanaatgggtcgcaacaaactntgcacagtaagtttcgagggcacgggtccaccatacgaccgaggaccacgtccatcacgacacacgcctacngtaggagctggagcgaggctaggancttacgtacggaccgtacgaccgggtaccgttaggtactttacggtggtacggacggtaacggacgggtacgtaaacgggttaaacgttttacgggttttaacggttttttaaggggtaacgggtttttacggggttttaacgttaaccgggggttaacgggtttaacgggttacggggttaaccgggtttcgggggtaacgggggaaaccccgggtaaacggggtaccccggtaacccgggtttcccgggtaaccccgttacccgtttaccccgtaccgtacccggtacccccttaaccccggtaaacccgggaacccggggtaaccccgttaaccgggtttccccccgggttttaccccccgtttacccccgggtaccccgggttaccccccttaccccccggttaaccccgtaacccggtaaaccggtacccggttaccccggttaaccccgggttcccggggtaacccgggggacccttaaacccggggtccccgggaccccgggggtcccccgggtttaccgggcccgttaccgggttacccgggtacccgggttaacccggtaaaccgggtaccccgttttaacccggttacccggtacccggtttaccgtcccgggtttaccgttaccgggttacccgggaccggggtccggtaccgggtaaccggg

SEQ ID NO: 129492 - DNA, 771 bp, Homo sapiens
  misc_feature: GYAE6OF02JNRPL.45.78.H01.1.454.CMB.1.raw
  modified_base (519)..(519): a, c, t, g, unknown or other
  misc_feature (519)..(519): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgaccaaatgtgacatccgagatacgacccagttccttacccttccaccctgtctcgctatcgtaggtaggagacgagacgtccaccactccgtacgttccggcccggcctagtacgagtagttaacgttaggttaacgttcggttacggtcgttaggtactacgacgaccgtaaacggaaaccggaacgggaaacccgtacccgtaactccgtcctacggtaccttacgtaacgtaacggcttaacgttacgttaaggtttaacggtaacgggtccgggttaacctagtacgtaacggttcgaggccggtacgtaacggtcgtacgtcggtaacggacgtaacgttacttaccacgtacgtaccaccgtacacgggtacnccgtacgtaccgtacgaccgttacgccgttagaccgtttagtttacgttaccgttaactttaccgttagtaccctaagtaccctaaggttacgttacggtaagtttacgttaacgtttccggtaccgttaccggtaccggtaacggacgggtttaaaacgagggttacaaaccggttaccggaaacgtacgggttcggtaccggtacttacggacctaacgtccttacggtttacttccgttaaccttcccg

SEQ ID NO: 129493 - DNA, 791 bp, Homo sapiens
  misc_feature: GYAE6OF02FNCR2.45.78.H01.1.454.CMB.1.raw
  modified_base (138)..(138): a, c, t, g, unknown or other
  misc_feature (138)..(138): n is a, c, g, or t
  modified_base (206)..(206): a, c, t, g, unknown or other
  misc_feature (206)..(206): n is a, c, g, or t
  modified_base (274)..(274): a, c, t, g, unknown or other
  misc_feature (274)..(274): n is a, c, g, or t
  modified_base (293)..(293): a, c, t, g, unknown or other
  misc_feature (293)..(293): n is a, c, g, or t
tcagacgcgatcgacacgaccggtgctcgatttagtgtgagtagtttgggtttggggtgaagaagcctggggcctcagtgaaggtctcctgcaaggcttctggactacaccttcaccggctactatatacactgggtncgacaggcccctggacaagggcttgagtcggatgggatggatcaaccctaacaatggtgcacaaactntgcacagaagttcgaggcagggtcacatcgaccagggacacgtccatcagcacagcctacagtcggangtcgagcgaggcgtgacgntcgcgacgcgaccggcctagttacttacgtcgtgacgtagacggacgaaggtaacttacggttaagttttgggagtttacgggttagttacgggacggtttagtacgggacggttcgttacgggggaccgtaagggtaacccgacgggttacccgtaccggttacctcccgttaccgtaaccggtccgtccccgaaacccggtaaccgggtaccctaaccgggtttcccggttacccgttccccggttacccgggtcccgtacccccgttaacccgtaacccgtaaacgggtaccgttacccgaccggttacccgggtacgggggcctaaccggacccgggtcccgggtacccggtcggggtaccttcccggggtacccgttcgggtaacccggtaacgggttaacccgtttcccgttacccggttacccggttacgttccccggttacgggtttacccggttaccgggaaccgggttccgggtcccggttaaccggg

SEQ ID NO: 129494 - DNA, 880 bp, Homo sapiens
  misc_feature: GYAE6OF02F9F8F.45.78.H01.1.454.CMB.1.raw
tcagacgcgatcgacacgaccggtgctcgatttagtgtgagtagtttgggtttgggggagtcagacccagtcaggacacagcatggacatgagggtccccgctcagctcctggggctcctgctgctctggcctcccaggtgaccaaatgtgacatccagatgacccagtcctccttccacctgtctgcatctggtaggacgacagacgtccacctatctacgttcggcccggacctacggtacaggtaacgttaagttaacgtaaccgttgggttcggaccgttaggtaactcgacgaccaaacggaaaaccggtaacggggaaaaccgtacccccgtaagccgtaccgtgtaccttacgtaagtaacggccttaacgtacgttaagttaaggaaacgggttccggggttaccctaagtacgtaacggttcgacggccggaacgtaggtcggacgttcgggtaagggaaaccgtaaaggttaacttccgacccgttacctaccgtaacctagtacgtaacgcctaacggtcccgtaacgaccgtaacggaccttagggtaacgttagtttaacggtttttacgaacccgttttaaaccttttaacgttaaccggtaccgttaaacccgtaaaacgttaccgtttaaggttaacgggttaaacgttttaaaccgggtttttaacgggttaaccccgggtttaaccggggttaaccccgggtaaaaccggttaaaaccgggggtaaaccccgggttaaagggtaacggtaaaacccttaaccgggaaaaacggtttaaccggttacggtaacgggtacccttaccggaacccgtaccgtttaaccgttccgtttaccgtttaccccggttattaacccccgg

SEQ ID NO: 129495 - DNA, 797 bp, Homo sapiens
  misc_feature: GYAE6OF02IDDL4.45.78.H01.1.454.CMB.1.raw
  modified_base (188)..(188): a, c, t, g, unknown or other
  misc_feature (188)..(188): n is a, c, g, or t
  modified_base (307)..(307): a, c, t, g, unknown or other
  misc_feature (307)..(307): n is a, c, g, or t
  modified_base (347)..(347): a, c, t, g, unknown or other
  misc_feature (347)..(347): n is a, c, g, or t
tcagacgcgatcgacacgaccggtgctcgatttagtgtgagtagtttgggtttgggtgaagaagcctggggcctcagtgaaggtctcctgcaaggcttctggatacaccttcaccggctactatatacactgggtgcgacaggcccctggacaagggcttgagtggatgggatggactcaaccctaanaattggtggacaacaaactatgcaacaagtaagtttcagggcagggtcaccatcgaccgagggaccacgtacatcgagcaacgacgcctacaagtggagcgtgacgcgaggctgaagtntcctaggaacgaccgacggtccgttattaacgtttaccgnggtcgacggaggtacggacgtaaggttaacgttacgttaagtttttgggagtttacgggttattacgggaaggtttgtacgggtaaccgtcgtacggggacccgaagggacccgtacggtaccgaccgttccgtaccctcgaccgtacccgtaccgtaaccggaaccgggtaccctacgttcccggttaccccgtttcccccgtacgggccccttacccccttacccgtaacccgaaacgggtacctaccccggtaaccgttaccgggtccgggggaccctaaccggtaacccgggttcccggccccgggtagggtacccgttacgggttacccccggttaacgggttaaccgtaaaccgggttaaccccgtttaccgttttacccgacggttaacccgttcggtacccgttacggttacgggaccggtacccgggtacgttacccgggg

SEQ ID NO: 129496 - DNA, 730 bp, Homo sapiens
  misc_feature: GYAE6OF02F3FAK.45.78.H01.1.454.CMB.1.raw
  modified_base (206)..(206): a, c, t, g, unknown or other
  misc_feature (206)..(206): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatccaaaccctaacaatggtgcacaaactntgcacaagaagtttcgagggcacgggtcaccatcgaccgagggacacgtccatcagaccacagcctacagtggagctgagcgaggctgagatcgtagaccggacgaccggtccgtagtactttacgtgtcggtacgagacgggacgtaaggtaacttacggttagtttttgggaaggtttggtttacgttacgggtaggttacgtgggtacgtcggtacgggggaccgaaaggggtcccgtaacggtccgaacccgtttcctccgacgtaccgtcccttaccgaacccgaccgggtccctaaccggtccggttcccgttcccccgtcggtacccctacccccgttcctaccgaaccgtaccgggcccttaaccgtccgggtaccgggggacctacccgggtacggtccccggtcccggtacgggtccgtccggtaccgtcgggtacgttaaccggtaccttacccggtcccgttacggtaccgtccggtaccggttccgtaggaccgggtccgggtcgtccggg

SEQ ID NO: 129497 - DNA, 678 bp, Homo sapiens
  misc_feature: GYAE6OF02IJ7WU.45.78.H01.1.454.CMB.1.raw
  modified_base (135)..(135): a, c, t, g, unknown or other
  misc_feature (135)..(135): n is a, c, g, or t
  modified_base (276)..(276): a, c, t, g, unknown or other
  misc_feature (276)..(276): n is a, c, g, or t
  modified_base (346)..(346): a, c, t, g, unknown or other
  misc_feature (346)..(346): n is a, c, g, or t
tcagacgcgatcgacacgaccggtgctcgatttagtgtgagtagtttggtttggggtggagagcctgggcctcagtgaaggtctcctgcaaggcttctggatacaccttcaccggctactatatacacgtgggtncggactagggacctacgtggacgaagggctttggagtgggatggggataggactaccaaccctaacaatggtcggcacgaaactatgacacagaagttcagggcagggtcaccataggaccagggacacgtcatcagcacngcctacagtcggaagctagagtcgaggctagagatcgtggacgacgacggtccgtgtacttctggtacgnggtaggacgaggagtaagttacgtagttttaggagttggttagttacggtacgtaggttacggtacgttcgggtacggggaccgtaacggggaccgtacggtaccgtaccggtcctaccgtcgacgtccctaccgacccggaacggcccgtaacggttccgtacccgtttcccccgtcgtccctaccccgtccgtaccgagtaccgcctacccggtcggtaccgggtcaccgacggcccggtccggtcgacgtcggtaccgttcggaacgtaacgtccgttaccgttccgttaccgacggttcctaccggtcgacggtaccggccggtacgg

SEQ ID NO: 129498 - DNA, 690 bp, Homo sapiens
  misc_feature: GYAE6OF02FJFM6.45.78.H01.1.454.CMB.1.raw
tcagacgcgatcgacacgaccggtgctcgatttagtgtgagtagtttggggtttggggggagcatcacccagcaaccacatctgtcctctagagaatcccctgagagctccgttcctcaccatggactggacctggaggatcctcttcttggtggcagcagccacaggagcccactcccaggtcgcagctggtgcagtcgtggggctggaggtgaagagccgtggggcctcagtgaaggtctcctgcaaggcttcgtggactacaccttcgaccggtctactatatacacgtgggtgcgacgacggccctggacagggtcttggagtggagtgggatacggactaccgaaaccctaagtaagtggggtacggactaaaccgaaatacgtacgacaacgtaaggtaacggtttcggacgggtacgtacggggtaccaaccgtacgtcggaaacccggagggaaccctaccggtaccctaacgtaccgaacggtaccaacggtaccgaacccttaacacggttacggacgtccgtaaggaggaccgaacgggtccgtaaggtaacggtacttacgggtaacggaccggaacgtacccggggtacgttaggttaacgtttcgacgggttacggaccggtaagggaccggacggtaacgggttaactttacgggtttaggtttacggttaaggg

SEQ ID NO: 129499 - DNA, 660 bp, Homo sapiens
  misc_feature: GYAE6OF02HRNWW.45.78.H01.1.454.CMB.1.raw
  modified_base (531)..(531): a, c, t, g, unknown or other
  misc_feature (531)..(531): n is a, c, g, or t
  modified_base (601)..(601): a, c, t, g, unknown or other
  misc_feature (601)..(601): n is a, c, g, or t
tcagacgcgatcgacacgaccggtgctcgatttagtgtgagtagtttgggtttggggacccagcaaccacatctgtcctctagagaatcccctgagagctccgttcctcaccatggactggacctggaggatcctcttcttggtggcagcagccacaggagcccactcccaggtgcagctggtgcagtctggggctggaggtgaagaagccgtgggcctcgagtgaaggtctcctgacaaggtcttcgtggatacctaccttcaccggctactatatacacgtgggtgacgtacgacggccccctgggaaccgaaggggtctttggagttgggaagtggggattcgggataccgaaaaccctaacgtaagtcggtaggactaaccaaacgtagtacgacaacgtaggtaaacgtttcgaaggggtcgaacgggttaccaaccgtaaggtacgaaccgtaacgggaacctaccggtacctaagtacgaacgacaccgaacgtaccgtaacacgtaggacgtccgtaagacgngaacggtccaggtacgagtctacggacgaaccggccggtacgttgtaagttcgtgtaggcggagtacggnggaacggttaacgttagttaggtttacgggtaggtttacggtttacgtcgggtaacggg

SEQ ID NO: 129500 - DNA, 649 bp, Homo sapiens
  misc_feature: GYAE6OF02GRVPR.45.78.H01.1.454.CMB.1.raw
  modified_base (459)..(459): a, c, t, g, unknown or other
  misc_feature (459)..(459): n is a, c, g, or t
tcagacgcgatcgacacgaccggtgctcgatttagtgtgagtagtttgggtttggggctgaggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagtaagtttcagggcagggtcaccatgaccagggacacgtccatcagcacagcctacagtggagctaggacgcgtaggtcgtagacggatcgagaccgacgtacggtcgtagttagttacgtgtggacggtaggacggacgtaaggtaattaacggtagttttaggaggtttggttagtacgggtacggtagtacggtacgtcggtacgggacgtacgggaccgtacggtactaccgtctccncgtaccgccctaccaacccgacggtaccacgtccgttcccttcccgcgtacccaccctcctaccgaacgtcgccgtaccggtcggtacgggaccacgccggcccggccgtcggggcctacgggtccgttcggtacgtaacggttaccttaccggttccgtcgtaccgtccggtcgttacgtggtaccggg

SEQ ID NO: 129501 - DNA, 727 bp, Homo sapiens
  misc_feature: GYAE6OF02F482B.45.78.H01.1.454.CMB.1.raw
  modified_base (159)..(159): a, c, t, g, unknown or other
  misc_feature (159)..(159): n is a, c, g, or t
  modified_base (190)..(190): a, c, t, g, unknown or other
  misc_feature (190)..(190): n is a, c, g, or t
  modified_base (248)..(248): a, c, t, g, unknown or other
  misc_feature (248)..(248): n is a, c, g, or t
  modified_base (516)..(516): a, c, t, g, unknown or other
  misc_feature (516)..(516): n is a, c, g, or t
tcagacgcgatcgacacgaccggtgctcgatttagtgtgagtagtttgggtttggggacccagcaaccacatctgtcctctagagaatcccctgagagctccgttcctcaccatggactggacctggagatcctcttcttggtggcagcagccacaggncccactcccaggtgcacgctggtgcagtcgngggtctgagtgaagacgcgtgggctcaggtcgtaagtctccgtgacgaaggtcttcgnggtactacctaccttccgacccggtacttactaagttaacttaacgaaccgtggggtccgacgacgaccgggtacccgtaggaccggaagggttccgttaggaggttagaagtcgggaatcggtaaggtaccctaaaccctaacgtaaggtgggtacggactaaacggtaaactaggtacgctaacggaattacgtttaaggaccgggtaccgagggtaacccacgtaccgtagaccggacggtacgaccgtctagacaacgcgaacncgtacctaccgataggacgtacgtacgaggtccgacggtacaaggagttacgtactaacggaccgaaccggtaccgggttaccgtaacggttacttacgggtacgaccgggtaacggaccgggtaacgaaaccggtaaggtttaacggttaccggttttaaggttaccggggtaaggttttcgggtttaccgggtacgggttaaacccggg

SEQ ID NO: 129502 - DNA, 580 bp, Homo sapiens
  misc_feature: GYAE6OF02GRFL5.45.78.H01.1.454.CMB.1.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaggaagcctggggcctcagtgaaggtctcctgcaaggcttctggctacaccttcaccggcgactatctccactgggtgcgacaggcccctggacgaagggcttgagtggatgggatggatcaaaccctaacaatggtggcacaaactatcgacaacgagtaagtttcagggcgaggggtacacacgtagaccgaggggaccgtacgtaccaagttccgaagccaacacggaccctaacgatcgggagtcgtaggacgacgagtactacgactatcgagaaccgacgaccggcctaagtttacttacgtcgtcgacggtaggtagtttcggtttaacccgggtgggtcgtttacggttttccgttttacggg

SEQ ID NO: 129503 - DNA, 782 bp, Homo sapiens
  misc_feature: GYAE6OF02FTEBF.45.78.H01.1.454.CMB.1.raw
  modified_base (137)..(137): a, c, t, g, unknown or other
  misc_feature (137)..(137): n is a, c, g, or t
  modified_base (209)..(209): a, c, t, g, unknown or other
  misc_feature (209)..(209): n is a, c, g, or t
  modified_base (262)..(262): a, c, t, g, unknown or other
  misc_feature (262)..(262): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtncgacaggcccctggacaagggcttgagtggatgggatggatcaaccctaacaatggtggcacaaactatgcncagtaacttcgagggcacgggtcacatcgaccgaggacacgtcatccagccancgtcacagtcggacgctagagcgaggtctgaatgtactagacgacgacggtcctagtacttacgtgtacggcggtaagacggtacgaaggtaacgtttacggtagttttaggggacgtttcggttagttacgggacgggttatcgggaaccgttcggtacgggggacctaaacgggggtaccctaccggtaccgtacccggttcgtacccgtcgtaccggtacccgtaaccccgtacccggtaaaccggggccccgtaacggtacccggtttacccggttcccccgttaccgggtacccgtaccccgttaccccgtaaccgtaaccggtaccggtacctacccgggttccggtacgggggtaccgttaaccgaccggggtacccctacccgggttacgggtaccggtccgggttacccgtaccgggttaccggtaaacggtacccgttaccggtttaccccgacggttaccggtaccggtccggttaccgacggttaccggtaccgggtcggtaaccggg

SEQ ID NO: 129504 - DNA, 651 bp, Homo sapiens
  misc_feature: GYAE6OF02H1653.45.78.H01.1.454.CMB.1.raw
  modified_base (195)..(195): a, c, t, g, unknown or other
  misc_feature (195)..(195): n is a, c, g, or t
  modified_base (316)..(316): a, c, t, g, unknown or other
  misc_feature (316)..(316): n is a, c, g, or t
  modified_base (410)..(410): a, c, t, g, unknown or other
  misc_feature (410)..(410): n is a, c, g, or t
  modified_base (551)..(551): a, c, t, g, unknown or other
  misc_feature (551)..(551): n is a, c, g, or t
tcagacgcgatcgacacgaccggtgctcgatttagtgtgagtagtttgggtttgggggagcatcacccagcaaccacatctgtcctctagagaatcccctgagagctccgttcctcacctttatggactggacctggaggatcctctttcttggtggcagcagccacaggagcccactcccaggtgcagctggtncagtctggggctgaggttgaagagccgtggggcctcagtgaacgggtctccgtgtacgaaggtcttcgtaggacttaccgtacccgttcgaccggtctaacttataactactacgtgggtncgacgcggaccctggaacgaaggtcttgagtggtaagtgggataggactaccaaaaccgttacgacgttcggtacggtactaaacaaacgttanacgcaaagtagtaaagtttacggacgggcgtaacgggtacctaccgattccggaacgaacggtaacgtcgtaacccagtaccaggacctacgtagacccttagacttacggacgtcgaggtacgacgcgaacgtgtaaccngtttaaccggagaccgacctacggtccggttattaactttcgcggtaccggtagaggtacgaccgtaaaggttacgtttaacgttcggttttaggaacgg

SEQ ID NO: 129505 - DNA, 930 bp, Homo sapiens
  misc_feature: GYAE6OF02F4EI1.45.78.H01.1.454.CMB.1.raw
  modified_base (214)..(214): a, c, t, g, unknown or other
  misc_feature (214)..(214): n is a, c, g, or t
  modified_base (797)..(797): a, c, t, g, unknown or other
  misc_feature (797)..(797): n is a, c, g, or t
tcagacgcgatcgacacgaccggtgctcgatttagtgtgagtagtttgggtttggggtgaagaagcctgggcctcagtgaaggtctcctgcaaggcttctggatacaccttcaccggctactatatacactgggtgcgacacggcccctggacaagggcttgagtggatgggatggataccaaaccctaacaagtggtaggacaacgtaaactntagccaacgagtaagtttcgagggcgagggtaccaccgagtagaccgtagggacaccggtaccatacgagtaccacgacgaccttaacagttcgggacgcttaggacgccggaaggtcctaggacgtactacgtacggaaccgtaccggtaccggtaccgttagtaatttaccgtggtacggtacggaacgggtaggaaccgttaaagggttactttaacggttgtttttaggggaagtttggtttaaccggtacgggtagggtttatacggggtccgtttagggtaccggggtaaccggaaacggggtcccgtaaccgggtacccgtacccggtttaccctaccccgttaacggtaacccggtacccccgtttaaaccccggaaaccggtaaaccccggggtccccctttaacgggttacccccgggtttttacccccggtccccccggttaccgggtaccccgttaccccccggttaaccttaaacccgggaccgttaacccgtaacccccggtaccgggttaacccggggttacccgggaaaccgtacccggtaccggggttacccgggttacccccggngggtttacccgaccggttacccgggttaccggtacggtaaacccggtacccgtttaaccccgttcccggtcttaacccggttccggtaccgtttccggaaccggggtaccggtaccggtaggttaaccccggg

SEQ ID NO: 129506 - DNA, 656 bp, Homo sapiens
  misc_feature: GYAE6OF02JI84F.45.78.H01.1.454.CMB.1.raw
  modified_base (136)..(136): a, c, t, g, unknown or other
  misc_feature (136)..(136): n is a, c, g, or t
  modified_base (186)..(186): a, c, t, g, unknown or other
  misc_feature (186)..(186): n is a, c, g, or t
  modified_base (231)..(231): a, c, t, g, unknown or other
  misc_feature (231)..(231): n is a, c, g, or t
  modified_base (258)..(258): a, c, t, g, unknown or other
  misc_feature (258)..(258): n is a, c, g, or t
  modified_base (268)..(268): a, c, t, g, unknown or other
  misc_feature (268)..(268): n is a, c, g, or t
  modified_base (271)..(271): a, c, t, g, unknown or other
  misc_feature (271)..(271): n is a, c, g, or t
  modified_base (280)..(280): a, c, t, g, unknown or other
  misc_feature (280)..(280): n is a, c, g, or t
  modified_base (294)..(294): a, c, t, g, unknown or other
  misc_feature (294)..(294): n is a, c, g, or t
  modified_base (381)..(381): a, c, t, g, unknown or other
  misc_feature (381)..(381): n is a, c, g, or t
tcagacgcgatcgacacgaccggtgctcgattagtgtgagtagtttgggtttggggtgaagaagcctggggcctcagtgaaggtctcctgcaaggcttctggatacaccttcaccggctactatatacactgggtncgacaggcccctggacaagggcttgagtggatgggatggatcaaccctanaatggtgcacaaactatgcacagaagtttcagggcagggtcaccngtgaccgagggtacacggtccatcgancacagcctanagnggagcgtgngacgaggctgacgntacgtgacgacacggccgtgtatctgtgcgagacggacgaagtaacttacgtagttttcggagttggttaacgttcggtacggttancgggtacgtcgtacggggccaagggacccgtacggtaccaccggtcttacccgacgacgccgttaccaccgtaaccggtcctacgtccggtccttccccgtggtccctacccgtcccgtaccgaaacgtaccggccgtaccgtcggtacggggtaccacccggcgcccggacccgttgggcccttacgggcccggttacggtaccgaaccgggttaccttaccggttcccgacgtacgtccgtccgtacgcggtaccggtcccgggtactacggg

SEQ ID NO: 129507 - DNA, 732 bp, Homo sapiens
  misc_feature: GYAE6OF02HZYZH.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacacccttcaccggctactatatacactgggtgcgacaggccctggacaagggcttgagtggatgggatggatcaaccctaacaatggtggcaacaaactagtcgacaacaagtaagttacagggcgaacgggtacaaccactgaaccgaaggggaacacccgtaccaacgttacaagccaacagtacctaccgagtgagctagagaccagggctaggaacgtatcgtgaacgaccgtacggcgttagtattactgtgacgagtacgacgtaagaacgtttacgtagttttacggagttagttagtcggtaacggttaggtacggtacgtcgttacggggaccggtaaaggtacccgtaaccggtcgtaacccggtcccttcccgtaacgactcccgtacccgaaaccgtaccgggacccgtacgtcccggttccttccccgtaccgaccgcccgttaccgtaccgaaacgtacggcccttaacccgtcgggtccgggaccgaacgtccggacccggtccggcgggttccttcgggacccttccgggaacgtaacgggtaacccgttcctttaacccgaccggtacgtacccgtcccggtattaccgggacggccggttacgacggg

SEQ ID NO: 129508 - DNA, 708 bp, Homo sapiens
  misc_feature: GYAE6OF02GV6Q3.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaaccctaacaatggtggcacaaactatgcacagaagtttcgagggcagggtcaccatgaccagggacacgtccatacagcacagtcctaacagtggacgctaggagcgaggcgtaggagactcgtggaccgacgaccggtccgttagtacttactggtgacggagacggcgaaggtaattacggtattttgggagtttaggtttagttacgggtaggttagtcgggacgttcggtacggggacgacgggtaccgtacggtccgtccgtctccgtcgcgccgtacccgaccggaaccgggccctacggttcccggtcccgttaccccgtcggaccccgtaccctcccgacctaacgtacgacctacccgtcgggtacggggccacggaccggtcccggcccggtagggtccctacggtcccgttacgggtaccgtaaacgggttacccgttacccggtttacccgtaaccgttcggttaccgttaaccggtccggttaccggggtacggtcccggggtaccggtacggg

SEQ ID NO: 129509 - DNA, 720 bp, Homo sapiens
  misc_feature: GYAE6OF02G7K1E.45.78.H01.1.454.CMB.1.raw
tcagacgcgatcgacacgaccggtgctcgatttagtgtgagtagtttgggtttgggggagagcatcacccagcaaccacatctgtcctctagagaatcccctgagagctccgttcctcaccatggactggacctggaggatcctcttcttggtggcagcagccacaggacgcccactcccaggtgcagctgggtgcagtcgtggggctggaggtaggaagaacgccgtggggcctcgagtggaaggtctcctgacgaggcttctggataccaccttaccgaccggtactactatataccgtacgtgggtcgccggacgacggcccccgtaggaaccgaggggtcttaggacggtggaggtgggacgtggaactaccaaaccctaagaagtggacgacgaactaaacgtagtacgacgaactaaggttaacgttacggaggggaccgtacgggtacccaacgtacggacgaacccgtaacgggaacctacgtccgacgtacgacgtaccgacgtaacccgtacaacggtcgtaacgggtacgtacggtaacggacgtacggaccggtaccgtaggtaccgtaacggtcctacggggtaacccgaccggtaccggtcggggttaaactttaccggtttaacggacccgggttaggtaacccggtacgggttaaccggtagggttaaacggttaccggttttacgttagggttttaaccgggg

SEQ ID NO: 129510 - DNA, 946 bp, Homo sapiens
  misc_feature: GYAE6OF02GYHL0.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacacgtgggtgcgacaggcccctggacaagggcttaggagtggacgtgggataggactaccaaaccctaacgaagtgggtagacaacaaaactgtcgacaacaggtaacgttcgacgggcgacgggtaccaaccagtccgaaccggacgggtacaccgtacctaagtcaacggacaacgtaccgacctaacagtacggcgctggacgcgaggactgacgtacgttacgacggaaccgaccggtaccggttcgttaacgttactttacggtcgacggtacggaaggacggtacggaaagttaaacgtttaccggtttaaggtttttaggggaagttttagggttacggttacgggtaacggttacggtaacggtccgggttaacgggtacccggggaacggtaaccggggtaccctaaggttcccggtaacccgtttccggtacccgtaccgtacccggtacccacccggtaacccgggacccggtcccggtaaccggtttcccgtttccccggttaccccgggtccccgtaccccggttacccccgttaccccgttaaccggtaaccgtacccggtacccgttacccgggtccggggtaccgggtaccccgggtaaccggtaccccgggtacccgggttcccgggttaaacccgggtcccggtttacccgggtacccgggtaccgggtttaacccggaaacccggttacccggtttttaaccccggtcccggtttacccggttaccgggttccccgggtaacccggtttaccggtaccgggggttaacccggttcccggggtacccggtaacccggggg

SEQ ID NO: 129511 - DNA, 723 bp, Homo sapiens
  misc_feature: GYAE6OF02HR0BS.45.78.H01.1.454.CMB.1.raw
tcagacgcgatcgacacgaccggtgctcgatttagtgtgagtagtttgggtttggggggagcatcacccagcaaccacatctgtcctctagagaatcccctgagagctccgttcctcaccatggactggacctgggaggatcctctttcttggtggcagcagccacaggacgcccacctcccaggtgcagctggtgcagtcgtggggctggagggtgaagaagccgtgggcctcgagtgaacggtctcctgcaaggcttcgtggtatacctaccttcaccggctactatatacacgtgggtcgacggacacggccccgtgggaacggaacgggtcttagggacggttagggaggtaggggtaagtggggtaactaacccgtaaacccgtaaacgtaaggttagggtaggaccaaacgtaaacgttacacgaccaacgtaaggtaaacgtttacggaacgggtacgtacgggtacaccgtagacgacggaacgggaccgaacgtccaagtacaagacccaacgtacgacccgtaagacgtacggacgacgtacggtaacggcggaccggtacgtagggacgacgtacgtaggaacccgaacgggtaccgggtaccggttacgggtttaacgttaccggttaggtacgggacggtaaacgggacggttaagggtaaaccgggtttaacggtttttacggttacgggttttaagggtttaacgggg

SEQ ID NO: 129512 - DNA, 656 bp, Homo sapiens
  misc_feature: GYAE6OF02GW9QG.45.78.H01.1.454.CMB.1.raw
  modified_base (137)..(137): a, c, t, g, unknown or other
  misc_feature (137)..(137): n is a, c, g, or t
  modified_base (208)..(208): a, c, t, g, unknown or other
  misc_feature (208)..(208): n is a, c, g, or t
  modified_base (342)..(342): a, c, t, g, unknown or other
  misc_feature (342)..(342): n is a, c, g, or t
  modified_base (358)..(358): a, c, t, g, unknown or other
  misc_feature (358)..(358): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtncgacacggcccctggacaagggcttgagtggatgggatggatccaaccctaacaatggtgacaacaaactntcgacacagtaagttcgagggcagggtccacagagaccgagggacacgtccatcagcacacacctacagtggagctagacgcgacggctagagtactacgtggaccgaccgaccgggccgttagttaacttcgnggtcgacgaggagganaacggtattacgttgttttagacgttaggttacgttacggacgttagtcggtacgtcgtagggaccgacggaccgtacggtaccgtaccgtactccgtacgccgtccgtacccgaccggacggaccctcgtaccggttccttccccgtacgaccctacccgtacctaccgacgtacgacccgtaccggtccggtacgggccacgcgtcccggtccgtcgggcctccggacgtaggtaccgtacggtaccttccttaccgcgtaccgtcgtaccgtcgtacggcggtccggcgtacggg

SEQ ID NO: 129513 - DNA, 736 bp, Homo sapiens
  misc_feature: GYAE6OF02H0UNH.45.78.H01.1.454.CMB.1.raw
  modified_base (136)..(136): a, c, t, g, unknown or other
  misc_feature (136)..(136): n is a, c, g, or t
  modified_base (272)..(272): a, c, t, g, unknown or other
  misc_feature (272)..(272): n is a, c, g, or t
  modified_base (281)..(281): a, c, t, g, unknown or other
  misc_feature (281)..(281): n is a, c, g, or t
tcagacgcgatcgacacgaccggtgctcgatttagtgtgagtagtttgggtttgggtgaagaagcctggggcctcagtgaaggtctcctgcaaggcttctggatacaccttcaccggctactatatacactgggtncgacaggcccctggaccaagggcttgagtggatgggatggatcaaaccctacaagtggtaggcaacaaactatacgcacagtaagtttcgagggcagggtcacgatcgacaggacacgtcatcagcacagacctanacgtgacgntacgagcaaggctaggaagtatcgtagaccgacgacggtccgttgtacttacgtggtagcgaaggaaggctaagggtaatttacggtagtttttcggaaggtttaggttacgttacggtaacggttatacggggtacgttcggacggggtaccgaaagggtacctacgggtaccgtaccgttccgtacccgttaccgtaaccgtccccgttaccgaaaccggtaaaccgggtaccccgtaacggttcccggttaacccgtttcccccggttaccggacccttaaccccgttccctaccgaacggaccgtaccgtaacccgtccgggtaccgggggtaccaaccgacggcccgggtccgtaccgggctacggtcccgtacggtaccgtaacgggtaccttaccgttccgttaccgaccggttaccgcgttccgtaggacggtacgggtccgtacgg

SEQ ID NO: 129514 - DNA, 683 bp, Homo sapiens
  misc_feature: GYAE6OF02GURUB.45.78.H01.1.454.CMB.1.raw
  modified_base (203)..(203): a, c, t, g, unknown or other
  misc_feature (203)..(203): n is a, c, g, or t
  modified_base (323)..(323): a, c, t, g, unknown or other
  misc_feature (323)..(323): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctacaatggtgcacaaactntgcacagaagtttcgagggcagggtcaccatgaccagggacacgtcatcagcacagcctacagtggaacgctagagcgagcgtagaaggtctcgtagacgacacggcgtagtacttacgngtcgacggagacggtacaaggtaactttacggtaattttcgggaagtttcggttaattcggggaaacgttctggggtaaccttgggcggggacctaaggggggtaccctacgggtccgtaacccgtaccgtcccgttacgacgtcccgtaaccaccggtaacggcccgtaccgtccgtacccgtttcccgccgtaccgtaccctcctaccgacgacgaccgcgttaccggcgggacctacgaccggtccgccggtcggtccaaccgggttccgtaggtaccggtaacgacccgtttccgtaccccgttagtacccggtaccgtccggtaccgttaacggccgtaccggtgtaacccgggg

SEQ ID NO: 129515 - DNA, 706 bp, Homo sapiens
  misc_feature: GYAE6OF02FORBD.45.78.H01.1.454.CMB.1.raw
tcagacgcgatcgacacgaccggtgctcgatttagtgtgagtagtttgggtttggggagagcatcacccagcaaccacatctgtcctctagagaatcccctgagagctccgttcctcaccatggactggacctggaggatcctcttcgttggtgcagcagccacaggacgcccactcccaggtgcagctggtgcagtcgtggggcttggaggtagaagacgtccgtaggggtcctacaggtgtaacggtcctccgtgacgaaggtccttcgtcggtaagtacctaacccgttaccgaacccggtacctaacgttaactaattacctacggttcgggtacgccgtaaccgacggtccccgtaggaacggacggtcttacgaggtacgtaggtgggtagacggtatacctaaccgtaacgaagttcgggacgacgaaacgtaactaagtcgactaacgaacgtaagtttaccgagggaccgtagggtacacagtcgaacgtacggaacacgtaccgacgtacgtacgactacgacgactaccgtagtacggacgtacgtacggcggaccgacgggtaccgtaggtaccgtacgtaccggtaagacccggtacggtaccggtaacgggtacgttaacgttaccggtggttaccgggaagacggtcggtaaccgggtaacgttacggttaacggttacggtttttaaggg

SEQ ID NO: 129516 - DNA, 832 bp, Homo sapiens
  misc_feature: GYAE6OF02GDH35.45.78.H01.1.454.CMB.1.raw
  modified_base (310)..(310): a, c, t, g, unknown or other
  misc_feature (310)..(310): n is a, c, g, or t
tcagacgcgatcgacacgaccggtgctcgatttagtgtgagtagtttgggtttgggtgaagaagcctggggcctcagtgaaggtctcctgcaaggcttctggatacaccttcaccggctactatatacacgtggtgcgacaggccccgtggacaagggcttgagtggactggatggactccaacctaacaagtcgggtggcaactaaactagtgacacgagtaacgttcgagggacagggtactacgagtcgacgaacgggacgtacgtcactctagactacgacgactactagcgtagctgacgcgagntcggagtcgttacacgtaccggactaccggtacgtcgtaacgtttacgcgggtacgtcggaacggtacggtaacgttaaggttaacgtttaacggttttacggttttaacggggagtttttcggggttaaacggtttccggtaacggggtttacgttacgggttacccggtaaggggtttacggggttaacccgggaaacggggttaccccgtacggttacccgaccggtttaccggttacccttaccgggtaccctaacccggtacccgacccggtaaccggttaccccggtacgttacccgggtttccccgttaccccggtacccgttcccgaaccccgttccgttaaacccggtacgacccgtccgtaacccggtccgggtacccgggatacccgggtaaccgggccgtacgggtaccggccttacggtccggttaacgtccggaaaacgttccgttaccgttacccgtaacggtccgtttacggccggttacgttcggcggttacggtaccggaacgg

SEQ ID NO: 129517 - DNA, 818 bp, Homo sapiens
  misc_feature: GYAE6OF02JY6XV.45.78.H01.1.454.CMB.1.raw
  modified_base (192)..(192): a, c, t, g, unknown or other
  misc_feature (192)..(192): n is a, c, g, or t
  modified_base (713)..(713): a, c, t, g, unknown or other
  misc_feature (713)..(713): n is a, c, g, or t
tcagacgcgatcgacacgaccggtgctcgatttagtgtgagtagtttgggtttggggacccagcaaccacatctgtcctctagagaatcccctgagagctccgttcctcaccatggactggacctggaggatcctcttcttggtggcagcagccaacgaggacgcccactcccaggtcgcagcgtggtcgcngtcgtgggctggaggtagaagtaacggccggtggggtcctacgagtacggtaacggtcctccgtgacgtaacggtcctttggacggaacttaacctacccgttaccgacccggtacttaactaacttaaccgtaacggaccgtggggactccgggaacaacccgggtccccgtaagggaccggtaaacgggtccgttaggaccggttagggaagtgggggaacgttagggtaactaaccccgtaaaaaccttaggaaggttacggggtacgaacctaaaacttaaacggtagtaccgaacgtaaaggtaaacggttaacggtttacggaacggggtaaccgttaacgggctaaaccggacgttaacgacgggtacgaacgtcggtaccaacggtcaacgtaccaacgaccgtaacgcgttaagacgtcgtaacgtagaacggtcgtacgggtacgtacggtacgtaacggttaccgaaggaaccgttaccggtccgggtaaacgttccgttaaagttacgnggggtaaccgacggggtaaccagggtaaacgttacggtttaaggtttaccgttagggttttaccgggtaaggtttaagggtttacccggggtacggtttaagggg

SEQ ID NO: 129518 - DNA, 760 bp, Homo sapiens
  misc_feature: GYAE6OF02IZY2M.45.78.H01.1.454.CMB.1.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggaccaagggcttgagtggatgggatggatcaaccctaacaatggtggcacaaactatgacacagtaagtttcgagggcagggtcacctgtcgaccagggaccacgtaccatacacgacgacacgcctacgagtcggagacctgaacgcgaacgggtctagacgtatcacgacgacgaccggtcgtacgtattcgtgtcgacgacgacggacgtaaggtaacttacggttagtttacgggtaggttaggttacgttaccgggaagggttagtacgggtaaccggttcggtaacgggggtaccttaaacggggacccgtacgggtacctacccggtacccttccggaactcccgtacccgacccgtaaaccggaaacccgggtccctacggttacccgggttcccttaccccgtacggacccctaaccccgtcccgtacctaaacgcccggtacctacccgtccgggtagggacccacgtccgggtccctcccggtacgggcttacccggtcccttaacgggtaccgtaaccggtaccgtttacccgttcccggtaacgttacccgtacggtccgttacgttaccgggacggggtcccctagggtacccggg

SEQ ID NO: 129519 - DNA, 715 bp, Homo sapiens
  misc_feature: GYAE6OF02JGI5Q.45.78.H01.1.454.CMB.1.raw
  modified_base (187)..(187): a, c, t, g, unknown or other
  misc_feature (187)..(187): n is a, c, g, or t
  modified_base (213)..(213): a, c, t, g, unknown or other
  misc_feature (213)..(213): n is a, c, g, or t
  modified_base (219)..(219): a, c, t, g, unknown or other
  misc_feature (219)..(219): n is a, c, g, or t
  modified_base (257)..(257): a, c, t, g, unknown or other
  misc_feature (257)..(257): n is a, c, g, or t
  modified_base (270)..(270): a, c, t, g, unknown or other
  misc_feature (270)..(270): n is a, c, g, or t
tcagacgcgatcgacacgaccggtgctcgatttagtgtgagtagtttgggtttggggacccagcaaccacatctgtcctctagagaatcccctgagagctccgttcctcaccatggactggacctggaggatccgtcttcgttggtggcagctagccacaggagcccactcccaggtgcagctggtncagtctgggctgaggtgaagacgcgnggcctnagtgagtctctgcacgcttctgatactcctcgaccgtntactactactacncgtaggtgaccaccgacggtccccgtagggaaccgtaacggtcgtggacgggtagtaggtacgggtatcgggtactaaccgaaccgtaaagtaacggttcgggacggtaacaaccggtaaactacgtacggactaacggtaagtttaacgttaccggaggggtaccgtaagggtaccctaacgtaacgtccgggaacccgtaacggggaacccgttacgtaccgtaacgtacgaccggaacctaaccgaccgtaacctaccgttaaggcgacgtcggtaacgcgacgtaacggcgacggtacgtacgtacgtaacggaccgaacggtaacccggttcggttaaccgttaacgttccggagtaccggtcgaaggtacggtaacggttaacggtaagtttacgggttaggtttaggtacggtttaggttaccggtacgggttaacgg

SEQ ID NO: 129520 - DNA, 763 bp, Homo sapiens
  misc_feature: GYAE6OF02GWXN0.45.78.H01.1.454.CMB.1.raw
tcagacgcgatcgacacgaccggtgctcgatttagtgtgagtagtttgggtttgggggagtcagacccagtcaggacacagcagtggacatgacgggtccccgctcagctcctggggctcctgctgctctggctcccaggtcgaccaaatgtgacatccagatcgaccagtctccttccaccctgtctgctatctggtacggagacgagacgtccaccgatcctacgttcggcccgggccagtcagtagttatagtacgtggtcgcttggtatcgacgtacaacggtaaaccgaagggaacctaccccgtaagtcctccctggaccttacgtaacgtaacggcctaagttacgtttaaggttaaggtaaccgggttccgggtaccctaagttaaccggtaaaggttccgacgggtccggtacgtaggtcggtacttaccggtacgggaactaggtaacttccgaccgttacacccgaccataccgagtacccgacgtccgtacgcgtactccgtaggttacttagtttacgtttacgaacctttaacgttacgttccgaaccgtaaccctaagttcgtaacgtacggttaagtttaccgttacggttacccgttaaccgggttacgggaaaccttaacggggaacccgtttaaagggtaccgtaaacgttaaccgtaaaacgggtacgttacggtaccgggtaccttaaccgacccgttacgttacgttaaccggtacccttttaccgtacccgttaacccgg

SEQ ID NO: 129521 - DNA, 570 bp, Homo sapiens
  misc_feature: GYAE6OF02FZJDH.45.78.H01.1.454.CMB.1.raw
  modified_base (261)..(261): a, c, t, g, unknown or other
  misc_feature (261)..(261): n is a, c, g, or t
  modified_base (301)..(301): a, c, t, g, unknown or other
  misc_feature (301)..(301): n is a, c, g, or t
  modified_base (336)..(336): a, c, t, g, unknown or other
  misc_feature (336)..(336): n is a, c, g, or t
  modified_base (341)..(341): a, c, t, g, unknown or other
  misc_feature (341)..(341): n is a, c, g, or t
  modified_base (407)..(407): a, c, t, g, unknown or other
  misc_feature (407)..(407): n is a, c, g, or t
  modified_base (430)..(430): a, c, t, g, unknown or other
  misc_feature (430)..(430): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctcccttccaccctgtctgcatctgtaggagacagagtcacccatcacttgccgggcctagtcagagtattagtaactggttggcctggtattnagcagaaaccagggaaacgccctaagctctgctctatagnatctagtttgaaagtgggtccatcaggtcagcganagtgntacgtaggacaaggaacttcacctcttcaacccatctacgcagtcctgcagcctagactgtatttnactaacttattactagacctaanagtactataattacgtttattacgtaccggtttcggacccgaaagggtaaccgtaaaggtacggaaacgtaccgtaaaacgtaacgttagtacgggtctacggtacctaacctacgttacgtacgtttccgttactaccc

SEQ ID NO: 129522 - DNA, 856 bp, Homo sapiens
  misc_feature: GYAE6OF02HDLX6.45.78.H01.1.454.CMB.1.raw
  modified_base (142)..(142): a, c, t, g, unknown or other
  misc_feature (142)..(142): n is a, c, g, or t
  modified_base (673)..(673): a, c, t, g, unknown or other
  misc_feature (673)..(673): n is a, c, g, or t
  modified_base (818)..(818): a, c, t, g, unknown or other
  misc_feature (818)..(818): n is a, c, g, or t
tcagacgcgatcgacacgaccggtgctcgatttagtgtgagtagtttgggtttggggtgaagaagcctggggccttcagtgaaggtcttcctgcaaggcttctcggatacaccttcgaccggctactatatacacgtgggtncgaacaggcccctggacaagggtcttgagtggatgggatacggataccgtaaccctaagaagttcgggtacggacaacctaaaaagttcgtcgaccaaacgacggttaaagtttaccgaagggggacctagggttaccaacccgtaagtacgacccggaaaggggaaccaaccgttccgaaatccgacggacaacgttacggaccttaacaggtacggaacgtcgtacggacgtaggaccggtgttaaggaacgggttactaacggtacggaaaccggtaccggtacggttaacccgttgttaacgttaccgttagggaccggtacgaagggaaccgggtacgtaaacggttaacgtttacggttacggttttacggaaaacggtttgggtttaaaacgtccgggtaaccgggtttagaacggtttaacggtccggggtggaaaaccgttccgggagtaccggtactaccgtcgtacctacgcgtaccgactaacggacgtaccgtacgtccgtccgttaccgaccgtacncccgtacgtacacggtctaccggtaacctcgggttacgcgggtacttacccgggaccggtacctcggtaccgtaaccggtaccgtagggtaaccggtaaccgtttaccggtaccccgttaccgtaacgggttactacccgggttntacccggtacggtaccgggttagggccctaaaccgggg

SEQ ID NO: 129523 - DNA, 1015 bp, Homo sapiens
  misc_feature: GYAE6OF02I6HSR.45.78.H01.1.454.CMB.1.raw
tcagacgcgatcgacacgaccggtgctcgatttagtgtgagtagtttgggtttggggagagcatcacccagcaaccacatctgtcctctagagaatcccctgagagctccgttcctcaccatggactggacctggaggatcctcttcttggtggcagcagccacaggacgccccactcccgagggtcgcacgcgttggtgccgtaggtcgtgggggccttggagggtaggaaaggaacgcccggtagggggccctacgaggtggtaacggtcctccgtgaccgtaaggtctttcgtacggacttaaccgaccctttaccgacccggtacttaacttaacttaactaccgtaacggttggggtaccggaccgggaaccgtaccgggacccccgttaacggggaaccggtaacgggggttaccggttggggtaacgggtaggggtaacgggtacggggttaggttacgggtaaccttaaaccccgtaaacccttaaacggtaacgggttacgggtaccgggtaaacctaaaacccgtaaaacgttacgttacggaacccgtaaacgtaaacgggtttaaacggttttaccgggacgggggttaaccgggtaaccggggttacccgaaacgtaaccggttaacccgggaacccgggtaacgggtaacccgtacccgttaccgtaaccgtacccgtaaccggtaaacccgaccgtaacccgtaccccgtaacgtaacggtaaccgggacgttaaccgtaccggggaccgtaccgggccgggtttaacggtaaccggtaaacgtaccggtttaacgggaacccgggttaacccgggtaaccccggggttcccgggttaaccgggtttttcccgttttaaaccgggttaccgggtttacgggttaacccgggtaaaccgggggtaccggggttaacccggggtttaaaccggggttaaaacgggtttttaaccccggggtttttacggggttttttaaccgggggttttttaaacgggggg

SEQ ID NO: 129524 - DNA, 731 bp, Homo sapiens
  misc_feature: GYAE6OF02IGZEV.45.78.H01.1.454.CMB.1.raw
  modified_base (262)..(262): a, c, t, g, unknown or other
  misc_feature (262)..(262): n is a, c, g, or t
  modified_base (723)..(723): a, c, t, g, unknown or other
  misc_feature (723)..(723): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggccccctggacaaggcttgagtggatgggatggatccaaccctaaacaagtggtggcaacaaactatgaccacaagaagtttcgagggcaggtcacatcgaccgaggactactccactnacgacacagacctacagtggacgtcgtagaggcgtacggcgtaggagtacttaccgtacgaaccggtaaccgtacggggtacccggttcggtttaacttaccgttggtcggacggtaaggaccggagtaagggtaaatttacggtttaacgtttttaggggttagtttagggtttacggtttaaccggggtaacggttaggttacgggtacgttacgggtacgggggaccgaaaccggggtaccgtaaccgggtaccgtaccgtccctccgtcgaccgtccgtaccgaccgacggcccgtagttcccgttcccttccccgtcgtccctaccctccctaccgaacggacaccgtaccgtcggtacgggacgtcgtaccgccggtaccgtcgccgtccgtccgtcggtacggtaacgttaccctcgttacctcgtacgttcgaccgttcgacggccggtcggnggtaccgg

SEQ ID NO: 129525 - DNA, 709 bp, Homo sapiens
  misc_feature: GYAE6OF02HDWB4.45.78.H01.1.454.CMB.1.raw
  modified_base (261)..(261): a, c, t, g, unknown or other
  misc_feature (261)..(261): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaacctaacaatggtggcacaaactatgcacagaagtttcagggcagggtccaccatcgaccagggacacgtccatcagcacngacctacagtggagctgacgcaggctgagtagtctgacgaccgaccggtccgtgtagttactggtgcgtaaggcggtacgaaggtaattacggtacgttttgggaggttaggttagttccgggtaaggtagtacgggtacggttacggtcggggacgtaaacggggacgtaccggaccgtaacccgttcgtacccgtacgtaaccgtcccgtaacccaccggaaccgggtaccctacgttcccggttcccgttaccccgttcgggtacccctacccgtacccgttaacccaaggtacccggacccgtacccggttaccggtcgggggtaaccaacggtccggccggtacccggtggggtccctcggtccgtacggtacggaaccggttaccgttaccgttccgtacgtaggttccgtccggtcgttcgggacggtccgggcgtacggg

SEQ ID NO: 129526 - DNA, 673 bp, Homo sapiens
  misc_feature: GYAE6OF02IKQFZ.45.78.H01.1.454.CMB.1.raw
  modified_base (137)..(137): a, c, t, g, unknown or other
  misc_feature (137)..(137): n is a, c, g, or t
  modified_base (188)..(188): a, c, t, g, unknown or other
  misc_feature (188)..(188): n is a, c, g, or t
  modified_base (199)..(199): a, c, t, g, unknown or other
  misc_feature (199)..(199): n is a, c, g, or t
  modified_base (205)..(205): a, c, t, g, unknown or other
  misc_feature (205)..(205): n is a, c, g, or t
  modified_base (257)..(257): a, c, t, g, unknown or other
  misc_feature (257)..(257): n is a, c, g, or t
  modified_base (276)..(276): a, c, t, g, unknown or other
  misc_feature (276)..(276): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtncgacaggcccctggacaagggcttgagtggatgggatggatcaaccctaanaatggtggcanaactangcacagaagtttcgagggcagggtccaccagtgaccgagggacacgtcactnagcacagcctacagtgganctagacggacgtacgtcgtacggatacgtctacggaccggtacgtaccgaccggttgtaacttacgttcgtcgacgaggtacggacgaggtattacgttaaggttttggacggtttaggttacgtcggaagttacgagggtacgtacgggttacggacggtacgggaaccgtccggacgtaccgtctacccgtaccacgtcctacgaccgaaccggtacccacgttccggtacccttcccgtacccgtaccgtacccaccctacgaaaccgtcgtacccgaccgtcgggtacgggccgtaacgtaccgaccggtacgcggacgtccggtcgtacggtacgaacggtactacccgtcgtacgtacgtaccgtcctagtcggtacggccggtagtacgg

SEQ ID NO: 129527 - DNA, 746 bp, Homo sapiens
  misc_feature: GYAE6OF02GKT25.45.78.H01.1.454.CMB.1.raw
  modified_base (521)..(521): a, c, t, g, unknown or other
  misc_feature (521)..(521): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggacgccccactccccagggtgcagctagtgcagtcgtggggctggagggtagaaaggaacgccgtcggggcctcgaggtagacggttcctccgtgacgaacggtccttcgaggtactaccgtaccttccgaccggtcttaactatactaactacggtgggtcgacgaccggaccggtccccgtaggaccgtaagggtctggacggtggagtgggtagtcggaactacctaacccgtaagtaggtacggacggaccaacgtaacgtatacggactaacgtagtaacgtttcggacgggcgtacgggtaccacgtagtacgaccggacggacctacgtaccagtccacgaccgtaacncccggaacctagacgtcggaccgtagacggagccggaggtcgtacggtaagtaccgtacggtaaccgaacgggtacccgtaccgggttaccgtttaacggtttaccggtttaaccggttaggggtaacccgggttaccggggaacgttaaccggggtaacggtttaaaccggggttaaaccggtttttaagggtttaacggggttttaccgggtttaaacggggg

SEQ ID NO: 129528 - DNA, 909 bp, Homo sapiens
  misc_feature: GYAE6OF02HEJ2F.45.78.H01.1.454.CMB.1.raw
tcagacgcgatcgacacgaccggtgctcgatttagtgtgagtagtttgggtttgggggagcatcacccagcaaccacatctgtcctctagagaatcccctgagagctccgttctcaccatggactggacctgggaggactccgttcttcgttggtggctagcagccacgaggacgcccactcccgaggtcgcacgcgtgggtcgccgaggtcggtcggggcgtaggaggtaggtaaaggaacggtccggttcgggggtacccctaggtaagggttacggtaaaccggttccgttacccgtgggaaccgtaacgggtttcctttacggtacgggtaactacccggttaacccgttaccggtaaccggttaccttaaaccttacgttaacgttaccgtaaccgggttggggttaccgaccggaacgtaccccggtcccccggttaaggaaaccggtaaccggtttcggttacggaacgggttcggttagggttcgggttacggtaggtaaccgttacccgtaaaacccgtaacgtagggttacggggtagtaaccggtaaaagttaaccgtaacggttaccggaacgtaacggttaaacggttaaccggttacggtaaccggggtacggtaccggggtacctaaccgggttaactaccggggaaaccggtaccgggtaaccgaacccggtttacgaaccttacgggacaacccggttaacggacggtaccctaccgggagtaacggcgacggttaccggacgtaaccggaggtccggtaacggattcgggtaccggttaacgaccgtaaccgggttaccggttaacccgggttaagttcccgttaacgggttcgaagggtacgtaagcggtaaggtaacggtacggttttacttagggtttcgggtaacgg

SEQ ID NO: 129529 - DNA, 788 bp, Homo sapiens
  misc_feature: GYAE6OF02JU4A1.45.78.H01.1.454.CMB.1.raw
tcagacgcgatcgacacgaccggtgctcgattagtgtgagtagtttgggtttggggtgaagaagcctggggcctcagtgaaggtctcctgcaaggcttctggatacaccttcaccggctactatatacactgggtgcgacacggcccctggacaagggcttgagtggatgggatggatcaaccctaacaatggtgcaacaaactatcgcacaggtaaacgtttcgacgggtcgacgggtcaccagtacgaccgaagggtaccacgtaccatcgaacgacctaacgacgtacctaaccgtagacgggtactcgtacggacgcggaacggtcgtagaatacgtcctaggaccgaacggaccgtacggttacgttaacgtaccgtggtacgacggaacggacggacgtaaacggttaacgtttaacgtttaggttttaggggtacgtttgggtttaacggttaccggggtaaggtttaacgggttacggtaccgggttttcggacgggggtaacccgtaacgggaacccgtacgggtacccgtacccggttccgtccgtaacgccgtaacccgtcccggaaacccggggtaccgtacccgtaccggtccttccccggtacccggtcgaccccgttacccttacccgccgaaaggtccgtaaccgtcccgttcgggcggaaccgtacgccggtaccggtaccgtcggtaccgtgtaccggttccgagtacccggtaccttaccgaccgttcgcccgttacgtcgtaccggtacggacggtccggtacgtcgg

SEQ ID NO: 129530 - DNA, 699 bp, Homo sapiens
  misc_feature: GYAE6OF02HOHOW.45.78.H01.1.454.CMB.1.raw
  modified_base (396)..(396): a, c, t, g, unknown or other
  misc_feature (396)..(396): n is a, c, g, or t
tcagacgcgatcgacacgaccggtgctcgatttagtgtgagtagtttgggtttgggggagagcatcacccagcaaccacatctgtcctctagagaatcccctgagagctccgttcctcaccatggactggacctggaggatcctcttcttggtggcagcagccacaggagcccactcccaggtgcagcgtggtgcagtcgtgggctggaggtgaagaagccgtcgggcctacgagtaggaaggtcctccgtcggacgaacggtctttaccgtggtactacctacgttaccgaccggtactaacgtatactacacggtcgggtcgaccgacgaccgggccccgtaggaccgaacggtcgttaggacggtggagtgggagtggactaccaaaccctanaagtgggtacgacaactaaacgtagtcgacaacgaggtaacgttacgagggtacgacgggtaccaaccgtaagaccggtaaccgaacggggtaacctacccggtaccaagtaccgaacgtaccaacgtacgacctaaacgtacggacgggacgtacgtacggtaacggaccgacggtacgtagaacggtcgtaccgaggtaacccgaccggtacggtccggttaacggttacttacggtacggtcggaacggtcggaacgggtacgtaacggtttaagtttaccggttaggttttaaccgggg

SEQ ID NO: 129531 - DNA, 932 bp, Homo sapiens
  misc_feature: GYAE6OF02JC8UB.45.78.H01.1.454.CMB.1.raw
  modified_base (261)..(261): a, c, t, g, unknown or other
  misc_feature (261)..(261): n is a, c, g, or t
  modified_base (269)..(269): a, c, t, g, unknown or other
  misc_feature (269)..(269): n is a, c, g, or t
  modified_base (285)..(285): a, c, t, g, unknown or other
  misc_feature (285)..(285): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggtcttggagtggatgggatggatcaaccctaacaagtgggtggctaacaaactatgacacgaggtaagttcgagggtcagggtacaccatacgaccgagggacncgtcctancagcacacgtcctaancgtagacgctagacgacgaggtcgtagacggtactcgtacggaccgacgtacggtaccgttaggtacgttacgtcggtacgacggaagaggaccgtaaggtacgtttacgtttaggtttaggtacggtttaggttaacggttcgggtaacgttacggtagggtaccggttacgggtaccggggaacgggtaacggtaaccggtacccggtacccggttaacccgttccgtacccggtaacccgttacggtacccgtacccccgggtaaacgtaacccggggtacccttccggttacccccgggtttccccctttaaaccccgggcccgtaaccccccgttaccccgggttaacccgttaaaaccccgggagttaaccccggcccggttaaccccgggtttcgggggaaccccgggttaacccggaacccgggttacccgggtacccccgggggttacggtttcccgggacccgtttaccgggtacccgggttttaacgggaaaccccgggtttttaacggtaccccccggttttaaaccggtttccccgggtttaaaccggtcccgggtttaaccccgggtttacccgggtaccgttacccgggggggaaccccgggttttacgggggacccggttaaccccggggg

SEQ ID NO: 129532 - DNA, 606 bp, Homo sapiens
  misc_feature: GYAE6OF02GHRH0.45.78.H01.1.454.CMB.1.raw
  modified_base (352)..(352): a, c, t, g, unknown or other
  misc_feature (352)..(352): n is a, c, g, or t
  modified_base (499)..(499): a, c, t, g, unknown or other
  misc_feature (499)..(499): n is a, c, g, or t
  modified_base (571)..(571): a, c, t, g, unknown or other
  misc_feature (571)..(571): n is a, c, g, or t
  modified_base (588)..(588): a, c, t, g, unknown or other
  misc_feature (588)..(588): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaagtggtggcacaaactatgcacagaagtttcagggcagggtcaccatcgaccgagggacaccgtaccatcagccaacacgacctacgaggtcggggcgtggacgcgaggctaggacgatcgtagacgacgacggccgtagttagttacgtggtgcgaggacgngaaggtatagttagttttgaggttgttacgtggagttgtggtcgtgtcggggacgaacgggaccgagtccgaccgttctcctcgcgcctaccgacgacgcccacgttccgtaccctcccgtcgccctaccctcctaccgacgtaccnccctacggtcggtccgggaccacgtccgccgtccgacggctcgtccgtcgggacgacggtctaccttcccgngtacgttccggcttcgngacggcggtcgtggaccg

SEQ ID NO: 129533 - DNA, 690 bp, Homo sapiens
  misc_feature: GYAE6OF02FNI1G.45.78.H01.1.454.CMB.1.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtgggcctcgagtggaaggtcctccgtgcgaacggtcttcgtggactacaccttcgaccggtctactatactacacgtgggtgcgacgacggcccgtggaccaagggtcttaggaggtggagtagggagtggactaccgaaaccctaacgtaagtgggtacgactaactaaactacgtacgactaacgagtaacgtttcgacgggtacgagggtaccaaccgtagtacgggaccgtaacgggacctaaccgtaccgtaacgtaccgtaacgaccgtaacgaaccgtacccttaacgagttacgggacgtacggttacgacggaccgagggtacgtaggaacgtacgtcggacggtaaccgggtaccgtaccggtaccggttacgttaacgttaaccgttcggacggttacggaacggttacgggacggtaacgggttaacgtttaacgggtttacggttttagggttaacggg

SEQ ID NO: 129534 - DNA, 760 bp, Homo sapiens
  misc_feature: GYAE6OF02HL6ZB.45.78.H01.1.454.CMB.1.raw
  modified_base (513)..(513): a, c, t, g, unknown or other
  misc_feature (513)..(513): n is a, c, g, or t
  modified_base (520)..(520): a, c, t, g, unknown or other
  misc_feature (520)..(520): n is a, c, g, or t
tcagacgcgatcgacacgaccggtgctcgatttagtgtgagtagtttgggtttgggggagtcagacccagtcaggacacagcatggacatgacgggtcccgctcagctcctggggctcctgctgctctggctcccgaggtcgaccaaatgtagacactccgaagactcgacctagtcctccttccacccgtcgtctcgactagtcgtaggtaagacgacgacggtacgtccaacctagttcgtacggttttccgggaccggggtaccgtacgtaacgtaacggtaagtttaagttaacgttaacgggttcgggttaccggtccggttggtaacgtacgaacggaccgaaacggaaaccgaaccggggaaaccgtaccgtaacgtccgtacctcgtccgtaacgtaacgacggactagttacgttaagttacggtaacggtacggtacctacgtacgtaacggtcgacggacggacgtagtagcgtcggagtaacgtacgtacgtactacgtcncacgtancgacgcgactcgcgtacggctcgtacggtatacggttattcaacgttaacttcgtagtacactagtactagtagtattaccgtttaggtaccgttacgtaaccggtaacggaaaccgggtaaccgggttaagaaccggtttaactaaaccgggaacggttaaccggtacgggtccgttaccgaaccggtaccttaaccgtacgtttaccggtttacgtttcccggtaacttacccccggg

SEQ ID NO: 129535 - DNA, 715 bp, Homo sapiens
  misc_feature: GYAE6OF02JRGIX.45.78.H01.1.454.CMB.1.raw
  modified_base (200)..(200): a, c, t, g, unknown or other
  misc_feature (200)..(200): n is a, c, g, or t
tcagacgcgatcgacacgaccggtgctcgatttagtgtgagtagtttgggtttgggggagtcagacccagtcaggacacagcatggacatgagggtccccgctcagctccgtggggctcctgctgctctggctcccaggtgaccaaatgtgacatccagatcgacccagtcctccttccacctgtctgcatctgtagganacagacgtccaccatccgacgttcggccggcagtcgagtagttattagtaacgtggttcggcctggtactcagacgaacgaaaccgagggaaactccctaagccttccgagtctacgtacgtaacggactacgtacgttaaggttaacgaacggtcgggtaccaagttacggtaacggttcacggacggtacggtaaggtcggtacgttacggtacgggaacctaaggttacttacctaacttccgtaaccgaacctagttaccgaacgtaccgacggtcccgtaagacctaccggtacctagggtattacgtttactttaagacctttaaacgtttactaaccgtaccgtaaccgtaaacttagtacgttaagttacgtttaacgggttacgtttaccgggtaaccgttaccgggaaaccgaaagggtacccgtaagggtacgtaaaccgtaacgtaaacggtacgtggtacccgagtaccaccgtactacgttcgtacgttactaccttaccg

SEQ ID NO: 129536 - DNA, 682 bp, Homo sapiens
  misc_feature: GYAE6OF02GQANT.45.78.H01.1.454.CMB.1.raw
  modified_base (152)..(152): a, c, t, g, unknown or other
  misc_feature (152)..(152): n is a, c, g, or t
  modified_base (202)..(202): a, c, t, g, unknown or other
  misc_feature (202)..(202): n is a, c, g, or t
  modified_base (315)..(315): a, c, t, g, unknown or other
  misc_feature (315)..(315): n is a, c, g, or t
  modified_base (398)..(398): a, c, t, g, unknown or other
  misc_feature (398)..(398): n is a, c, g, or t
  modified_base (510)..(510): a, c, t, g, unknown or other
  misc_feature (510)..(510): n is a, c, g, or t
tcagacgcgatcgacacgaccggtgctcgatttagtgtgagtagtttgggtttgggggagtcagacccagtcaggacacagcatggacatcgagggtccccgctcagctcctgggctcctgctgctctcggctccagtcgacaaatgtgacntccagatgacccagtcctccttacacccgtgtctgcactcgtgtacgganacgaagtcgtcaaccgtatcacgtcgtccggacctagcagattagtactagtcggtgactggtactcgacgtactaaggaaaccgagggtaaactcccctaaaggctaccgtnaccgtattaacgaacggtctaactacgttaacgtttaagggaacggttcggtaccctaagtaccgtaacgttcgaagcggtanaggtgtacgttcgaaggaacgactaacgtctacacgctaacctagccgaacgctacgtcctggactacgtacgtactagtagttacgttcgtacttaacgttaccgttaacncgtaacgaacgtacgttagtaacggttaatacgtttacttaaccgggtagtttaccggaacggtaaacgtaccgtaacggtaacgtaacgtaaccggtaaaccggtaaccgttacggaccggtaccgttaaccgcttaaccgtacgttacctacgtttacctaccttaaccg

SEQ ID NO: 129537 - DNA, 1007 bp, Homo sapiens
  misc_feature: GYAE6OF02II0II.45.78.H01.1.454.CMB.1.raw
tcagacgcgatcgaaacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggagtgggatggactcaaccctaacaatggtggacacaaactatgacacagtaacgttcgacgggacacgggtcaccgtatacgaaccgtacgggaacctaccgtacctatacgagaccaacacgtccttaacgacgtcgggacgtacggttacggacgacgtacgggtcgtaggtaacgttactcccggtaggaaccggtaaccggtacccggggtaccggtttacggtttaacgttttaccggttagggttaccggttacggggaacgggtaacggggtacccggtttaaagggttaaaccgttttaaacgggttttaacggttttttacgggggttaaacgggtttttacgggttttaaaccgggttttacgggggttaaacgggtttcgggtttaacgggtaaccgggttacggggtaccggggggtaaacccggtaaaacccgggggttaccgggaacccggttcccggtaaccccgttcccgttaccccggtaccggaacggtcccccttaaacccggaaaccccgggtaaacccgggtaacccccggttaaccccggttccccgggggtttaaccccccttttcccccgggtaacccggttacccccttaaacccccgttcccgttaacccggaaaccgggtacccggtcccttaaccccgggtcccgggttaaccggggaccgtaacccggacccgggttccccggtcccgggttaaccgggtccgttccgggccgttaccgggtaacgtaacccgggttccttaacccggttcgttaaccgtccgttaccggttcgtaccggttaccggtcggcgggttacccggtacggg

SEQ ID NO: 129538 - DNA, 670 bp, Homo sapiens
  misc_feature: GYAE6OF02G7U8L.45.78.H01.1.454.CMB.1.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggagggtgaaggaagccgtggggccctcagtgaggtctcctgcaaggcttcgtggatactaccttccgaccggtctactatactactacgtgggtcgcgaccgacggccccgtaggaccgaacgggtcttagggaggtagggagtgggagtaggactaccgaaacccgtaacgtaggtacgggtcggacaacgtaaactacgtacgacaacgtaagtaacggtttacgacggggtaccggacgggtaccaaccgtagtaccggaaccgacggggaccacgtaccgacgtaccgacgacgaccgacggtacctaagacgtggacgtacgtaggaccgcggaaggcgtaagacgtactcggaacggaccgacggaccggtaccggtagttaccgttacggtcggtacggcggtaaggtacggtacgtaagggtttacgttaacgggtttagtttttacgggtaacggg

SEQ ID NO: 129539 - DNA, 654 bp, Homo sapiens
  misc_feature: GYAE6OF02HB68A.45.78.H01.1.454.CMB.1.raw
  modified_base (271)..(271): a, c, t, g, unknown or other
  misc_feature (271)..(271): n is a, c, g, or t
  modified_base (533)..(533): a, c, t, g, unknown or other
  misc_feature (533)..(533): n is a, c, g, or t
  modified_base (611)..(611): a, c, t, g, unknown or other
  misc_feature (611)..(611): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtgggctggaggtgaagagccgtggggcctcgagtgaaggtctccgtgacaggcttcgaggactacacccttacncccggacttaactatactacgaccgttggggtcaccggcacggtcccctaggaccgaagggtcttggaggttggacgtagggtatagggactcctaaacccgtaataacgtaggtcggaccaactaacgtatcggacaagtagtagttacgacgggacgtcggtaacaccgtagacggacgtacgggacacgtacacgtacacggactacgaccgtacctacgagttacgagttcgaacgggcaccggtagtggaccggtanacggttacgaccggtaaccggttaaccgcggttccgttagggttacttaaccggtcggtacggagtacgggtaaccgnggaaaccggtttaagtaccgggttttaagtttgggttaacggg

SEQ ID NO: 129540 - DNA, 742 bp, Homo sapiens
  misc_feature: GYAE6OF02JW4QG.45.78.H01.1.454.CMB.1.raw
  modified_base (194)..(194): a, c, t, g, unknown or other
  misc_feature (194)..(194): n is a, c, g, or t
  modified_base (216)..(216): a, c, t, g, unknown or other
  misc_feature (216)..(216): n is a, c, g, or t
  modified_base (331)..(331): a, c, t, g, unknown or other
  misc_feature (331)..(331): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacacgtgggtgcgacaggcccctggacaagggcttgaggtggagtgggagtggatccaaaccctaanaatcgggtggacaacgaaactntgcaacaggtaagttcgaggggctagggtcaacctgtacgaccgagggtaccaccgttaccagacagtccaacgacgcctacagtggacgcctggacgacctagggccgtggaangtccgtagaacgtaccggacggtcccggtaacgttacgtacggtgtaacggacgagggacggtccggtaaaggtaagttaccgtttaaagttttgggggtacttagggtttaaggtacggtaccgggttatacgggcgttacggtaggggacccgtaggaccgtagtcgtaccgtctacccgtcaccggtcaccgtacgaacgcgacgtcggtcccaccgttcggcctcccggtacctaccgaacgcgtacccgtcgtacccggtacggggaccgaacgccgggttccgacccggttcggacctaccgggttccgtaccggtaacggtaaccgggttacttaccccggttacccggtaaccgtcggttacccgacggtttaccggacgaccgggttccgggacggtacggg

SEQ ID NO: 129541 - DNA, 660 bp, Homo sapiens
  misc_feature: GYAE6OF02GOH6S.45.78.H01.1.454.CMB.1.raw
  modified_base (201)..(201): a, c, t, g, unknown or other
  misc_feature (201)..(201): n is a, c, g, or t
  modified_base (517)..(517): a, c, t, g, unknown or other
  misc_feature (517)..(517): n is a, c, g, or t
tcagacgcgatcgacacgaccggtgctcgatttagtgtgagtagtttgggtttgggggagtcaggacccagtcaggacacagcatggacatgagggtccccgctcagctcctggggctcctgctgctctggctcccaggtgccaaatgtgacatccagatcgacccagtctccttccaccctgtctgctactctgtagganacagagtcacctatcacttcgccggcagtcgagtagtacttagtaacgtggttcggccttggtatcagactaagaaaccgagggaacctccctaagcctaccgtcgtactacgtagtaacggctagtacttagttagaaaggtcggtaccctagtaccgtaacgtcgacggcgtacgtacggtaggtacgtacggtaggacgtaagtaacttccacttccgtaccaccgtaacgtcgtacgaccgtacgccctacggcaacggtccttagacttcggttaactttgaacctttaatttacgtacgtacaccgtaanacgtttagagttacttagttacgtaccgttacgttaccggggacctaaacgggtaccgaagggttaagaaccctaacggtaaacgttaggcggtaaggaccctcggtaaccacgtattccgtaacgtttccaccgttaacccg

SEQ ID NO: 129542 - DNA, 816 bp, Homo sapiens
  misc_feature: GYAE6OF02GACF5.45.78.H01.1.454.CMB.1.raw
tcagacgcgatcgacacgaccggtgctcgatttagtgtgagtagtttgggttgggggagagcatcacccagcaaccacatctgtcctctagagaatcccctgagagctccgttcctcaccatggactggacctcggaggatcctcttcttggtggcagcagccacaggacgtcccactcccacggtgcagcgtggtcgcagtcgtgggctgaggtgaagacgccgtcggggcctcgagtggaacggtctccgtcgacgtaacggtcttgtcggaactacctaccttaccgaccgctaactattaactacgacggtcggtcgcgaccgtacgcccgtacggtaccgtaacgggtccgtaggtaaggtacggtacggttacggggtcgtaggtaccgtaaccgttaaaccccgttaaacggtacggttacgggttaacggaaccgtttaaacgaaaaccggtttaacgtccggaacgtaaacggtaaacggtttaaacggttttaccgggtaacgggtaccggttacccgggttaacgaacccggaaggtttaacccggaaccggtaacggggtaaaccgtacccgaacccgttaagggtacccaggttaaccctaaccgaccgtaacccgttacgtaaggtcgggtaaccggtgtaacggaccgtaaccggacgggttacgtaccgggtaaggtaacgttacccggtaacgacggtaccgggtacccggttacggtaacggtttaccgttacggtacggtacggtaacggacggaacggaccggttaagttacgggtttaccgttaggtttaccggg

SEQ ID NO: 129543 - DNA, 806 bp, Homo sapiens
  misc_feature: GYAE6OF02I2885.45.78.H01.1.454.CMB.1.raw
  modified_base (127)..(127): a, c, t, g, unknown or other
  misc_feature (127)..(127): n is a, c, g, or t
  modified_base (171)..(171): a, c, t, g, unknown or other
  misc_feature (171)..(171): n is a, c, g, or t
  modified_base (555)..(555): a, c, t, g, unknown or other
  misc_feature (555)..(555): n is a, c, g, or t
  modified_base (633)..(633): a, c, t, g, unknown or other
  misc_feature (633)..(633): n is a, c, g, or t
  modified_base (761)..(761): a, c, t, g, unknown or other
  misc_feature (761)..(761): n is a, c, g, or t
  modified_base (785)..(785): a, c, t, g, unknown or other
  misc_feature (785)..(785): n is a, c, g, or t
tcagacgcgatcgacacgaccggtgctcgatttagtgtgagtagtttgggtttgggggagtcagacccagtcaggacacagcatggacatgacgggtccccgctcagctcctggggctcctgctgcnctggcctcccgaggtgccaaatggtgacatccagatcgaacccngtctccttccaccctgtctagccatctagtaggacgacgagacgtcaaccatcacgttggcccgggacccaagtccgtaaggaagtttagttaacggtaaccgttggggttcggtccctagggtaccttacgagaccgaaaggtaaaaccccggagggtaaaccaccccggtaaatccgtcccgttagtccgttaaccgttaggaacggtaccatttacggttaacgttttaacggaaagggttcccgggtaccctagtaacgtaaacggttcgaacggtaccggagtaaggtacggaagtccggttacggggaaacttaaacggtaccttacacccggttacaccaacgtacctgaacggactaccgcgtacggctaaccggngttacgtagtttacgtacgtttaccggactttaacgtttaccgttaacgaccgaaactaaccgggttatttaaccggntttaaaccgttaccggttttaacggtccgttaaccggggtaccgtaaacgggtaaacgggtaacccgttaaggggacttaaaacccggaagggtaaaaccggttccgtaaagggttccaccgggttanacccttaacgggtggtttaccttntttacccgggtctaacccggg

SEQ ID NO: 129544 - DNA, 259 bp, Homo sapiens
  misc_feature: GYAE6OF01ATNCX.17.80.H03.1.454.CMB.1.raw
  modified_base (257)..(259): a, c, t, g, unknown or other
  misc_feature (257)..(259): n is a, c, g, or t
tcagcgtagactagcacgaccggtgctcgatttagctgtgcgtcgaagggaaagggcggtggtagctgctaccgccgtgggttcgaccactgggccagggaaccctggtcaccgtctcctcagcctccaccaagggcccatcggtcttccccctggcaccctcctccaagagcacctctggggcacagcggccctgggctgcctggtcaaggactacttccctagtctacgctgagcgggctggcaaggcgcatagnnn

SEQ ID NO: 129545 - DNA, 259 bp, Homo sapiens
  misc_feature: GYAE6OF01EZQTW.17.80.H03.1.454.CMB.1.raw
  modified_base (257)..(259): a, c, t, g, unknown or other
  misc_feature (257)..(259): n is a, c, g, or t
tcagcgtagactagcacgaccggtgctcgatttagctgtgcgtcgaagggaaagggcggtggtagctgctaccgccgtgggttcgaccactgggccagggaaccctggtcaccgtctcctcagcctccaccaagggcccatcggtcttcccctggcgccctgctccaggagcacctccgagagcacagcggccctgggctgcctggtcaaggactacttccctagtctacgctgagcgggctggcaaggcgcatagnnn

SEQ ID NO: 129546 - DNA, 265 bp, Homo sapiens
  misc_feature: GYAE6OF01DHSGF.17.80.H03.1.454.CMB.1.raw
  modified_base (261)..(265): a, c, t, g, unknown or other
  misc_feature (261)..(265): n is a, c, g, or t
tcagcgtagactagcacgaccggtgctcgatttagctgtgcgtcgaagggaaaggggcggtggtagctgctaccgccgtggggttcgaccactggggccagggaaccctggtcaccgtctcctcagcctccaccaagggcccatcggtcttccccctggcaccctcctccaagagcacctctgggggcacagcggccctgggctgcctggtcaaggactacttccctagtctacgctgagcgggctggcaaggcgcatagnnnnn

SEQ ID NO: 129547 - DNA, 274 bp, Homo sapiens
  misc_feature: GYAE6OF01E0KVR.17.80.H03.1.454.CMB.1.raw
  modified_base (260)..(274): a, c, t, g, unknown or other
  misc_feature (260)..(274): n is a, c, g, or t
tcagcgtagactagcacgaccggtgctcgatttagctgtgcgtcgaagggaaagggcggtggtagctgctaccgccgtggggttcgaccactggggccagggaaccctggtcaccgtctcctcagcctccaccaagggcccatcggtcttccccctggcaccctcctccaagagcacctctgggggcacagcggccctgggctgcctggtcaaggactacttccctagtctacgctgagcgggctggcaaggcgcatagnnnnnnnnnnnnnnn

SEQ ID NO: 129548 - DNA, 264 bp, Homo sapiens
  misc_feature: GYAE6OF01DE05S.17.80.H03.1.454.CMB.1.raw
  modified_base (261)..(264): a, c, t, g, unknown or other
  misc_feature (261)..(264): n is a, c, g, or t
tcagcgtagactagcacgaccggtgctcgatttagctgtgcgtcgaagggaaaggggcggtggtagctgctaccgccgtggggttcgaccactggggccagggaaccctggtcaccgtctcctcagcctccaccaagggcccatcggtcttccccctggcaccctcctccaagagcacctctgggggcacagcggccctgggctgcctggtcaaggactacttccctagtctacgctgagcgggctggcaaggcgcatagnnnn

SEQ ID NO: 129549 - DNA, 266 bp, Homo sapiens
  misc_feature: GYAE6OF01DMGFV.17.80.H03.1.454.CMB.1.raw
  modified_base (262)..(266): a, c, t, g, unknown or other
  misc_feature (262)..(266): n is a, c, g, or t
tcagcgtagactagcacgaccggtgctcgatttagctgtgcgtcgaaagggaaaggggcggtggtagctgctaccgccgtggggttcgaccactggggccagggaaccctggtcaccgtctcctcagcctccaccaagggcccatcggtcttccccctggcaccctcctccaagagcacctcgtgggggcacagcggccctgggctgcctggtcaaggactacttcctagtctacgctgagcgggctggcaaggcgcatagnnnnn

SEQ ID NO: 129550 - DNA, 277 bp, Homo sapiens
  misc_feature: GYAE6OF01ERCRD.17.80.H03.1.454.CMB.1.raw
  modified_base (260)..(277): a, c, t, g, unknown or other
  misc_feature (260)..(277): n is a, c, g, or t
tcagcgtagactagcacgaccggtgctcgatttagctgtgcgtcgaagggaaagggcggtggtagctgctaccgccgtggggttcgaccactggggccagggaaccctggtcaccgtctcctcagcctccaccaagggcccatcggtcttccccctggcaccctcctccaagagcacctctgggggcacagcggccctgggctgcctggtcaaggactacttccctagtctacgctgagcgggctggcaaggcgcatagnnnnnnnnnnnnnnnnnn

SEQ ID NO: 129551 - DNA, 273 bp, Homo sapiens
  misc_feature: GYAE6OF01DBR54.17.80.H03.1.454.CMB.1.raw
  modified_base (259)..(259): a, c, t, g, unknown or other
  misc_feature (259)..(259): n is a, c, g, or t
  modified_base (262)..(264): a, c, t, g, unknown or other
  misc_feature (262)..(264): n is a, c, g, or t
  modified_base (266)..(273): a, c, t, g, unknown or other
  misc_feature (266)..(273): n is a, c, g, or t
tcagcgtagactagcacgaccggtgctcgatttagctgtgcgtcgaagggaaaggggcggtggtagctgctaccgccgtggggttcgaccactgggccagggaaccctggtcaccgtctcctcagcctccaccaagggcccatcggtcttccccctggccaccctcctccaagagcacctctgggggcacgagcggccctgggctgcctggtcaaggctacttccctagtctacgctgagcgggactggcaaggcgcanagnnntnnnnnnnn

SEQ ID NO: 129552 - DNA, 261 bp, Homo sapiens
  misc_feature: GYAE6OF02ICRZF.17.80.H03.1.454.CMB.1.raw
  modified_base (259)..(261): a, c, t, g, unknown or other
  misc_feature (259)..(261): n is a, c, g, or t
tcagcgtagactagcacgaccggtgctcgatttagctgtgcgtcgaagggaaagggcggtggtagctgctaccgccgtggggttcgaccactgggccagggaaccctggtcaccgtctcctcagcctccaccaagggcccatcggtcttccccctggcaccctcctccaagagcacctctgggggcacagcggccctgggctgcctggtcaaggactacttccctagtctacgctgagcgggctggcaaggcgcatagnnn

SEQ ID NO: 129553 - DNA, 261 bp, Homo sapiens
  misc_feature: GYAE6OF02G5DXX.17.80.H03.1.454.CMB.1.raw
  modified_base (260)..(261): a, c, t, g, unknown or other
  misc_feature (260)..(261): n is a, c, g, or t
tcagcgtagactagcacgaccggtgctcgatttagctgtgcgtcgaagggaaagggcggtggtagctgctaccgccgtggggttcgaccactggggccagggaaccctggtcaccgtctcctcagcctccaccaagggcccatcggtcttccccctggcaccctcctccaagagcacctctgggggcacagcggccctgggctgcctggtcaaggactacttccctagtctacgctgagcgggctggcaaggcgcatagnn

SEQ ID NO: 129554 - DNA, 262 bp, Homo sapiens
  misc_feature: GYAE6OF02FHENE.17.80.H03.1.454.CMB.1.raw
  modified_base (261)..(262): a, c, t, g, unknown or other
  misc_feature (261)..(262): n is a, c, g, or t
tcagcgtagactagcacgaccggtgctcgatttagctgtgcgtcgaagggaaaggggcggtggtagctgctaccgccgtggggttcgaccactggggccagggaaccctggtcaccgtctcctcagcctccaccaagggcccatcggtcttccccctggcaccctcctccaagagcacctctgggggcacagcggccctgggctgcctggtcaaggactacttccctagtctacgctgagcgggctggcaaggcgcatagnn

SEQ ID NO: 129555 - DNA, 280 bp, Homo sapiens
  misc_feature: GYAE6OF02IE0HD.17.80.H03.1.454.CMB.1.raw
  modified_base (267)..(280): a, c, t, g, unknown or other
  misc_feature (267)..(280): n is a, c, g, or t
tcagcgtagactagcacgaccggtgctcgatttagctgtgcgtcgaagggaaaggggcggtggtagctgctaccgccgtggggttcgaccactggggccagggaaccctggtcaccgtctcctcagcctccaccaagggcccatcggtcttccccctggcaccctcctccaagagcacctctgggggcacagcgccctgggctcgcctggtacaaggacttaccttccctagtctacgctgacgcggctggacgaaggcgcaatagnnnnnnnnnnnnnn

SEQ ID NO: 129556 - DNA, 264 bp, Homo sapiens; identical to SEQ ID NO: 129548
  misc_feature: GYAE6OF02IYO4Q.17.80.H03.1.454.CMB.1.raw
  modified_base (261)..(264): a, c, t, g, unknown or other
  misc_feature (261)..(264): n is a, c, g, or t

SEQ ID NO: 129557 - DNA, 275 bp, Homo sapiens
  misc_feature: GYAE6OF02HZLNG.17.80.H03.1.454.CMB.1.raw
  modified_base (269)..(275): a, c, t, g, unknown or other
  misc_feature (269)..(275): n is a, c, g, or t
tcagcgtagactagcacgaccggtgctcgatttagctgtgcgtcgaagggaaaggggcggtggtagctgctaccgccgtggggttcgaccactggggccagggaaccctggtcaccgtctcctcagcccccccccctcaccaagggcccatcggtcttccccctggcaccctcctccaagagcacctcgtgggggcacagcggccctgggctgcctggtcaaggactacttccctagtctacgctgagcgggctggcaaggcgcatagnnnnnnn

SEQ ID NO: 129558 - DNA, 281 bp, Homo sapiens
  misc_feature: GYAE6OF02JQK2U.17.80.H03.1.454.CMB.1.raw
  modified_base (259)..(281): a, c, t, g, unknown or other
  misc_feature (259)..(281): n is a, c, g, or t
tcagcgtagactagcacgaccggtgctcgatttagctgtgcgtcgaagggaaaggggcggtggtagctgctaccgccgtggggttcgaccactggggccagggaaccctggtcaccgtctcctcagcctccaccaagggcccatcggtcttccccctggcaccctcctccaagagcacctctgggggcacagcggcctgggctgcctggtcaaggactacgttcctagtctacgctgagcgggctggcaggcgcatagnnnnnnnnnnnnnnnnnnnnnnn

SEQ ID NO: 129559 - DNA, 130 bp, Homo sapiens
  misc_feature: GYAE6OF01CLLRF.49.45.E01.1.454.CMB.1.raw
  modified_base (130)..(130): a, c, t, g, unknown or other
  misc_feature (130)..(130): n is a, c, g, or t
tcagagtcgagagacacgaccggtgctcgatttagtgagtcagtaagggaaagggtgtagatctcggtggtcgccgcatcttcccgccatctgatctctcgactctgagcgggctggcaaggcgcatagn

SEQ ID NO: 129560 - DNA, 177 bp, Homo sapiens
  misc_feature: GYAE6OF02FWWEP.49.45.E01.1.454.CMB.1.raw
  modified_base (152)..(152): a, c, t, g, unknown or other
  misc_feature (152)..(152): n is a, c, g, or t
  modified_base (154)..(155): a, c, t, g, unknown or other
  misc_feature (154)..(155): n is a, c, g, or t
  modified_base (157)..(177): a, c, t, g, unknown or other
  misc_feature (157)..(177): n is a, c, g, or t
tcagagtcgagagacacgaccggtgctcgatttagtgagtcagtaagggaaagggcgcacactgcacatcgttggtttgggcatcgaaccggacaacgctgaactggtgcaggggctggcaaggcgcatagcgggctggcaaggcgcatagngnngnnnnnnnnnnnnnnnnnnnnn

SEQ ID NO: 129561 - DNA, 499 bp, Homo sapiens
  misc_feature: GYAE6OF02HLI8Y.49.45.E01.1.454.CMB.1.raw
  modified_base (484)..(499): a, c, t, g, unknown or other
  misc_feature (484)..(499): n is a, c, g, or t
tcagagtcgagagacacgaccggtgctcgatttagtgagtcagtaagggaaggggctggagtggatttcatatattagtgctggtgctactaccatgaagtacgcagactctgtgaggggccgattcaccatttccagggacgacgccaaagaaatcagtatatctacaaatgagtagcctgagagacgaggacacggctgtgtattactgtggcggggccggggagccactcggaccaccctacaccaagactacgtcggggccgacgggaacccgtggtcgccgtcctcctcacgccctccaccgaacgggccccatccggtcctttcccccctcgggccaccctccctccaacgacgcaccctcgtcgggggcacagcacgcccgtgggctcggcctggtaccgaacggtacttacctttccctccgttcctccgtaccttcgtcggacggtccgggcgtcgggcgaacgggcgcagtagnnnnnnnnnnnnnnnn

SEQ ID NO: 129562 - DNA, 774 bp, Homo sapiens
  misc_feature: GYAE6OF01EHD9F.9.88.H11.1.454.CMB.1.raw
tcagtgatacgtctcacgaccggtgctcgatttagcgacagcgagaacacgacgaaaggggggggtctcaggaggcagcactctcaggacgtcaccacatggcctgggctctgcctcctcctccaccctcctcacctcgacgggccgacgtacgggtccgtcgggaccctaggtctcggccctgacctccgacgtccctcccgtccggtccgtccgggtctccgtggactgtctacgtccacctcttccgtcctcgcctacggtacggtaccgtccggactcgttcggttacggttttcggttttacgttttgtactttcgtcgttacccgtccggttaacggaccacgtaccgaccgaccgtaaccggagaacccctaaaccccggaccccttaagttccgtttacgttacgacgtaaccggttcctacggacggcccgttcgaacggtacgtccttaccgagtccttccgttcttccgacggtccgtacgccgtcggtcgaccgaaccgtacccgtccggtccccttaacggaccttgtcctcgtaccgtccaccggtctcgtacgacgtacgtaggttactttctttattacgtacgtaggtccgtaagttacgacgtatacggaccgttaggaacgttacgtttaagtttccgtttaggttcgggggtacgaccggggtacgtaccggttaccgttacgggtaacctggtaacgccggtaccgcccggtaccgtaccggtcccgtaccggtccttccgtcccgtttaccc

SEQ ID NO: 129563 - DNA, 532 bp, Homo sapiens
  misc_feature: GYAE6OF02GOZSI.9.88.H11.1.454.CMB.1.raw
tcagtgatacgtctcacgaccggtgctcgatttagcgacagcgagaacacacaaaggggggtctcaggaggcagcactctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccggcactgacgttggtcgttttgtctatgtctcctggtaccagcagcacccaggcaaaggccccaaactcgtcctttatgaagcctctaagcggccctcagggatccctgatcgcttctctggctccaggtctggcaacacggcctccctgaccgtctctggactccagcctgacgatgaggctatttattactgcagtgcatatgcaggcagttaattactttgggttttcgctaggacgggacctacgggtcgaccgttcctaagtccaggcccgaaggcctcggcccccttcgggtcctaccg

SEQ ID NO: 129564 - DNA, 680 bp, Homo sapiens
  misc_feature: GYAE6OF02GY0OM.9.88.H11.1.454.CMB.1.raw
  modified_base (317)..(317): a, c, t, g, unknown or other
  misc_feature (317)..(317): n is a, c, g, or t
  modified_base (369)..(369): a, c, t, g, unknown or other
  misc_feature (369)..(369): n is a, c, g, or t
tcagtgatacgtctcacgaccggtgctcgatttagcgacagcgagaacacacaaaggggggggtctcaggaggcagcactctcaggacgtcaccaccatggcctgggctctgctcctcctcaccctcctcactcagggcacagggtccgtgggcccagtctgccctgactcagccctccctccgcgtccggtctcctggacagtcagtcaccatcctctgcactggactccggcactgtacgttggttcgttttgtcttatcgtctcctggtaccagcagcaaccgagacaaaccggcccaaactccgttcctttancgtaacgcctactaacggccgtcctacgaggtactcccgtgactcgctttcncgtcggccttaccgaggtctcggacctaacgtacccgtccctacccgtcgtaccgttctcgtcgacctccgacgtccgtagacgagtcggaacgtctttaatttactacttgactagtctacgtaatcgtcgacgtacgtacttaaggtttaactttacgggtttttcgggtttacggacggggtaacggtacccgttacgggtaccggtaacccgtttaccggttaaacgttcccgaacccggtacccgtaaacgggttcccgttaccccggtaccccccggtttacgggtaccctaccgtttcccccgg

SEQ ID NO: 129565 - DNA, 786 bp, Homo sapiens
  misc_feature: GYAE6OF02J01SL.9.88.H11.1.454.CMB.1.raw
tcagtgatacgtctcacgaccggtgctcgatttagcgacagcgagaacacacaaagggggggggtctcaggaggcagcactctcaggacgtcaccaccatggcctgggctctgctcctcctcaccctcctcactcgagggcacgagggtcctgggcccagtctcgccctgactcacgcctccctccgcgtccgggtctccgtggacacgtcagtcaccatctcctgctactggactccggctacgtggtacgttcggttcgttttgtctatcgtcctccgtacgtaccgagcgtacgaccaccgacggaaccgaaaccggacccctaacgtccgttacttagagaaccgtcctacggtaacggcccgtacccgtacggacggtaccttacccggtagttacgttcccgtacgtttccgtaccgtcgggtaccccgttacggtcgttccgggtaccggaacccgtaaaccggtccccggtacccgttacccgtacggtacccgttcgtacgtccggtacccgcggtacgggtacctacggtaaacggtggttaccggcgttacgttagttaaacgtttaacgttcctaggacccgtagtccctttaggaacttacggtaccgcgaacccggtacccaaactccggtttaagttcccggtaaacgggttccgggaagttcccggggtaaccggttcccggttaaccggtaacccggtttcccgggtaacgtacccggtaacccggaccccgtaacccggaccctaaccccgttcgttaaccggtcccg

SEQ ID NO: 129566 - DNA, 678 bp, Homo sapiens
  misc_feature: GYAE6OF01BACSC.35.18.B07.1.454.CMB.1.raw
  modified_base (186)..(186): a, c, t, g, unknown or other
  misc_feature (186)..(186): n is a, c, g, or t
  modified_base (228)..(228): a, c, t, g, unknown or other
  misc_feature (228)..(228): n is a, c, g, or t
tcagtacagatcgtcacgaccggtgctcgatttagtcgctgcgtaaaggaggaacggggcgacggagtcagtctcagtcaggacaccacgcatggacagtcgaggctcccgcgtcacgctcctgggctcctgcgtactctggctccgaggtgccgagtactgtgtactatccagtagtcgaacccngtactcctacgccgtaccctgtccctacgcatctgtcggaanacgagtcgtccaccagtccacgtcgccggtcaagtcgacgaccagttcgcgtactactttaaatggtactccgccagacgtccaggtacgacctccctaacgtctgagtctagtacgtgtatacttactttgctatacttcgcgtcccaagtcgtaacgttcaggtcggtacgtaggttcggtaacgtccggtagggaaccgtaagttaacgtttccaaccgttacccgtaccgtaaccgtaactaaccgaaaacctaacgttacctaacccgtaaccccgttacggtaaccgttacctttacgtacccttaacccgtttacttaccgttacgtaaccgtaaaccgtacgtaaccgttaacgaccgggtaccccgtagttaccgtaccgtttcccggaccgttccggaaccactacggcctactacaccgtaacgtctagcgtactgacc

SEQ ID NO: 129567 - DNA, 640 bp, Homo sapiens
  misc_feature: GYAE6OF01C08RF.35.18.B07.1.454.CMB.1.raw
  modified_base (109)..(109): a, c, t, g, unknown or other
  misc_feature (109)..(109): n is a, c, g, or t
  modified_base (246)..(246): a, c, t, g, unknown or other
  misc_feature (246)..(246): n is a, c, g, or t
tcagtacagatcgtcacgaccggtgctcgatttagtcgctgcgtaaaggaggaaagggggcaggagtcagtctcagtcaggacacagcatggacatgaggcctccccgntcagctccgtggggctcctgctactctggctccgaggtcgccagatgtgacactccagatcgacccagtcctccacgtcccttccctgtcctgcctatccgtgcggagacagactcaccatcacgttcggaccgganaacgtcacgacctagttcgacgttacttaatttaagtggtatcgaccaggacgccgaaggacaaccgcccctaatcagtactgtatactgtattctactttgacttatgtccgacgtaccagtacgtaagttcaggtgacgtacggtgacgtttcggaagggactaaggttactttcctacctacttaacccactaactaaccaaacttaactaactaaaccgtaacgtacgtaacgttactttacgaacttaaccttacgtactaacgtacaaacgtactaaccgtacgacccggtacctacgttacgttacccgtccggtacccgacggtaaccacttacggtccttaacgtaaccgtaccgtaaacgttcgtacggtcgtcgtacgtaccc

SEQ ID NO: 129568 - DNA, 841 bp, Homo sapiens
  misc_feature: GYAE6OF01A0TO2.35.18.B07.1.454.CMB.1.raw
  modified_base (133)..(133): a, c, t, g, unknown or other
  misc_feature (133)..(133): n is a, c, g, or t
  modified_base (148)..(148): a, c, t, g, unknown or other
  misc_feature (148)..(148): n is a, c, g, or t
tcagtacagatcgtcacgaccggtgctcgatttagtcgctgcgtaaagggagaaagggggcaggagtcagtctcagtcaggacacagcatggacatgaggcctccccgctcagctccgtgggctcctgctacnctggctccgaggtcnccagatgtgacactccagatacgacccatcctaccacgtcccttccctgtctcgcgtacttcgtggacggagaccaggtactacaaccgtatccgaacgttcggccgggacaacgtacaacgtacctacgttcgtaccgtttaatttaagtttaaagttcggtacctccgaccgtaaggaccggtaccggaagggtaaaccaaacccgtacccccgttaaaaccgtacgttacggtaacttacggttaaaccgttatacggtttaaacctttacgttttaacgttttacaacctttaagttaccgtttaccggtacccgttacccgttaacttaaacgggtaccgttacgtacggtaggacttagggttacggcgttacgacgggtaacgtacgttactttaccgaaccttcctaaccgtaactaaacgtaacctaaaactaaactaaccctaaacgtaacgtaacgtaaacttacgttaacgtaaaccctttaactaaccgttacttaccggtaacctaaacggtaaccgttaaaccgttaccggaaccgttaccccgttacgtttaacccctacggtttttaaccccggacccggttaaaccggtaaaccctacgttaacccgtcctttaaaccgggaaaccttaaccccgtaaacgttaacgtaggttacccgaccgtacgttaaacccg

SEQ ID NO: 129569 - DNA, 532 bp, Homo sapiens
  misc_feature: GYAE6OF02GWPRI.35.18.B07.1.454.CMB.1.raw
  modified_base (447)..(447): a, c, t, g, unknown or other
  misc_feature (447)..(447): n is a, c, g, or t
tcagtacagatcgtcacgaccggtgctcgatttagtcgctgcgtaaaggagtaaagggggcaaggagtccagtctcagtccaggacacagcatggacatgaggctcccgctcagctcctgggctcctgctactctggctccgaggtgcccagatgtgacatccagatgacccagtctccagcctcccgtgtctggccagtcctgtcggagacagagtcaccatcacttgccggcaagtccagaccattcgcgtctagtttaatggtactcgccaggagccgaggagacgccccgtaactctgatgtatactgtactcttacttgactattatcgacggtccagtctaaggttcaggtgcagtggatcgtagggacagtactttcactctacaccatacaactatactaccaactgaagtactttgactaacttactactgtacaacngtacttacgacggccctagttcctacgttcggcctgggacctacgtagtccaattctaccaacgtactcggtacgtccgtgaccg

SEQ ID NO: 129570 - DNA, 586 bp, Homo sapiens
  misc_feature: GYAE6OF02F74AG.35.18.B07.1.454.CMB.1.raw
tcagtacagatcgtcacgaccggtgctcgatttagtcgctgcgtaaaggaggaaagggggcaggagtcagtctcagtcaggacacagcatggacatgaggctccccgctcagctcctggggctcctgctactctggctccgaggtgccagatgtgacatccagatgacccagtctccagcctccctgtctgcatctgtcggagacagagtcaccatcacttgccgggcaagtcagaccattcgcgtctatttaaatggtatcgccagaggccagggagaacgcccctaactactgatgtatactgtactctactttgctattatgcggtccatcaaggttcagtgcaggtggatcgtgggacagtatttcacttctccaacctataccaaactaataacttaaccaaaccgttagaaacgtacctttagacctaaactttaaccgtataggtaccaaacgtacgtactttaaccgacgggtacccctaatttacccacgtttccggacccgttagggaaccctactaacgtccctaagttaacctacccgaaacggtaaccgttcggtacggtacctcggtaaccc

SEQ ID NO: 129571 - DNA, 782 bp, Homo sapiens
  misc_feature: GYAE6OF02H0CNB.35.18.B07.1.454.CMB.1.raw
  modified_base (246)..(246): a, c, t, g, unknown or other
  misc_feature (246)..(246): n is a, c, g, or t
tcagtacagatcgtcacgaccggtgctcgatttagtcgctgcgtaaaggtaggaaagggggcaggagtcagtctcagtcaggacacagcatggacatgaggcctcccgctcagctccgtgggctcctgctactctgctccgaggtgccagatgtgacatccagatcgaccagtcctccacgccctccctgtctgcactcgttggacggagacaggtacgtcaacctatcacgttcggcccgggganaacgtcacggaaccctagtttaccggacgttaactttaagtttaaacgttcgggtacttaccggacctaaggaccggaccgaaagggaacgtaacccggtaccccccttaaacgtacgttacgtaacgttacggttaaacctaccgttacggttaactttcccgtttaaacgtttccggaactttaaacggtttaccgttccgggtaccccgggtttacccaaagtttacccggtaaacgggttttccaacggggttcgaacgtaacgggttggtaccgttagggtaaccgggtactacggtacttttaccaccgtttacccgtactaaccgtaactaacgaaacgtacttaacgtaaccgtaaccgttagtaacgtttacctttacgaactaacctttagacgttaccgtaactaaaccgtacgttaactacccggtacggtaaccctcgttaccgtaccttacccgggaccgttacggaaccctacgtccgtaacctactaccggttaccaaggtaactgaccgtctacacccg

SEQ ID NO: 129572 - DNA, 1006 bp, Homo sapiens
  misc_feature: GYAE6OF02GJE1I.35.18.B07.1.454.CMB.1.raw
  modified_base (201)..(201): a, c, t, g, unknown or other
  misc_feature (201)..(201): n is a, c, g, or t
  modified_base (212)..(212): a, c, t, g, unknown or other
  misc_feature (212)..(212): n is a, c, g, or t
tcagtacagatcgtcacgaccggtgctcgatttagtcgctgcgtaaaagggagaaagggggcaggagtcagtctcagtcaggacacagcatggacatgaggctccccgctcagctcctggggctcctgctactctggcctccggaggtcgccagatgtgacatccaagatcgacccagtcctccagccctccctgtctgcntgtcgacgganacgagacgtaccaaccacttaccgtacgttcggccggacaacgtcgaacgtaccctacgttccgacgttacttaaagttttaaacgttggtactccgaccgaggacggaccgagggaacgaacccgtaccccttaacctacttgaacgtttagtacttactagttacttctttaacgttcgtacctaagtttacgttacggtacccgtactacgttacggtaccggttagacggttagggtacgtagggttacgggtaactttcggggtaaccgggtaacgtttaacggttacttttaaccccgttaccgtttaccccgtaaaccccgttaaccccgttaaaaccgttaaacccgtaaaacccttttaaaaccttaaaacccggtaaacccccgtttaaaaccgttaacgggtttaaaaccggttttaccccgtttaaacgggtttaaccccttttaaaacccgtttttaaaccccggtttaaccgttaaacccggttttaaacctaaaaccccggttttaaaccggtttaaaacccccgtaaccgggttttaaaacccccggggttaccccccttttaaacgggttttttaaaccccggttaccccccgggtttttacccccggggttaaccccggtttaaacccgggtaaaacccccggtttaacccgtaaccccgggtttaaaaccccgttccggttttaaaaccccctaaaacccccggttttaaacccggggtaacccggtttttaaaccgggggtaccccgtacgttacccccggggttaaaccccgg

SEQ ID NO: 129573 - DNA, 210 bp, Homo sapiens
  misc_feature: GYAE6OF01BNHHT.49.52.E08.1.454.CMB.1.raw
  modified_base (209)..(210): a, c, t, g, unknown or other
  misc_feature (209)..(210): n is a, c, g, or t
tcagagtcgagagacacgaccggtgctcgatttagtcgagctctctcggggcacgaccggtgctcgatttagagagagtgtgttgggtttgggggaagaggaagactgacggtcccccaggagttcaggtgctgggcacagcggccctgggctgcctgtcaaggactacttcctctctcgactctgagcgggctggcaaggcgcatagnn

SEQ ID NO: 129574 - DNA, 164 bp, Homo sapiens
  misc_feature: GYAE6OF01CLZUS.49.52.E08.1.454.CMB.1.raw
  modified_base (164)..(164): a, c, t, g, unknown or other
  misc_feature (164)..(164): n is a, c, g, or t
tcagagtcgagagacacgaccggtgctcgatttagtcgagctctctcggcgggcacgaccggtgctcgatttagtcacgcgagaaagggaaggggctggccctgacgtgttctgttcccaccctcctctctctcgactctgagcgggctggcaaggcgcatagn

SEQ ID NO: 129575 - DNA, 238 bp, Homo sapiens
  misc_feature: GYAE6OF01CBNAE.49.52.E08.1.454.CMB.1.raw
  modified_base (179)..(179): a, c, t, g, unknown or other
  misc_feature (179)..(179): n is a, c, g, or t
  modified_base (214)..(238): a, c, t, g, unknown or other
  misc_feature (214)..(238): n is a, c, g, or t
tcagagtcgagagacacgaccggtgctcgatttagtcgagctctcgtcgcgggcacgaccggtgctcgatttagagagagtgtgttgggtttgggggaagaggaagactgaccggtccccccaggagttcaggtgctgggcacagcggccctgggctgcctggtcaaggactacttccnctctcgactctgagcgggctggcaaggcgcatagnnnnnnnnnnnnnnnnnnnnnnnnn

SEQ ID NO: 129576 - DNA, 502 bp, Homo sapiens
  misc_feature: GYAE6OF01DA4MV.49.52.E08.1.454.CMB.1.raw
  modified_base (313)..(313): a, c, t, g, unknown or other
  misc_feature (313)..(313): n is a, c, g, or t
  modified_base (496)..(496): a, c, t, g, unknown or other
  misc_feature (496)..(496): n is a, c, g, or t
tcagagtcgagagacacgaccggtgctcgatttagtcgagctctcagagagaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctnagggatccctgagcgattctctggctcaggtcagggacaacggtcacattggccatcagtggagtccaggcagaggacgagggctgactattattgtcaatcaaacagacaccattggtacttatgtcttcggaactgcgaccaaggtcaccgtcctgggtcacgcccaaggcccaaaccccntgtacc

SEQ ID NO: 129577 - DNA, 488 bp, Homo sapiens
  misc_feature: GYAE6OF01BWT9P.49.52.E08.1.454.CMB.1.raw
  modified_base (484)..(484): a, c, t, g, unknown or other
  misc_feature (484)..(484): n is a, c, g, or t
tcagagtcgagagacacgaccggtgctcgatttagtcgagctctcagagagaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttggaactgcgaccagtcacgtctggtcagcccaaggccacccntgtc

SEQ ID NO: 129578 - DNA, 563 bp, Homo sapiens
  misc_feature: GYAE6OF01D0KM5.49.52.E08.1.454.CMB.1.raw
  modified_base (235)..(235): a, c, t, g, unknown or other
  misc_feature (235)..(235): n is a, c, g, or t
  modified_base (259)..(259): a, c, t, g, unknown or other
  misc_feature (259)..(259): n is a, c, g, or t
  modified_base (336)..(336): a, c, t, g, unknown or other
  misc_feature (336)..(336): n is a, c, g, or t
tcagagtcgagagacacgaccggtgctcgatttagtcgagctctcagagaggaaaggggtgggtccaggaggcagaactctgggtgtctcaccattggcctggatccctctacttctccccctcctcactctctgcacaggctctcgaggccctcctatgacgctgacacagcccacccgtcggtgtcgagtcgtcccccaggaaccagaccggccaggatccaacctgccttcnggagactgcaattgaccaaaccgntatgcttattggtaaccagcagaacgccggcaggcccctgtgttggtgatgtataaacggcacgtgagacggccctnagggactccctgacggcgattcgtctggctccgaaggtcagggaccaacggtcactattcggccatcgagtgagtccaggcagaggacgagctgactattatgtacaatacaacagacaccgtattggtacttaagtgtcttacggaactgacgtaaccgaacggttcgacccggttcgtacgggtccaacgtacccgaacggcccaaaccccctgtcgtaaccccg

SEQ ID NO: 129579 - DNA, 239 bp, Homo sapiens
  misc_feature: GYAE6OF01C82MS.49.52.E08.1.454.CMB.1.raw
  modified_base (215)..(239): a, c, t, g, unknown or other
  misc_feature (215)..(239): n is a, c, g, or t
tcagagtcgagagacacgaccggtgctcgatttagtcgagctctctcggcgggcacgaccggtgctcgatttagagagagtgtgttgggtttcgggggaagaggaagactgacgggtccccccaggagttcaggtgctgggcacagcggccctgggctgcctggtcaaggactacttcctctctcgactctgagcgggctggcaaggcgcatagnnnnnnnnnnnnnnnnnnnnnnnnn

SEQ ID NO: 129580 - DNA, 500 bp, Homo sapiens
  misc_feature: GYAE6OF01D702O.49.52.E08.1.454.CMB.1.raw
  modified_base (471)..(471): a, c, t, g, unknown or other
  misc_feature (471)..(471): n is a, c, g, or t
  modified_base (494)..(494): a, c, t, g, unknown or other
  misc_feature (494)..(494): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtccngggtcagcccaaggccaaccccntgtacc

SEQ ID NO: 129581 - DNA, 239 bp, Homo sapiens
  misc_feature: GYAE6OF01DALG1.49.52.E08.1.454.CMB.1.raw
  modified_base (216)..(239): a, c, t, g, unknown or other
  misc_feature (216)..(239): n is a, c, g, or t
tcagagtcgagagacacgaccggtgctcgatttagtcgagctctctcggtcggggcacgaccggtgctcgatttagagagagtgtggttgggtttgggggaagaggaagactgacggtcccccaggagttcaggtgctgggcacagcggccctgggctgccgtggtcaaggactacttcctctctcgactctgagcgggctggcaaggcgcatagnnnnnnnnnnnnnnnnnnnnnnnn

SEQ ID NO: 129582 - DNA, 653 bp, Homo sapiens
  misc_feature: GYAE6OF01CBB53.49.52.E08.1.454.CMB.1.raw
  modified_base (237)..(237): a, c, t, g, unknown or other
  misc_feature (237)..(237): n is a, c, g, or t
tcagagtcgagagacacgaccggtgctcgatttagtcgagctctctcgggcgggggggtcacaacgaacggcgagcgctctcgggacgtctccaccagtcggcctggctctgcctggctcctcactctcctcacgtcaggacacgagggtcctgggcccagtctgccctgactcagccctgcctccgtgtcctcgggtctcctggacagtcgatcgacatctactgcactgaaaccngcgagtgatggttaggaattataactttctctgtacaactacaccaggacaacgaccccaaaatacgaactacctaatttactaggaacggtcccgatcgaacggccggtaccctacgtaacggggttcctacgtcggtaactcgtccttacgtcgtacggtctaccgacgtctcgggcacgtctaccggtcctcccgagacctagtcctacgtcgggctccggaaggccggtacggggacaacgggtcttagtagtttattaacgttgtactttagtactaagtagtcggtacggtagtacgttacggtcgggtaccgtaagggttcggttaccgggcggggtaacggggaccgtaaagggtcgaaccggtcgtacgggtactaccggaccgtaggcctccggcccgtggtaccc

SEQ ID NO: 129583 - DNA, 507 bp, Homo sapiens
  misc_feature: GYAE6OF01AS4W7.49.52.E08.1.454.CMB.1.raw
tcagagtcgagagacacgaccggtgctcgatttagtcgagctctctcgagggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaactcatcatttatgaggccgatcagcggccctcgagggtctctgatcgcttctctggctccacgtctggcagcacggcctcctgacatctctgggctcaggctggggacaggctgattattattgctgttcatatgccgtgataggtggccgaagggtgttcggcggagggacgaaaggtgaccggtctaggtcacgcccgaaggcctcgcccccgtggtcc

SEQ ID NO: 129584 - DNA, 183 bp, Homo sapiens
  misc_feature: GYAE6OF01BZMC1.49.52.E08.1.454.CMB.1.raw
  modified_base (167)..(183): a, c, t, g, unknown or other
  misc_feature (167)..(183): n is a, c, g, or t
tcagagtcgagagacacgaccggtgctcgatttagtcgagctctctcggcgggcgacgaccggtgctcgatttagtcacgcgagaaagggaaggggctggccctgacgtgtttcctgttcccgccctcctctctctcgactctgagcgggctggcaaggcgcatagnnnnnnnnnnnnnnnnn

SEQ ID NO: 129585 - DNA, 496 bp, Homo sapiens
  misc_feature: GYAE6OF01CA1OC.49.52.E08.1.454.CMB.1.raw
  modified_base (468)..(468): a, c, t, g, unknown or other
  misc_feature (468)..(468): n is a, c, g, or t
  modified_base (491)..(491): a, c, t, g, unknown or other
  misc_feature (491)..(491): n is a, c, g, or t
tcagagtcgagagacacgaccggtgctcgatttagtcgagctctcagagagaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggccccctgtgttggtgatgtataaagacactgagaggccctcagggatccctgagcgattctctggctccaggtcagggacaacggtcacattggccatcagtggagtccaggcagaggacgaggctgactattattgtcaatcaacagacacctattggtacttatgtcttcggactgcgaccaggtcaccgtcngggtcacgcccaggcccaacccntgtcc

SEQ ID NO: 129586 - DNA, 189 bp, Homo sapiens
  misc_feature: GYAE6OF01APUHD.49.52.E08.1.454.CMB.1.raw
  modified_base (166)..(189): a, c, t, g, unknown or other
  misc_feature (166)..(189): n is a, c, g, or t
tcagagtcgagagacacgaccggtgctcgatttagtcgagctctctcggcgggcacgaccggtgctcgatttagtcacgcgagtaaagggaaggggctggccctgacgtgttctgttcccgccctcctctctcgtcgactctgagcgggctgggcaaggcgcatgnnnnnnnnnnnnnnnnnnnnnnnn

SEQ ID NO: 129587 - DNA, 345 bp, Homo sapiens
  misc_feature: GYAE6OF01DITPE.49.52.E08.1.454.CMB.1.raw
  modified_base (272)..(272): a, c, t, g, unknown or other
  misc_feature (272)..(272): n is a, c, g, or t
  modified_base (274)..(274): a, c, t, g, unknown or other
  misc_feature (274)..(274): n is a, c, g, or t
  modified_base (276)..(345): a, c, t, g, unknown or other
  misc_feature (276)..(345): n is a, c, g, or t
tcagagtcgagagacacgaccggtgctcgatttagtcgagctctcgtacggccgggacacgacccggtgcgtcgatttacgctctacgctcagggcacgaccggtgctcgatttagaggagagtgtgtttgggtttggggggaagaggaagactgacggtccccccagggacgttcacggtgctgggcacagcggccctgggctgcctgggtcaaggactacttcctcgtctcgactctggagccgggctgggcaagggtccgcgtaatagncntnnnnnnnnnnnnnnnnnnnnnnnnnnnnnnnnnnnnnnnnnnnnnnnnnnnnnnnnnnnnnnnnnnnnnn

SEQ ID NO: 129588 - DNA, 504 bp, Homo sapiens
  misc_feature: GYAE6OF01BSMGB.49.52.E08.1.454.CMB.1.raw
  modified_base (475)..(475): a, c, t, g, unknown or other
  misc_feature (475)..(475): n is a, c, g, or t
  modified_base (498)..(498): a, c, t, g, unknown or other
  misc_feature (498)..(498): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccacggcccctgtgttggtgatgtataaagacactgagaggccctcagggactccctgagcgattctctggctccaggtcaggggacaacggtcactatggccatcagtggagtccaggcagaggacgaggctgactattattgtcaatcaacagacacctattggtaacttatgttcttcggaactgcgaccgagtcaccgtccnggtcacgcccaaggcccaacccntcgtcc

SEQ ID NO: 129589 - DNA, 182 bp, Homo sapiens
  misc_feature: GYAE6OF01B1PAI.49.52.E08.1.454.CMB.1.raw
  modified_base (169)..(182): a, c, t, g, unknown or other
  misc_feature (169)..(182): n is a, c, g, or t
tcagagtcgagagacacgaccggtgctcgatttagtcgagctctcgtctcgcgggcacgaccggtgctcgatttagtcacgcgagaaagggaaaggggctggccctgacgtgtttctgttcccaccctcctctctctcgactctgagcgggctggccaaggcgcatagnnnnnnnnnnnnnn

SEQ ID NO: 129590 - DNA, 489 bp, Homo sapiens
  misc_feature: GYAE6OF01CNLLF.49.52.E08.1.454.CMB.1.raw
  modified_base (433)..(433): a, c, t, g, unknown or other
  misc_feature (433)..(433): n is a, c, g, or t
  modified_base (455)..(455): a, c, t, g, unknown or other
  misc_feature (455)..(455): n is a, c, g, or t
  modified_base (481)..(481): a, c, t, g, unknown or other
  misc_feature (481)..(481): n is a, c, g, or t
tcagagtcgagagacacgaccggtgctcgatttagtcgagctctcagagagaaagggggtgggtccaggaggcagaactctgggtgtctcaccatggcctggatccctctacttcctccccctcctcactctctgcacagactctgaggcctcctatgagctgacacagcccaccctcggtgtctgtgtcctcaggacagacggccagtatcacctgctctggagatgcattgccaaaagcaatatgcttactggtaccagcagaagccaggccaggcccctgtcttgatcatttataaagactttgagagggcctcgagggacccctgagcgattctctggctccagctcagcgacaacagtcacgttgaccatcagtggagtccgggcaggaggacgaggctgactatactgtcagtcatcagacagtagngctacttctgtcgtagttcggnggagggccagctgaccgtctaggtcngcccacgg

SEQ ID NO: 129591 - DNA, 541 bp, Homo sapiens
  misc_feature: GYAE6OF01AO9JI.49.52.E08.1.454.CMB.1.raw
  modified_base (531)..(531): a, c, t, g, unknown or other
  misc_feature (531)..(531): n is a, c, g, or t
tcagagtcgagagacacgaccggtgctcgatttagtcgagctctcagagagaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcgagggactcccgtgacgcgtattctctggctccgaggtcagggacaacgggtcacattcggccatcagtggagtccaggcaggaggacgaggctagactattattgtacaatcaacgacgacaacctatttacggtactttatgttacttacggaactcggacgaccgtaacggtcctaccggtccgtagggtcacgcccgaacggaccccaaccccncgtcgtaccc

SEQ ID NO: 129592 - DNA, 507 bp, Homo sapiens
  misc_feature: GYAE6OF01BL2Z3.49.52.E08.1.454.CMB.1.raw
  modified_base (314)..(314): a, c, t, g, unknown or other
  misc_feature (314)..(314): n is a, c, g, or t
  modified_base (499)..(499): a, c, t, g, unknown or other
  misc_feature (499)..(499): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctnagggatccctgagcgattctctggctccaggtcagggacaacggtcacattggccatcagtggagtccaggcagaggacgaggctgactattattgtcaatcaacagacacctattggtacttatgtcttcggaacttgacgaccaaggtcaccgtcctgggtcacgtcccaacggcccaacccnctcgtacc

SEQ ID NO: 129593 - DNA, 223 bp, Homo sapiens
  misc_feature: GYAE6OF01CS2T2.49.52.E08.1.454.CMB.1.raw
  modified_base (142)..(142): a, c, t, g, unknown or other
  misc_feature (142)..(142): n is a, c, g, or t
  modified_base (213)..(223): a, c, t, g, unknown or other
  misc_feature (213)..(223): n is a, c, g, or t
tcagagtcgagagacacgaccggtgctcgatttagtcgagctctctcggcgggcacgaccggtgctcgatttagagagagtgtgttgggttgggggaagaggaagactgaccggtccccccaggagttcaggtgctgggcanagcggccctgggctgcctggtcaaggactacttcctcgtagcactctgagcgggctggcaaggcgcatagnnnnnnnnnnn

SEQ ID NO: 129594 - DNA, 213 bp, Homo sapiens
  misc_feature: GYAE6OF01DKYWN.49.52.E08.1.454.CMB.1.raw
  modified_base (213)..(213): a, c, t, g, unknown or other
  misc_feature (213)..(213): n is a, c, g, or t
tcagagtcgagagacacgaccggtgctcgatttagtcgagctctcagagagaaagggggtgggtccaggaggcagaactctgggtgtctcaccatggcctggatccctctacttctcccctcctcactctctgcacaggctctgaggcctcctatgagctgacacagccaccctctctctctcgactctgagcgggctggcaaggcgcatagn

SEQ ID NO: 129595 - DNA, 706 bp, Homo sapiens
  misc_feature: GYAE6OF01C0F76.49.52.E08.1.454.CMB.1.raw
  modified_base (226)..(226): a, c, t, g, unknown or other
  misc_feature (226)..(226): n is a, c, g, or t
  modified_base (257)..(257): a, c, t, g, unknown or other
  misc_feature (257)..(257): n is a, c, g, or t
  modified_base (303)..(303): a, c, t, g, unknown or other
  misc_feature (303)..(303): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcaccatctcctgcactgaaaccngcagtgatggttggaattattaaccttttcnctggtaaccaacaaccaccagacaacgaccccaaatcatctattangacgccgatcacgccgcctcgagggtctcgtgtactcgtcttctcgtcggcctcccgacgttcgtggaccacggccgtacccggtccctacccgtacgtaactaacttcgtaccggttcgggtaccctaccccggtagggtacccgggttacggggggaaccggtacgggtactttaacgggtaattttaacgtttagtttcgtactttacgttaccgtagttaacggttcgggtacccgggtagtaacggttacggggtaccgggtaccggggttaaggggttcggttaccggggacggggtaaccgggaaccggtaacggggttcgacccggttaccgtacgggtacccgtaacggaccccggtaacggcccgttccccggtcccccgttcggttaccccg

SEQ ID NO: 129596 - DNA, 579 bp, Homo sapiens
  misc_feature: GYAE6OF01EIPRA.49.52.E08.1.454.CMB.1.raw
tcagagtcgagagacacgaccggtgctcgatttagtcgagctctctcggcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacaccaggacaaacgccccaaactcatcatttatgaggccgatcagccggccctcgaggggtctcgtgatcgcttctcgtggcctccacgtctggcagccgaccggccctcccgtagaacctaatcctcgtcgggctccgaggcgtggggacgaggctagtatttattagttgcttgttcattagtcggccggtagtagtaggtcgggaccggtaagggttggtcgggcgggaaggggaccggtaagggtcggtacccggtccgtagggtcgaacggtcccgaaggtccgtccggtcccccgtcggtaccc

SEQ ID NO: 129597 - DNA, 516 bp, Homo sapiens
  misc_feature: GYAE6OF01CRWW3.49.52.E08.1.454.CMB.1.raw
  modified_base (508)..(508): a, c, t, g, unknown or other
  misc_feature (508)..(508): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccggccaggcccctgtgttggtgatgtataaagacactgagaggccctcagggactccctgagcgattctctggctccgaggtcaggggacaacggtcactagttggccatcaggtggacgtccgaggcaggaggacgaggctgactattattgtacaatcaacagacacctattgtacttatcgtacttcgaactgcgaacctaaggtcacccgtctgggtcacgacccaaggcccaaccccntcgtaccc

SEQ ID NO: 129598 - DNA, 528 bp, Homo sapiens
  misc_feature: GYAE6OF01AC8ZN.49.52.E08.1.454.CMB.1.raw
  modified_base (520)..(520): a, c, t, g, unknown or other
  misc_feature (520)..(520): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaacgatatgctattggtaccagcagaagccgggccaggcccctgtgttggtgatgtataaagacactgagaggccctcgagggatccctgagcgtattctctggctccaggtcagggacaacggtcacagttggccatcaggtggagtccaggcaggaggacgaggctgactattattgtacaatcaacagaaccacctattggtaacttatgttacttcggaactgacgaacctaggtccaccggttccgtgggtaccacggtaccccaaggacccaaaccccntcgtaccc

SEQ ID NO: 129599 - DNA, 981 bp, Homo sapiens
  misc_feature: GYAE6OF01BFU68.49.52.E08.1.454.CMB.1.raw
tcagagtcgagagacacgaccggtgctcgatttagtcgagctctctaggtaggagaaggggtggtccgaggaggcacgaactctagggtgtactcgaccgattcggccttgggatccctctacttctccccctcctacactctcgtgcaccaggcgtcttggacggtcctacctagtttcgaggtctcgtacttaacgaggtcctacccctcgggtgtccaagtgtccccgaggacacgacgggccgaggtactcggaccttgtcgtcctagggacgtagggttccgcaagttcgaccctaaacccggtattacgtcgtacgtttacgttacggtaccgtacgtaccgtaacggtaacggaaccggtaccgtaccgggtaccccgttggttcggtttacgggttacggttaacgtttaacgtaaacggttaccgtttacggaacgggtaccgggtacccggtaccggtaaccggggtaccccggttagggtaccggtaccgttaacgtttaccgttacgttaccggtaccgttaccgtacggtaccgttaacggtaaacgggttaaaccgtaaaccgttaacgttacccgtaacccgttaccggtaacccgtaacggttaaccgggtaaccggttaccgggtacccggtaccccgggtaacccggtaacgggtaaccgggaaccgggtaaccggtaaccgttaaccggttaacccgttaaacgtttaaccgttaccgttaacccgttaaccggttacccgttacgtaacggtaaccgtaaacggtaccgtaacggtacgggtaccgttaacgggtttacgttacgggttacggttacgggtaccgggtacgggtacgggtaaccgttaccggtaccggtttaccggtacccggttaccggtaaccgggtaacccggtaacccggtaccccggtaaccgggttacccggttccccgggttcccccgggttaccggtaccccg

SEQ ID NO: 129600 - DNA, 514 bp, Homo sapiens
  misc_feature: GYAE6OF01AIUUZ.49.52.E08.1.454.CMB.1.raw
  modified_base (223)..(223): a, c, t, g, unknown or other
  misc_feature (223)..(223): n is a, c, g, or t
  modified_base (507)..(507): a, c, t, g, unknown or other
  misc_feature (507)..(507): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgccaaaccgatatgcttattggtaccagcagaagccgggccaggcccctgtgttggtgatgtataaagacactgagaggccctcgagggatcccgtgagcgtattctctggctccgaggtcagggacaacggtcacgattcggccatcagtggagtccgaggcagaggacgaggctgactattattgtcaatcaacagacactattgtacttagtgtcttcggactgacgaccgtaggtccaccgtcgtgggtccacgacccaaggacccaaccccngtgtacc

SEQ ID NO: 129601 - DNA, 589 bp, Homo sapiens
  misc_feature: GYAE6OF01BQH57.49.52.E08.1.454.CMB.1.raw
  modified_base (305)..(305): a, c, t, g, unknown or other
  misc_feature (305)..(305): n is a, c, g, or t
  modified_base (368)..(368): a, c, t, g, unknown or other
  misc_feature (368)..(368): n is a, c, g, or t
tcagagtcgagagacacgaccggtgctcgatttagtcgagctctctcggcgggggggtcacaagaggcagcgctctcgggacgtctccaccatggccctggctctgctgctcctcactctcctcactcaggacacagggtcctgggcccagtctgccctgactcagcctgcctccgtgtctgggtctcctggacagtcgatcaccatctcctgcactgaaaccagcagtgatggttgggaattataaccttttctcctggtaccaaacaacacccacggacaaacgcccccaaatcatcatttangagcgatcagcgccctgagggtctgtgatcgcttctctggctccagtctgcagcacgcctccngacatctctcgggctccgaggtcgtggggacgaggtctaggatttatattgcttagtttcagttagtcggtccggtagtacgttaggtcgggtacgtaaaggggttcgttacgggacggtaggggacccgtaagggtccggtaacccggttcccgttaagggttccccaacgggtccccgtaaacgggtcccttccggccccccccgttgggttacccccg

SEQ ID NO: 129602 - DNA, 601 bp, Homo sapiens
  misc_feature: GYAE6OF01EFQJI.49.52.E08.1.454.CMB.1.raw
  modified_base (224)..(224): a, c, t, g, unknown or other
  misc_feature (224)..(224): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatgcattcgaccaaaaccgatatgtcttattcggtaaccagacaaggaacgccgggccacggcccctggttgttggtgatgtaataaagacacgtggagacggccctgagggactcccgtgacgcgtattctcgtggcctcgaggtcaagggacaacggtcacgtagttcggaccatcgaggtaggacgtccgaggcgaaggaggacggaggctagaacttattagttgtactaatacaaatacgaccaactagtttacggttacttagttcgttaccgttacggaacttcggaacgtaaccgtaacggttcccacccggttccgtagggtaccaccggtaccccgaaacgggacccccaaacccgtcgtcgtaccc

SEQ ID NO: 129603 - DNA, 540 bp, Homo sapiens
  misc_feature: GYAE6OF01EJWI7.49.52.E08.1.454.CMB.1.raw
  modified_base (240)..(240): a, c, t, g, unknown or other
  misc_feature (240)..(240): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgagcctcctatgagctgacacagccaccctcggtgtcagtgtccccaggacagacggccaggatcacctgctctggagatgcattgccaaaaccgntatgcttattggtaccagcagaagccggccaggcccctgtgttggtgatgtataaagacactgagaggccctgagggatccctgagcgattctctggctccaggtcagggacaacggtcacgtattggccatcaggtggagtccaggcaaggaggacgaggctgactattatgtacaatcaacagacacctattggtacttagtcgttcttacggaactggaccgaacctaagggtcccaccggtccgttagggtccaacggcccccgaaacggaccccaaacccccgtatccggtaccc

SEQ ID NO: 129604 - DNA, 678 bp, Homo sapiens
  misc_feature: GYAE6OF01C4TS5.49.52.E08.1.454.CMB.1.raw
  modified_base (185)..(185): a, c, t, g, unknown or other
  misc_feature (185)..(185): n is a, c, g, or t
  modified_base (245)..(245): a, c, t, g, unknown or other
  misc_feature (245)..(245): n is a, c, g, or t
  modified_base (298)..(298): a, c, t, g, unknown or other
  misc_feature (298)..(298): n is a, c, g, or t
  modified_base (303)..(303): a, c, t, g, unknown or other
  misc_feature (303)..(303): n is a, c, g, or t
tcagagtcgagagacacgaccggtgctcgatttagtcgagctctcagagagaaagggggtgggtccgagggaggcgagaaacgtctgggtgtctcaccatggcctggatccctctacttcctcccctcctcactctctgcacaggctctgaggcctcctatgagctgacacagccacccgtggtncagtcgcccaggacagacggccaggatcacctgctgaggatatgcattgacccaaaacgntatcgcttaattcggacaggacagaagccggcacggccctgtgttggtgagtntaaanaaacgacacgtagacgaccgccgtacgtacggtactccgtagacgtcgtacttcgtcgtacgcgtacgagggtacggaacgggaacgaacggtacaacgtacgtcgacctagtcggtaggtaggacgtaccgacggacgaagggaacgggaacggtacggtcgtaagtaactttaagtttaagttagtaacaaacgtaacaaacgtaaaccgaccctaaccgttagtttaacggttacttaagttccgttaaccggttaccggtaacgtaccggaaccggtaaacccgtaccggtacccgttacccggttcccggttacgggtacccgaacccggtaaccccgaaacccggaacccccaacccgtcgtccgtacc

SEQ ID NO: 129605 - DNA, 586 bp, Homo sapiens
  misc_feature: GYAE6OF01EAPVE.49.52.E08.1.454.CMB.1.raw
  modified_base (245)..(245): a, c, t, g, unknown or other
  misc_feature (245)..(245): n is a, c, g, or t
  modified_base (293)..(293): a, c, t, g, unknown or other
  misc_feature (293)..(293): n is a, c, g, or t
tcagagtcgagagacacgaccggtgctcgatttagtcgagctctcagagagaaagggggtgggtccaggaggcagaactctgggtgtctcaccatggcctggatccctctacttcctccccctcctcactctctgcacaggctctgaggcctcctatgagctgacacagcccaccctcggtgtcagtcgtccccaggacagacggccaggatcacctgctctggagatgcattgaccaaaaccgntatgcttattggtaccagcagaagccgggccaggcccctgtgtggtgntgtataaagacactggagagccctacagggactccctgacgcgtaattcgtctggctccgaggtcgaggggacaacgggtcacattcggccatccgaggtggacgtccgaggcgagagggacgaggctgacttattattgtacaatcaaactacgaacaccctagtttacggtaactttagtagttcttcggtaaacttcgaccgtaacccgaacgggttcccaccggttcccgttaggggtaccaccggtacccgaaaccgggccccaaaccccgtaccgtcggttaccccg

SEQ ID NO: 129606 - DNA, 587 bp, Homo sapiens
  misc_feature: GYAE6OF01EE4S4.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgtcttattggtaccagcagaagccggccacggcccctgtgttggtgatgtaataaagacactgagacggccctacgagggactcccgtggacgcgtatttctcgtcggcctccgagggtccaaggggaccgaacggtcaacgtagttcggacctatcgaggtggacgtccgagggcaaggaggacggaggctagacttattattgtacaatacaacagaccactagtttacgtaacttagtcgttacgttacggtaactcggaccgaacgtaacggtcctaaccggtccgtacgggtaccaacggtacccccgaacggacccccaaacccctcgtccgtaccc

SEQ ID NO: 129607 - DNA, 490 bp, Homo sapiens
  misc_feature: GYAE6OF01BG3TK.49.52.E08.1.454.CMB.1.raw
  modified_base (485)..(485): a, c, t, g, unknown or other
  misc_feature (485)..(485): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggcaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacacattgtacttatgtcttcggactgcgaccaggtcaccgtctggtcagcccaagcccaacccntgtcc

SEQ ID NO: 129608 - DNA, 586 bp, Homo sapiens
  misc_feature: GYAE6OF01BR37A.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctggagatgcattgaccaaaccgatatgcttattggtaccagcagaacgccggccaggcccctgtgttggtgatgtataaagacacgtgagacggccctagagggactcccgtgacgcgtattctcgtggctccgaggtcgagggacaacggtcaactagttcggacctagtcgaggtggacgtccgaggacaggacggacgaggctagacttattatgtacaatacaaacacgaacacctagtttacgttacttagtacgttaccgttacggaacttcggaccgtaaccgaacggttcccaccggttcccgtacgggtaccaaccggtaccccgaaacgggacccccaaaccccgtcgtcggtaccc

SEQ ID NO: 129609 - DNA, 671 bp, Homo sapiens
  misc_feature: GYAE6OF01CWK3W.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcactgctctggagatgcattcgaccaaaacgatatgcttattggtaccagcagaagccggccacggcccctgtgttggtgatgtaataaagacacgtgagacggccctacgagggactcccgtgacgcgtattcctcgtggtcctccgtaggtcgaaggggaccaaacgggtcaactagttcgggacctagtacgtaggtcgggaacgtcccgagggaccgaagggaacgggacggaacgggtcgtaggtaaaccttaagtttaagttacgtaacgtaaactaccgaaactacgaacctaacccgtaagtttaacggttaactttaaggttcggttaccgtttacggtaaaccgtcggaacccggtaacccgtaaacggtacctaccccgggttccgtacgggggttaccaaccggtaccccgaaacgggaccccctaaacccccgtcgtaccggttaccc

SEQ ID NO: 129610 - DNA, 521 bp, Homo sapiens
  misc_feature: GYAE6OF01BEMDN.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccggccaggcccctgtgttggtgatgtataaagacactgagaggccctcgagggactccctgagcgattctctggctccgaggtcagggacaacggtcacattcggccatcgagtggagtccaggcagaggacgaggctgactattattgtcaatcaacagacacctattggtacttatgtcttcggaactgacgaccgtaaggtccaccggtcctcgggtacacggcccaacggaccccaacccctctcgtacccg

SEQ ID NO: 129611 - DNA, 558 bp, Homo sapiens
  misc_feature: GYAE6OF01A142J.49.52.E08.1.454.CMB.1.raw
  modified_base (242)..(242): a, c, t, g, unknown or other
  misc_feature (242)..(242): n is a, c, g, or t
  modified_base (549)..(549): a, c, t, g, unknown or other
  misc_feature (549)..(549): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaaccgntatgtcttattggtaccagcagaagccggccacggcccctgtgttggtgatgtaataaagacactgagacgccctgacggactcccgtgagcgtattctcgtggctccgaggtcgagggaccaacggtcacgtagtcggaccatcgagtggacgtccgaggcgaggaggacgaggctagacttagttattgtacaatcaacacgaccactagttcgttacttatgtcgttacggaactcgaccgtaccgtaacggtcctaccggtcccgtcggtaccgaccgaccccgaacggaccccaaccccgtntccgtaccc

SEQ ID NO: 129612 - DNA, 551 bp, Homo sapiens
  misc_feature: GYAE6OF01ERL8A.49.52.E08.1.454.CMB.1.raw
  modified_base (187)..(187): a, c, t, g, unknown or other
  misc_feature (187)..(187): n is a, c, g, or t
  modified_base (252)..(252): a, c, t, g, unknown or other
  misc_feature (252)..(252): n is a, c, g, or t
  modified_base (300)..(300): a, c, t, g, unknown or other
  misc_feature (300)..(300): n is a, c, g, or t
  modified_base (355)..(355): a, c, t, g, unknown or other
  misc_feature (355)..(355): n is a, c, g, or t
  modified_base (545)..(545): a, c, t, g, unknown or other
  misc_feature (545)..(545): n is a, c, g, or t
tcagagtcgagagacacgaccggtgctcgatttagtcgagctctcaggtaggaggaaagggggtgggtccgaggaggcagaactctgggtgtctcaccatggcctggactccctctacttctccccctctcactctctgcacaggctctggaggcctcctatgagctgacacagcccaccctcggtntcagtcgtccccaggacagacggccaggatcacctgctcgtggagatgcattcgacctaaaacgntatgacttattggtaccagcagaacgccggccaggcccctgtgttggngatgtaataagaccactgagacggccctcgacgggtactcccgtgagcgaattcncgtggctccgaggtcagggacaacgggtcacagttcggcctagtcgagttgggagtcccgaaggcaggaggacgaggctagacttattattcgtacaatcaacagacaccttagttcggtaacttagcgttctcggtaactgacgtaccaaggtccaccggtcctgggccacgcccacgacccaaccctnctaccc

SEQ ID NO: 129613 - DNA, 553 bp, Homo sapiens
  misc_feature: GYAE6OF01C95LR.49.52.E08.1.454.CMB.1.raw
  modified_base (413)..(413): a, c, t, g, unknown or other
  misc_feature (413)..(413): n is a, c, g, or t
tcagagtcgagagacacgaccggtgctcgatttagtcgagctctcagagagaaagggggtgggtccaggaggcagaactctgggtgtctcaccatggcctggatccctctacttcctccccctcctcactctctgcacaggctctgaggcctcctatgagctgacacagccaccctcggtgtcagtcgtccccaggacagacggccaggatcacctgctctggagatgcattgaccaaaccgatatgcttattggtaccagcagaagccgggccaggcccctgtgttggtgatgtataaagacactgagaggccctcgagggactcccgtgacgcgtattctcgtggctccgaggtcgacgggacaacggtcacagttcggcatcagtggacgtcccgaggcaaggaggacgnggctgactattattgtacaatcaaacacgacacctattcggtactttatgtacgttcggtaatcggacgaccgtaacggtcccaccggttccgtacgggtccacgtaccccgaacggtccccaaacccctcgtcgtaccc

SEQ ID NO: 129614 - DNA, 184 bp, Homo sapiens
  misc_feature: GYAE6OF01DVTQ5.49.52.E08.1.454.CMB.1.raw
  modified_base (168)..(184): a, c, t, g, unknown or other
  misc_feature (168)..(184): n is a, c, g, or t
tcagagtcgagagacacgaccggtgctcgatttagtcgagctctctcggcgggcgacggaccggtgctcgatttagtcacgcgagaagggaagggggctggccctgacgtgtttcctgttcccgccctcctctctctcgactctgagcgggctggcaaggcgcatagnnnnnnnnnnnnnnnnn

SEQ ID NO: 129615 - DNA, 681 bp, Homo sapiens
  misc_feature: GYAE6OF01EUCYS.49.52.E08.1.454.CMB.1.raw
  modified_base (95)..(95): a, c, t, g, unknown or other
  misc_feature (95)..(95): n is a, c, g, or t
  modified_base (369)..(369): a, c, t, g, unknown or other
  misc_feature (369)..(369): n is a, c, g, or t
  modified_base (386)..(386): a, c, t, g, unknown or other
  misc_feature (386)..(386): n is a, c, g, or t
  modified_base (448)..(449): a, c, t, g, unknown or other
  misc_feature (448)..(449): n is a, c, g, or t
tcagagtcgagagacacgaccggtgctcgatttagtcgagctctcagagagaaagggggtgggtccaggaggcagaactctgggtgtctcaccanggcctggatccctctacttctccccctcctcactctctgcacaggctctgaggcctcctatgagctgacacagccacccgtcggtgtcagtcgtccccaggacaggaccggccaggactccacctgcctcgtgggagagtcgacttacgtaccgaaacccgaaacgttaattacgtacgtttacgtttacggttaccgtaaccgacgacgaacggaccgggccggaccggccccgtgaccgtttggtgttagtgaattaagtaacgaacgtacnggacgagggccccgtcnccggagtccgtcgagcgtacttcgtcgtcggcgtccgacggtcgacggacgaacggtacacnnacgtacgtacgacgtacgtacgtacggtacggtacgacggacggacgaggccgtacggacgtacgtacgttacgttaacgttaagttacgtaacgtaaccgtaaacctaaaccgaacgtaaccgtaaccgtttacgttacgttacgttacgttacgttacggtaacgtacggtaccggtaccgtaaccggtaccgtaccggtaccgtaccggtccgtacggacccgaacccg

SEQ ID NO: 129616 - DNA, 541 bp, Homo sapiens
  misc_feature: GYAE6OF01B0WH3.49.52.E08.1.454.CMB.1.raw
  modified_base (413)..(413): a, c, t, g, unknown or other
  misc_feature (413)..(413): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgatatgcttattggtaccagcagaagccggccaggcccctgtgttggtgatgtaataaagacactgagacggccctcgagggactcccgtgacgcgtattctcgtcgctccgaggtcgagggacaacggtcaactattggacctatcgaggtggacgtccggacaggacggacgnggctagacttattactcgtcagtccgcaacgacgagccagtgactagttagtgtcgttagttcgggcggtagggacctacggcgtcgaccgtcgtacggtccacgacccaacggctccggtacccccg

SEQ ID NO: 129617 - DNA, 527 bp, Homo sapiens
  misc_feature: GYAE6OF01CHF4O.49.52.E08.1.454.CMB.1.raw
  modified_base (518)..(518): a, c, t, g, unknown or other
  misc_feature (518)..(518): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccgggccaggcccctgtgttggtgatgtataaagcactgagaggccctgagggatcccgtgagcgattctctggctccgaggtcagggacaacgggtcacgattggccatcagtggagtccgaggcagaggacgaggctgactattattgtacaatcaaacagaacacctattagtaacttatgtccttggaactgacgaccgtaaggtccaccgtccgtgggtaccacggtacccaacggaccccaaccccnctggtaccc

SEQ ID NO: 129618 - DNA, 682 bp, Homo sapiens
  misc_feature: GYAE6OF01CWYS6.49.52.E08.1.454.CMB.1.raw
  modified_base (345)..(345): a, c, t, g, unknown or other
  misc_feature (345)..(345): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacacgcccacccgtcggtgtcagtcgtcccaggacagacgcaggatcacctgctcgtggagatcgcattcgaaccaaacgtatatgtactttagttcggtacagcgaagaacgccggcacggtccctggtggttggtgagtagtaataaagacacgtagaggacgcctcgacggactccgngacgcgtacttcgtcgtcggtccgtacgtacggtacggaacggtaccgtaaacgtctaacgtagttacggctaacgttcgagggtacggacgtaccggagggacgaacgggaacgggacgtaggtacgtaagttaacttatttaacgttcgtaacgtaactaaccaaacgaccgtaaccctaacgttagtttaaccgttaacgtttacgttacggttaccgtaaccggtaacgtccgaaccgggtaacccgtacggtacccgtacccggttccgtaccgggaccacccggtaaccccggaaccccgaccccgtaacccgtcccgtccgttaaccccg

SEQ ID NO: 129619 - DNA, 687 bp, Homo sapiens
  misc_feature: GYAE6OF01CWLCF.49.52.E08.1.454.CMB.1.raw
  modified_base (253)..(253): a, c, t, g, unknown or other
  misc_feature (253)..(253): n is a, c, g, or t
  modified_base (293)..(293): a, c, t, g, unknown or other
  misc_feature (293)..(293): n is a, c, g, or t
tcagagtcgagagacacgaccggtgctcgatttagtcgagctctctcggcggggggggtcacaagaggcagcgctctcgggacgtctccaccatggcctggctctgctgctcctcactctcctcactcaggacacagggtcctgggcccagtctgccctgactcagcctgcctccgtgtctgggtctcctggacagtcgatcaccatctcctgcactgaaaccgcagtgatgttggaattataacctttctcngtaccaacacaccagcaaacgccccaaactcatcatttangagccatcagcgccctgaggggtctctgactcgcttctctggctcctacgtctcggcacggcctaaccggcctaccctaggacctaacttccgtacgtcgggtccctccggtaacggtccgtacgggggacgtacggggtcgtttacggtaattttacgttacgttttcgtccgtttagtttaccgtaagttacgttcgggtacccggggttagtaagtttacggggtaccgggtaccggggtaaacgggggtttcgggtttacccggggccgggggtaaacggggtaacccggtaaacggggttaccggtaacccggttacccggttacgggtacccgacgggtaacccccgtaacgggtcccgtccccggtcccccgggtcgttacccccgg

SEQ ID NO: 129620 - DNA, 741 bp, Homo sapiens
  misc_feature: GYAE6OF01EBQZV.49.52.E08.1.454.CMB.1.raw
  modified_base (243)..(243): a, c, t, g, unknown or other
  misc_feature (243)..(243): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggcaggatcacctgctctggagatgcattcgaccaaaacgntatgtcttattggtaccagcagaacggccggccgacggccctgttggttggtgattagtaataaagacacgtgagacgccgtacgacggtccaagggtaccctccgtagtcggacttcgttccctacgggtacgtcccgacgggtaaccgtacgggtacgaaaccgtacgtccgaacttaggtccgacgtacgacgtacgggtaggtaccgtaacgggacggacggaacgggtacggtaacgggtaccgttacgttacgtttaacgtaactttaacggttaccaaacgtaacgtaaacccaacgttaacgttaaacccggttaacttttacgggttaacggttttaacgttaacggttactttaccggggtaaacccgtaaaccggtaccggtaaccccgtaaaccggttaccggtacccggtacccgtacccgggtacccggtaaccggaccccccgtaaacccggtcccggtaaacccccgtaacccgttacccgg

SEQ ID NO: 129621 - DNA, 538 bp, Homo sapiens
  misc_feature: GYAE6OF01DW0U0.49.52.E08.1.454.CMB.1.raw
  modified_base (529)..(529): a, c, t, g, unknown or other
  misc_feature (529)..(529): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaaacgatatgcttattggtaccagcagaagccggccaggcccctgtgttggtgatgtataaagacactgagaggccctcgagggatcccgtgagcgattctctaggctccgaggtcagggacaacggtcacagttcggccagtccaggtggacgtcgaggcaggaggacgaggctgactattattgtacaatcaaacagaccacctagttacggtaacttagtcgttacttacggaactgaccgaccgtaaggtccaccgtccgtgggtacacgacccaacgacccaaccccngtcgtaccc

SEQ ID NO: 129622 - DNA, 793 bp, Homo sapiens
  misc_feature: GYAE6OF01DIC39.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctggagatgcattgaccaaaccgatatgtacttattggtaccagcaagaacgccgggccacggcccctgtgttggtgatgtaataaagcacgtgagacggccctgagggactcccgtagacgcgtacttcgtcgtacggtcctaccgtacgggtacgaacggggaacctaaaccgggtacaaccgtaagtttccgggaccctaagttccgaagggttcgggtaacgttacccggaagggtaccgaacgggaaacggggtaccggaacggggtccgttaacgggttaaacccgtttaagtttttaacggtttacgttaaccgtaaaacgtttaacccgaaaaccgtaacgtaaccccgtaacccgtttaaagtttaaccgggtttaacctttttaacggtttacggttaccggttttaacccgggaaaccgttaccgggtaacccggtaaacccggttaaacgggttaccccgttaacccccgggttcccggtttaacgggggtaccctaacccgggaacccccggtaaacgggaacccccccttaaacccccgttaccgttccggttaacccccg

SEQ ID NO: 129623 - DNA, 618 bp, Homo sapiens
  misc_feature: GYAE6OF01DPV4I.49.52.E08.1.454.CMB.1.raw
  modified_base (249)..(249): a, c, t, g, unknown or other
  misc_feature (249)..(249): n is a, c, g, or t
  modified_base (297)..(297): a, c, t, g, unknown or other
  misc_feature (297)..(297): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgacggccttcctatgagctgacacagcccaccctcggtgtcagtcgtccccaggacaggacggccaggatccacctgctctggagatgctattcgaccaaaccgnttatgcttatcggtaccagcagaacgccggcacggccctgttgtggtnatagtaataagacactggacgacggccctacgacgggtactccgtagagtcgtattctcgtcgctaccgaggtacgacgggtaacacggttcacgtagttcggactagtacgaggtacggacgtacgaggacgaggacggacgagtctagtacttattgtacgtacaatacaacgagtaacctaccttagttacggtttaacttacgttacgttaccgtaacggtacgttcggaaccgtaaccggtacggtacccgtacccggtcgggtaccggacctacccggaacccgaaccggaccccaacccgtcgtcgttaccccg

SEQ ID NO: 129624 - DNA, 595 bp, Homo sapiens
  misc_feature: GYAE6OF01DNAZB.49.52.E08.1.454.CMB.1.raw
  modified_base (223)..(223): a, c, t, g, unknown or other
  misc_feature (223)..(223): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattcgaccaaaaccgatatgtctttattcggtaccagcaagaacgccgggccacggcccctggtgttggtgatgtaataaagacacgtgagacggccctacgagggactcccgtgacgcgtattctcgtggctcgaggtcgagggacaacggtcactagttcggaccatcgaggtggacgtccgaggcgaaggaggacgaggctagaacttattagttgtactaatacaacgacgaacctacctagttacggttaactttagttcgttacgttacggaacttcgaccgtaaccgtaacgggtccctaccggttccgtacgggtccaaccggtaccccgaaacggaccccaaacccctcgtcgtacccg

SEQ ID NO: 129625 - DNA, 523 bp, Homo sapiens
  misc_feature: GYAE6OF01BN0A4.49.52.E08.1.454.CMB.1.raw
  modified_base (488)..(488): a, c, t, g, unknown or other
  misc_feature (488)..(488): n is a, c, g, or t
  modified_base (495)..(495): a, c, t, g, unknown or other
  misc_feature (495)..(495): n is a, c, g, or t
  modified_base (516)..(516): a, c, t, g, unknown or other
  misc_feature (516)..(516): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccgggcacggcccctgtgttggtgatgtaataaagcactgagaggccctgagggactcccgtgagcgtattctctggctccgaggtcgagggaccaacggtcactagttcggacctatcgagtgggacgtcgaggcagggaggacgagggctagacttagttattgtacaatacaacagacacgtattggtaacttagtgtctgaactgacgtaccgaggtcnccgtcgnggtcacgtccagacccacccntcgtacc

SEQ ID NO: 129626 - DNA, 601 bp, Homo sapiens
  misc_feature: GYAE6OF01CISYP.49.52.E08.1.454.CMB.1.raw
  modified_base (285)..(285): a, c, t, g, unknown or other
  misc_feature (285)..(285): n is a, c, g, or t
  modified_base (592)..(592): a, c, t, g, unknown or other
  misc_feature (592)..(592): n is a, c, g, or t
tcagagtcgagagacacgaccggtgctcgatttagtcgagctctcagagagaaagggggtgggtccaggaggcagaactctgggtgtctcaccatggcctggatccctctacttctcccctcctcactctctgcacaggctctgaggcctcctatgagctgacacagccaccctggtgtcagtcgtccccaggacagacggccaggatcacctgctctggagatgctattcgaccaaacgatatgtcttattgtaccagcagacgccggcacggcctgtgtggtnatgtataagacactgagacgccctcgagggtactcccgtgacgtcgtattacgtcgtggtcctccgtaagggtccgaacggggacctaacgggtcaacgtacgttcggacctaagtacgaggtcggtacgtaccggaggtacgaaggaacggacggacggtcgtagaccgttatttacgttagtactaacgtacaaacgacggactaaccgtagttagttacttagttcgtacgttacgaactgaccgtaaccgtaggtcccacggttccgtacggtcgaacgtaccccgaacggaccccaaccccngtcgtaccg

SEQ ID NO: 129627 - DNA, 544 bp, Homo sapiens
  misc_feature: GYAE6OF01E39NE.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggcacggcccctgtgttggtgatgtataaagacactgagaggccctgagggatcccgtgagcgattctctggctccgaggtcgaggggacaacgggtcacgattcggcatcagtggagtccaggcaggacggacgacggctgacttattatgtacaatcaacgagacaccgtattggtaactttatcgtcttacggaactgacgtaccgaagggtcaacccggtccttgggtaccaacggcccctaacgggacccaaacccccgtacgtcgttaccc

SEQ ID NO: 129628 - DNA, 600 bp, Homo sapiens
  misc_feature: GYAE6OF01A8VYL.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatccacctgctctggagatgcattgccaaaaccgatatgcttattggtaccagcagaagccggccaggcccctggtgttggtgatgtaataaagacactgagaggccctgagggactcccgtgacgcgtattctcgtcggcctcccgaggtccaggggacaacggtcaccagttcggacctatcgaacggtgggtacgtccaagggacgagggaacggacggagggtctggtaaccttaagttatttgactaaacgtacaaacgacgtaacccaacctaagttacggttactttaagtcgttcgttacggtaacctgaccgtaacgaacggttccaccggttccgacgggttccaaccggcccaaacggaccccaacccctaacgtgtaacc

SEQ ID NO: 129629 - DNA, 613 bp, Homo sapiens
  misc_feature: GYAE6OF01DLTRB.49.52.E08.1.454.CMB.1.raw
  modified_base (229)..(229): a, c, t, g, unknown or other
  misc_feature (229)..(229): n is a, c, g, or t
  modified_base (259)..(259): a, c, t, g, unknown or other
  misc_feature (259)..(259): n is a, c, g, or t
tcagagtcgagagacacgaccggtgctcgatttagtcgagctctctcggcggggggggtcacaagaggcagcgctctcgggacgtctccaccatggccctgggctctgctggctcctcactctcctcactcaggacacagggtcctgggcccagtctgccctgactcagcctgcctccgtgtctgggtctcctggacagtcgatcaccatcctcctgccactgaaaccngcagtgatggttggaattataaccttttcncctaggtaacccaacaacacccaggaccaaacgcccccaaatcatactaatttatcgacggccgatcgaggccgcctcgagggtctctgatcggcttctctggctcgacgtctggcagcaccggcctcccgtgacctaatctacgtcgggcctcgagggtcgttacggggacgtaggtacttgtatttattacgtttgccttagtttactaagttcgttcgggtaccggttagacgttaggtcgggtaccggtaaaggggttcgttacggggcgggtagggaccgtaagggttacggacccggttccgtaggtccgacggtccctaagggccctccggcccccgttcggtaccg

SEQ ID NO: 129630 - DNA, 520 bp, Homo sapiens
  misc_feature: GYAE6OF01EAK8E.49.52.E08.1.454.CMB.1.raw
  modified_base (367)..(367): a, c, t, g, unknown or other
  misc_feature (367)..(367): n is a, c, g, or t
  modified_base (484)..(484): a, c, t, g, unknown or other
  misc_feature (484)..(484): n is a, c, g, or t
  modified_base (512)..(512): a, c, t, g, unknown or other
  misc_feature (512)..(512): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccacggcccctgtgttggtgatgtataaagacactgagaggccctcgagggactcccgtgagcgattctctggctccgaggtcgaggacacggtcacntggcatcagtggagtccgaggcaggaggacgaggctagacttattattgtacaatcaacagacactattggttacttagtgtacttcggaactggacgaccgacggtcaccggtccngggtaccacgcccaaggaccccaacccntcgtaccc

SEQ ID NO: 129631 - DNA, 547 bp, Homo sapiens
  misc_feature: GYAE6OF01CPUR8.49.52.E08.1.454.CMB.1.raw
  modified_base (471)..(471): a, c, t, g, unknown or other
  misc_feature (471)..(471): n is a, c, g, or t
  modified_base (539)..(539): a, c, t, g, unknown or other
  misc_feature (539)..(539): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattgtaccagcagaagccggccacggcccctgtgttggtgatgtataaagacactgagacggccctagagggtactcccgtagacgtcgtacttctctcggctccgaggtacgaagggacctaacggtcactagtcgcctatcaggtggacgtccgaggcagaggacgaggctagactattattgtactaatcaaacagacaccgtattacggttacttagtnttacgttacgactagccgaacgtaacggtccaccgtcgtggtaccacgtcccgaacgcccaaaccccngtgtaccc

SEQ ID NO: 129632 - DNA, 558 bp, Homo sapiens
  misc_feature: GYAE6OF01EAK41.49.52.E08.1.454.CMB.1.raw
  modified_base (240)..(240): a, c, t, g, unknown or other
  misc_feature (240)..(240): n is a, c, g, or t
  modified_base (550)..(550): a, c, t, g, unknown or other
  misc_feature (550)..(550): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttattggtaccagcagaacgccggaccaggcccctgtgttggtgattgtaataaagacacgtgagacggccctacgagggactccctgacgtcgattctctcggctccgaggtcagggacacggtcaacgtagttcggcctaatcgaaggttggacgtccgaaggcaaggacggacgagggacctgtaactatttagttgtacaactcaaacacggaaccaccgtattcggttacttagtcgttcttacggactcgacgacctaggtccaccggtccgtggtccacgcccaaacggcccaacccntcgtaccc

SEQ ID NO: 129633 - DNA, 776 bp, Homo sapiens
  misc_feature: GYAE6OF01DEA09.49.52.E08.1.454.CMB.1.raw
  modified_base (228)..(228): a, c, t, g, unknown or other
  misc_feature (228)..(228): n is a, c, g, or t
tcagagtcgagagacacgaccggtgctcgatttagtcgagctctctcggcggggggggtcacaagaggcagcgctctcgggacgtctccaccatggcctggctctgctgctcctcactctcctcactcaggacacagggtcctgggcccagtctgccctgactcagcctgcctccgtgtctgggtctctggacagtcgactcacctactctcctagacactagaaccnggcagtggtagttagttacggttaactttacttaaccgtttcctaccgtacgaacccaacgaacccaaccgacgaacctacccgaacctaactctatactagttagacggcgaccgtacgccggtacgccgggtccgtacggtcggtacttcgtacgcttccgttcgtacgtccgtcggtacctccggtaccgtccgtcgacccgacgtcccgaccgtccctacccgttaacgtacctagttccggtccggtcggtccggtacggtaacggggcggtacggggtaactacccgggtttaagtttaacgtttacgtttacgtttacggttccgttacgttacgttacgtaaccggttaggggttacccggtacggggttacgtacggggttaaccggttaggggtacccgggttaagggggtacggtaaccggggtacggtaaaaccggggttcccgtaaacgggttacccgggacccggttaccggacccggtaaccggtaccggtcccccgtaacggttcccccgtccgttccccgtcgttaccccg

SEQ ID NO: 129634 - DNA, 597 bp, Homo sapiens
  misc_feature: GYAE6OF01CLMWX.49.52.E08.1.454.CMB.1.raw
  modified_base (242)..(242): a, c, t, g, unknown or other
  misc_feature (242)..(242): n is a, c, g, or t
  modified_base (584)..(584): a, c, t, g, unknown or other
  misc_feature (584)..(584): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaaccgntatgcttattggtaccagcagaagccgggccacggcccctggtgttggtgatgtaataaagacacgtgagacggccctagagggactcccgtgacgcgtattctctggcctccgaggtcgaggggacaaacgggtcacgtattcggccatcgagtcggacgtccaggcaggaaggacggagcgtgtactatttatgtacaatcaaacgagacctaactagtttggttaacctttagtcgttacgttacggaacgttcggaccgtaacccgtaagggtacccgtacccggttcccggttcggggtaccaaccggtccccgaaacggaccccctaaaccccccngttaccgtacccg

SEQ ID NO: 129635 - DNA, 670 bp, Homo sapiens
  misc_feature: GYAE6OF01DRUXD.49.52.E08.1.454.CMB.1.raw
  modified_base (507)..(507): a, c, t, g, unknown or other
  misc_feature (507)..(507): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccatctcctgcactacgaaaccagcagtgatggttagggtaatttattaaccttttctcctggtaaccaacaaccaccaggacaaacgacccccaaactcatctatttatgagccgatcacgcgccctcgagggtctctagtactcgtccttctcgtcggtcctccgtacgtcgtggccacgccgaccggtccctcccgtagaacctaacgttccgttccgtcggggtaccctacccggacgggtccgggtagggggacccgagggtcttaggttaatttacgtttagttcgtcgttacgtttntaacgttacgtcggtaccgggttagagttacgggtacgggtaccgggtaagggttcggtacggggtacggggtaaagggacggtaaacgggtccggtacccggttccggtagggtaccaccgggtacccgaacgggtcctcccggtcccccgttggttacccg

SEQ ID NO: 129636 - DNA, 535 bp, Homo sapiens
  misc_feature: GYAE6OF01CCV3W.49.52.E08.1.454.CMB.1.raw
  modified_base (241)..(241): a, c, t, g, unknown or other
  misc_feature (241)..(241): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgntatgcttattggtaccagcagaagccgggccaggcccctgtgttggtgatgtataaagacactgagaggccctcgagggactcccgtgagcgattctcgtggctccgaggtcagggacaacggtcacattggccatcagtggagtccaggcagaggacgaggctgactattattgtacaatcaacagacacctagttggtacttagtgttacgttcggaactgaccgaaccgtaacggtcacccggttccgtcgggtccacggtcccaacggacccaaaccccctgtcgtaccc

SEQ ID NO: 129637 - DNA, 621 bp, Homo sapiens
  misc_feature: GYAE6OF01CC3FK.49.52.E08.1.454.CMB.1.raw
  modified_base (227)..(227): a, c, t, g, unknown or other
  misc_feature (227)..(227): n is a, c, g, or t
  modified_base (257)..(257): a, c, t, g, unknown or other
  misc_feature (257)..(257): n is a, c, g, or t
  modified_base (298)..(298): a, c, t, g, unknown or other
  misc_feature (298)..(298): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacagggtcctgggcccagtctgccctgactcagcctgccctcgtgtctgggtctccgtggacagtcgatcaccatctcctgcactagaaaccngcagtgatgttaggaattactaacttttcnctgtacaacaccaccagacaacgccccaaatcatctattangacgccatcacgccggccctgacgggtctcgtgtactcgtcttcgtcgtcggtcctccacgtcgtcgggcacggccgaccggtcctcccgtagaacctacgttcgtcggtcggtacctcggacgggtcggtacggggacgaggtcgttagtaagtttacttagttcgtacttcgttactagtacgtcggtaccgggtagtacggttaggtcgggacggtaagggtcggttacggacgggtaacgggaacgtaagggtccgtaaccggtcgtacggtaccgacggtacccgtaacggtcccgtaccgtccccgttcggtacccg

SEQ ID NO: 129638 - DNA, 534 bp, Homo sapiens
  misc_feature: GYAE6OF01BD7EM.49.52.E08.1.454.CMB.1.raw
tcagagtcgagagacacgaccggtgctcgatttagtcgagctctcagagagaaagggggtgggtccaggaggcagaactctgggtttctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcgagggactccctgacgcgattctctggctccgaggtcagggacaacgggtcacattggccatcagtggagtccaggcaggaggacgaggctgactattatgcaatcaacagacacctagttcgtacttatcgtacttacggactcggccgacgtaacggtccacccggtcgtcgggtccaacgccccaaacggccccaaccccgtacgtccgtctacccg

SEQ ID NO: 129639 - DNA, 504 bp, Homo sapiens
  misc_feature: GYAE6OF01BY6EM.49.52.E08.1.454.CMB.1.raw
  modified_base (471)..(471): a, c, t, g, unknown or other
  misc_feature (471)..(471): n is a, c, g, or t
  modified_base (496)..(496): a, c, t, g, unknown or other
  misc_feature (496)..(496): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtacaatcaacagacaccattggtaacttatgtcttcggactgcgaccgtaggtcaccgtcngggtcacgcccaacggcccaacccngtcgtacc

SEQ ID NO: 129640 - DNA, 560 bp, Homo sapiens
  misc_feature: GYAE6OF01CMTJN.49.52.E08.1.454.CMB.1.raw
  modified_base (549)..(549): a, c, t, g, unknown or other
  misc_feature (549)..(549): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgatatgcttattggtaccagcagaacgccgggccaggcccctgtgttggtgatgtaataaagacactgagacggccctcgagggactccctgagcgtattctcgtggctcgaggtcagggacaacggtcacagttggccatcgagtgggacgtcgaggcaggaggacgagggctagacttattattgtacaatcaaacagaccacctatttacggtaacttagtcgttcgttacgaacttggaccgaaccgtaacggtccaacccggtccgtgggttacccacggacccctaacgggaccccaaaccccgngttccgtaccc

SEQ ID NO: 129641 - DNA, 586 bp, Homo sapiens
  misc_feature: GYAE6OF01DV38M.49.52.E08.1.454.CMB.1.raw
  modified_base (223)..(223): a, c, t, g, unknown or other
  misc_feature (223)..(223): n is a, c, g, or t
  modified_base (241)..(241): a, c, t, g, unknown or other
  misc_feature (241)..(241): n is a, c, g, or t
  modified_base (344)..(344): a, c, t, g, unknown or other
  misc_feature (344)..(344): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgaccaaaccgntatgcttattcggtaccagcagaagccggccaggcccctgtgtggtgatgtataaagacactgagacggccctacgagggtactcccgtgacgcgtatttccncgtcggcctccgaggtcaacggggaccaacggtcaactagttcgggaccctagtaccaggttcgggacgttacccgaaggcgaagggagggacggagggtctggaaccttagtttattgtacaatacaacgacgaccactattggttacttagtcgttcgttacggaactcgaccaaccgtacggtccaccggttcgcgggttaccacgacccgaacggaccccaaacccctcgtcgtaccc

SEQ ID NO: 129642 - DNA, 572 bp, Homo sapiens
  misc_feature: GYAE6OF01A9AG1.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctggagatgcattgaccaaaccgatatgcttattggtaccagcagaagccgggccaggcccctgtgttggtgatgtataagacactgagacggccctgagggactcccgtgacgcgtattctctggctcgaggtcagggacaacggtcacattcggccatcagtggagtccgaggcaggaggacgaggctgactattattgtacaatcaacagaccacctatttacggtaactttagtcgttcgttacggtaactcggaccgtaaccgtaacgggttccacccggttccgttacgggtaccaccgggtacccccgaaacgggaccccccaaaccccgtccgttcggttaccccg

SEQ ID NO: 129643 - DNA, 578 bp, Homo sapiens
  misc_feature: GYAE6OF01CJLT9.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccagatcactgctctggagatgcattgaccaaaccgatatgcttattggtaccagcagaagccggccacggcccctgtgttggtgatgtaataaagacactgaggacggccctcgagggtactcccgtaggagcgtattctcgtcggctccgaggtcgagggacaacggtcactacgtcgacatcgtaggtcggacgtaccgaggcaaggagggacggagcgtagtacttattattagtacaatacaacgagaccactagttgtaacttagtcgttacttacggacttacgcgtaaccgtaacgggtccctacccggttccggtacggtacgtaccggaccccgaaacggtaccccaaacccctcgtcgtacccg

SEQ ID NO: 129644 - DNA, 184 bp, Homo sapiens
  misc_feature: GYAE6OF01D6I5P.49.52.E08.1.454.CMB.1.raw
  modified_base (164)..(184): a, c, t, g, unknown or other
  misc_feature (164)..(184): n is a, c, g, or t
tcagagtcgagagacacgaccggtgctcgatttagtcgagctctcccgcgggcacgaccggtgctcgatttagtcacgcgagaaagggaaaggggctggccctgacgtgtttctgttcccacctcctctctctcgactctgagcgggctggcaaggcgcatagnnnnnnnnnnnnnnnnnnnnn

SEQ ID NO: 129645 - DNA, 609 bp, Homo sapiens
  misc_feature: GYAE6OF01C9PFR.49.52.E08.1.454.CMB.1.raw
tcagagtcgagagacacgaccggtgctcgatttagtcgagctctctcggcggggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccatctcctgcactgaaaccagcagtgatgttagggaattataacctttctctgtaccaacaacaccagacaaacgccccaaactcatctattatgaggccgatcagtcgccctcgagggtctcgtgatcgtcttctctcggctcacgtctggcagccgaccggtcctccctgaactaacgtcctcgtcgggcctccgagggccgtagggggacgaggtctagtatttagttattggtcttgttacaattagtcggtcggttagagttaggtacgggaccggtaaggggttcggttacggggcgggtaacgggaacgtaaacggggttacgacccggttccggtaagggttacccaaccgggtacccgaaacgggtccctacccgggcccccgttcggttaccccg

SEQ ID NO: 129646 - DNA, 583 bp, Homo sapiens
  misc_feature: GYAE6OF01BATEK.49.52.E08.1.454.CMB.1.raw
  modified_base (574)..(574): a, c, t, g, unknown or other
  misc_feature (574)..(574): n is a, c, g, or t
tcagagtcgagagacacgaccggtgctcgatttagtcgagctctcagagagaaagggggtgggtccaggaggcagaactctgggtgtctcaccatggcctggatccctctacttctcccctcctcactctctgcacaggctctgaggcctcctatgagctgacacagccaccctcggtgtcagtcgtccccaggacaggacgccaggatcacctgctcgtggagatgctattcgaccaaaaccgatatgtctttaattggtaccagacagaacggccgggccacggcccctggtgttggtgatgtaataaacgacactgagacggccctagacgggtactcccgtggacgtcgtattcctcgtcggtcctaccgtagggtccgaaggggtacctaaacgggtcaactagttcggacctaatcgaggtcggacgtccgaggcaagggacggacggagcgtagtaactatttacgtagtacaatcaaacacgtacaaccttagttacgtacttatcgtacgttaggactgaccgtacgacgtcgaccgtcgtggaccacgaccgacgacccacccngtcgtaccg

SEQ ID NO: 129647 - DNA, 619 bp, Homo sapiens
  misc_feature: GYAE6OF01CQ0WO.49.52.E08.1.454.CMB.1.raw
  modified_base (241)..(241): a, c, t, g, unknown or other
  misc_feature (241)..(241): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgntatgcttattggtaccagcagaagccgggccaggcccctgtgttggtgatgtaataaagacactgagaggcccctgacgggatcccgtgacgcgattctcgtggcctccgaggtcaaggggacaacggtcactagttcggaccatcgaggtgggacgtcccgaaggcgaaggacgggacggaggctagactattagttgtacaactacaaacgacgaacctaaccctagtttacggttaactttagtcgttaccgtttacgggaaaccttcggaccgtaaacccgtaacgggttccctaacccggttcccggtaggggtacccaaccggtacccccgaaacgggacccccaaaccccccgtacgtccggttaaccccg

SEQ ID NO: 129648 - DNA, 699 bp, Homo sapiens
  misc_feature: GYAE6OF01EHGVC.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttcctccccctcctcactctctgcacaggctctgaggcctcctatgagctgacacacgcccaccctcggtgtcagtcgtccccaggacagacggccaggactcacctgctcgtggagatgctattcgacccaaaaccgtatatgtactttagttcggtaaccaggacaaggaaacggcccgggaccgaccgggtcccccgttggttcggtttggtagtagttaggtaaactaaaaggacctacgtaggaacggacggcccctacgacgggtactcccgtggacgcgtacttcgtcgtcggcctccgaggtcgaacgggacaaccggtacacgtagttcggacctagtcgacggtggacgtcgaggaccgaagggagggacggaggtaccgtagtacgtttaacgtttattacggtactaacgtaaccgaaactaaccgaacctaaccgttaacgtttaacggtttaactttacgttcggttacgttaccgggtaacttcggaaccgtaaccggtaaccggtacctacccggttcgtccgggtaccaccgtacccggaaccgtaccccaaccccgtgtccggttaccc

SEQ ID NO: 129649 - DNA, 552 bp, Homo sapiens
  misc_feature: GYAE6OF01BDZ96.49.52.E08.1.454.CMB.1.raw
  modified_base (225)..(225): a, c, t, g, unknown or other
  misc_feature (225)..(225): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgganatgcattgaccaaaccgatatgcttattggtaccagcagaacgccggccacggcccctgtgttggtgatgtaataaagacacgtggagacggccctagagggactcccgtgacgcgtattctcgtcggctccgaggtcgagggacaacggtcacagttcggcagtcgaggtggacgtccaggacaggaggacggagctagacttattatgtacaatcaacagaccaactagttaggttacttagtcgttacgtacggaactgaccgaccgtaacggtcaccggttcgacgggtcaccggcccaacgacccaacccgtcgtcgtaccc

SEQ ID NO: 129650 - DNA, 576 bp, Homo sapiens
  misc_feature: GYAE6OF01BSVT9.49.52.E08.1.454.CMB.1.raw
  modified_base (240)..(240): a, c, t, g, unknown or other
  misc_feature (240)..(240): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggccaggcccctgtgttggtgatgtataaagacactgagaggccctcgagggactcccgtgacgcgattctctggctccaggtcagggacaacggtcacgattcggccatcgagtggagtccaggcaggaggacgagggctggacttattattgtacaatcaacagaccacctagtttacggtactttatgttccgttacggaacttcggaccgtaacccgtaaagggtccctaacccggttcccgtacggggtacccaacggtcccccgaaacgggaccccccaaacccccgtctccggttaaccccg

SEQ ID NO: 129651 - DNA, 545 bp, Homo sapiens
  misc_feature: GYAE6OF01CAXYC.49.52.E08.1.454.CMB.1.raw
  modified_base (475)..(475): a, c, t, g, unknown or other
  misc_feature (475)..(475): n is a, c, g, or t
  modified_base (512)..(512): a, c, t, g, unknown or other
  misc_feature (512)..(512): n is a, c, g, or t
  modified_base (535)..(535): a, c, t, g, unknown or other
  misc_feature (535)..(535): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatccacctgctctggagatgcattgaccaaaccgatatgcttattggtaccagcagaagccggaccacggcccctgtgttggtgatgtataaagacactgaggacggccctcgagggactcccgtggacgtcgtattctcgtgcctccgaggtcacgggacaacggtcacgtagttcggaccatcaggtggagtccgaggcaggaggacgaggctaggactattattgtactaatcaacaacgacaaccgtagttaggttacttagtnttcgtacgaactgaccgtacgacggtccaccggtcgnggtccacgcccacgcccaacccncgtcgtaccc

SEQ ID NO: 129652 - DNA, 597 bp, Homo sapiens
  misc_feature: GYAE6OF01DZ4SP.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgcattcgacccaaaccgatatgcttattggtaccagcaagaacgccgggccaggcccctgtgttggtgagtgtaataaagacacgtgagacggccctgagggactcccgtgacgcgtacttctgtcggctccgaggtcgacgggacacggtcactagttcgcctagtcgaggtggacgtcgaggcgaaggaggacgaggcgtagtacttatttagttgtacaactacaaacagaaccaccgtaagttacgttacttagttcgttacgttaccgggaacttcggaaccgtaccgtaaccggtaccgtacccggttccgtacggggtcaacccgtacccggaaccggaccccaacccccgagttccgtaccc

SEQ ID NO: 129653 - DNA, 657 bp, Homo sapiens
  misc_feature: GYAE6OF01C59M9.49.52.E08.1.454.CMB.1.raw
  modified_base (224)..(224): a, c, t, g, unknown or other
  misc_feature (224)..(224): n is a, c, g, or t
tcagagtcgagagacacgaccggtgctcgatttagtcgagctctctcggcggggggggtcacaagaggcagcgctctcgggacgtctccaccatggcctggctctgctgctcctcactctcctcactcaggacacagggtcctgggcccagtctgccctgactcagcctgcctccgtgtctgggtctcctggacagtcgatcaccatctcctgcactgaaaccngcagtgatgttggaattatactttctctgtacaacacaccagacaaacgcccaactcatctattatagagccatcacgcgcctgagggtctctgactcgtcttctcgtcgctaccacgtcgtgcacgcgaccggtcctcctagactacgtcgtacgtcggtccgtcgtacgggcgtgggggaacctacgggtccgttagttaatttacgtttacgtttcggtctttcgttacgtaagttacgttcgggtaccggttagtaacgttacgggttacgggacccgggttaaggggtttccgggtttaccggggacggggtaaccggggtaaccgtaacggggtaccgttaaccccgggttcggttaaccggtaccgaaccggtaaccccggtaaacgggtcccgttaccccgggtcccccgttcgggttacccccg

SEQ ID NO: 129654 - DNA, 669 bp, Homo sapiens
  misc_feature: GYAE6OF01EVCPB.49.52.E08.1.454.CMB.1.raw
  modified_base (299)..(299): a, c, t, g, unknown or other
  misc_feature (299)..(299): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctcgtggagatgcattgaccaaaaccgatatgcttattggtaccagcagaagccggccaggcccctgtgttggtgatgtaanaagacactgagacgccctacgagggactcccgtgacgtcgtactttctacgtcggcctccgagggtccgaaggggtaccgaacggtaccaacgtagttcgggaccctagttccgaaggtacgggtacgtcccgaagggtccaagggaacgggaccggagggtccttaggtaaccttaatttttaagttacgtacctaaacgttaccaaacgtaacgaacctaccgtaagtttacggttacttaagttcgttacgttacggaacgttcggaccgtaacccgtaaacggttcccaacccggttcccgttacggggtaccaaccggtaccccgaaacccgggaccccaaacccccgtcgtacggttaaccccc

SEQ ID NO: 129655 - DNA, 726 bp, Homo sapiens
  misc_feature: GYAE6OF01D6LQK.49.52.E08.1.454.CMB.1.raw
  modified_base (185)..(185): a, c, t, g, unknown or other
  misc_feature (185)..(185): n is a, c, g, or t
  modified_base (232)..(232): a, c, t, g, unknown or other
  misc_feature (232)..(232): n is a, c, g, or t
tcagagtcgagagacacgaccggtgctcgatttagtcgagctctcagagagaaagggggtgggtccaggaggcagaactctgggtgtctcaccatggcctggatccctctacttcctccccctcctcactctctgcacaggctctgacggcctcctatgagctgacacacgcccacccgtcggtntcagtccgtccccaggacagacggccaggactcacctgctcgtgganatgctagttcgacccaaaaccgtatatcgtctttaagttcggtaccagacgaaggaaccggcccggggaccaccgggtccccttgggttggttcggtagtagttagtaaataaacgacgtacgtagggacgaccggtcccgtacggaacgggtacctcccgtaggacgtccgtatttccgtcgtcggcctccggagggtaccgaacgggacaacggtcagtacggttcgacctagtcgaggtacgggacgtaccggaggacgaacgggagggaaccggaggtcttagtaacgtttagtttattacggtaactaaacgtacgaaacgataaccgtacctttaggtttacggttaactttacgttacggtttaccgtaaccggtaacgtcggaacccgtaaaccggtaaccggttcccgtacccggtttcccggacgggtacctaaccccggaaccccgtaacggaacccccctaaccccgtggtaccctaccccg

SEQ ID NO: 129656 - DNA, 594 bp, Homo sapiens
  misc_feature: GYAE6OF01CGQDK.49.52.E08.1.454.CMB.1.raw
  modified_base (444)..(444): a, c, t, g, unknown or other
  misc_feature (444)..(444): n is a, c, g, or t
tcagagtcgagagacacgaccggtgctcgatttagtcgagctctcagagagaaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaaccgatatgcttattggtaccagcagaacgccggccaggcccctgtgttggtgatgtataaagacactgagaggccctcgagggactcccgtaggacgcgtattctcgtggcctccgaggtcaacggggacaacggtcacgattcggccatccgaggtggacgtccgaaggccaaggaacggacggaggctaggacttattagttntacaaatcaaacacgaaccaacctagtttacggttaacttagttcgtaccgttacggaacttcgaccgtaacccgtaacggtcctaacccggttctacggggtaccaaccggaccccgaaacggcccccaaaccccgtctccgttacccg

SEQ ID NO: 129657 - DNA, 589 bp, Homo sapiens
  misc_feature: GYAE6OF01A35U7.49.52.E08.1.454.CMB.1.raw
  modified_base (440)..(440): a, c, t, g, unknown or other
  misc_feature (440)..(440): n is a, c, g, or t
  modified_base (463)..(463): a, c, t, g, unknown or other
  misc_feature (463)..(463): n is a, c, g, or t
tcagagtcgagagacacgaccggtgctcgatttagtcgagctctcagagagaaagggggtgggtccaggaggcagaactctgggtgtctcaccatggcctggatccctctacttcctccccctcctcactctctgcacaggctctgaggcctcctatgagctgacacagcccaccctcggtgtcagtcgtccccaggacagacggccaggatcacctgctctggagatgcattcgaccaaaaccgatatgcttattcggtaccagcagaacgcccgggccacggcccctggtgttggtgatagtaataaagacactggaagacggccctagacgggtactcccgtggacgcgtattcgtcgtcggctaccgaggtcgaggggaacaacggtcaactagttcggacctagtcgaggtggacgtcgaggacgaggaggacgngacgtagaacttagttatcgtanaactcaactaagacctaacgtagttacgttacttagtacgtacgttacggaactcgaccgaacgtaacggtccaaccggttccgtaggtaccaccgacccgaacgaccccaacccgtgtcgtaccc

SEQ ID NO: 129658 - DNA, 169 bp, Homo sapiens
  misc_feature: GYAE6OF01A7VMY.49.52.E08.1.454.CMB.1.raw
  modified_base (167)..(169): a, c, t, g, unknown or other
  misc_feature (167)..(169): n is a, c, g, or t
tcagagtcgagagacacgaccggtgctcgatttagtcgagctctctctcgcgggcacgaccggtgctcgatttagtcacgcgagaaagggaaaggggctggccctgacgtgtttctgttcccaccctcctctctctcgactctgagcgggctggcaaggcgcatagnnn

SEQ ID NO: 129659 - DNA, 639 bp, Homo sapiens
  misc_feature: GYAE6OF01EYPRO.49.52.E08.1.454.CMB.1.raw
  modified_base (223)..(223): a, c, t, g, unknown or other
  misc_feature (223)..(223): n is a, c, g, or t
  modified_base (242)..(242): a, c, t, g, unknown or other
  misc_feature (242)..(242): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctggtgtcagtcgtccccaggacagacggccaggatcacctgctctgganatgcattcgaccaaaccgntatgtacttagtcggtaccagacgaggaacggccggccgaccggtccccgttggttcggttggtagtagttagtaagtaaacgactacgtaggaacggtaccggtcccgtacggacgggtacctcccgtaggacgtacgtacttccgtcgtcggtcctaccgtacggtacgaacgggaccgaacggtcactagttcggactatacgtaggtcggtacgtaccgaggacgaaggacggacggagtcgtagtacttagttagttagtactaactacaacgacgacctactagttacgttacttagtcgttcgttacggtactcggaccgtaccgtacggtaccaccggttccgtacggtaccaccggtacccgaacggaccccaacccgtcgtcgtacc

SEQ ID NO: 129660 - DNA, 585 bp, Homo sapiens
  misc_feature: GYAE6OF01E5ZXN.49.52.E08.1.454.CMB.1.raw
  modified_base (223)..(223): a, c, t, g, unknown or other
  misc_feature (223)..(223): n is a, c, g, or t
  modified_base (242)..(242): a, c, t, g, unknown or other
  misc_feature (242)..(242): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattcgaccaaaccgntatgcttattggtaccagcagaagccggccaggcccctgtgttggtgatgtaataaagacactggagacggcccctcgagggactcccgtgagcgtattctcgtcggctccgaggtcgaagggacgaacggtcactagttcggccctagtcaggtcggagtcccgaggcaggaaggacgaggctaggactattagttgtcaatcaacgagacacctagttacggttacttagtcgttacgttacggtaactcgacccgtaaccgtaacggttccaaccccgggttcctacggggtaccaccggaccccgaacggacccccaaaccccgtacgtcgtaaccccg

SEQ ID NO: 129661 - DNA, 805 bp, Homo sapiens
  misc_feature: GYAE6OF01EUZST.49.52.E08.1.454.CMB.1.raw
  modified_base (298)..(298): a, c, t, g, unknown or other
  misc_feature (298)..(298): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagaccggccaggatcacctgctctggagatgcattcgaccaaaaccgatatgtcttattcggtaccagcaagaacgccggccacggcccctggtgttggngatagtataaagacactgagacggcctgacggactcccgtgacgcgtattctcgtcggctccgaggtcgaagggaaccaacgggtcacgtagttcggacctagtccgtaggtacgggacgttacccgaagggtaccgaaacgggaacggggaaaccggtacggggtaccgttaacgggtaaacccgtttttaagttttaacggttttaacgggttaacccttaaaacgtttaacccgaaaaccgtaaacgggtaaacccctaaccccgttaaaggtttttaccgggtttaaacccttttaaggtttaccggtttacccgttttaaccggggaaaaccctttcggggaaacccccgttaaacccggtaaaaccggggtttaccccgtaacccccggggtttccccggttaccggggggtaaccccaaacccgggggtaacccccccgtaaaaacccggggtacccccccttaaaaccccccggttaaccgttcccgggttaacccccc

SEQ ID NO: 129662 - DNA, 642 bp, Homo sapiens
  misc_feature: GYAE6OF01ERZBO.49.52.E08.1.454.CMB.1.raw
  modified_base (181)..(181): a, c, t, g, unknown or other
  misc_feature (181)..(181): n is a, c, g, or t
  modified_base (225)..(225): a, c, t, g, unknown or other
  misc_feature (225)..(225): n is a, c, g, or t
  modified_base (244)..(244): a, c, t, g, unknown or other
  misc_feature (244)..(244): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagcccaccctcggtntcagtcgtccccaggacagacggccaggatcacctgctctgganatgcattgacctaaaacgntatgtcttattggtaccagcagaagccgggccacggcccctgtgttggtgatgtaataagactactgaggacgcccgtcgagggactcccgtggacgacgatttcgtcgtcgggcctccgacggtccgaaggggaaccgaacgggttacaacgtagttcggacccattcgtaggtgggacgtccgaaggaccgaaggacgggaacggtaggacgtaggtaacttatttacgttagttacaataacaacacgaactaccgtaagtttacgtaactttagttcgttaccttacggtaacttacggaccgtaaacgtacggttacccgtaccggttcccgttaggggtaacccaccggtacccgaaaccgggacccccaaaccccgtaacgttcgtaaccc

SEQ ID NO: 129663 - DNA, 547 bp, Homo sapiens
  misc_feature: GYAE6OF01A9W2R.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctggagatgcattgaccaaaccgatatgcttattggtaccagcagaagccgggccacggcccctgtgttggtgatgtataaagacacgtgagacggccctgagggactcccgtgacgcgattctcgtcggctccgaggtcgaagggacaacggtcactagttcggccatcgagtggacgtccgaggcaaggaggacgaggctgacttattagtgtacaatcaacaagaccactagttagtacttatgttcttcggaacttggacgaccgtaacggtccaccggttccgacgggtccacgacccaacggaccccaaccccgctcgtaccc

SEQ ID NO: 129664 - DNA, 677 bp, Homo sapiens
  misc_feature: GYAE6OF01DWIMB.49.52.E08.1.454.CMB.1.raw
  modified_base (226)..(226): a, c, t, g, unknown or other
  misc_feature (226)..(226): n is a, c, g, or t
  modified_base (321)..(321): a, c, t, g, unknown or other
  misc_feature (321)..(321): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactagaaaccngcagtgagttggttagggtaatttacttaaccttttctccgtaggtaaccaaacaaccacccaggaccaaaacgcccccaaactcatctatttangacggccgatcgacgccggtccctgacgggtctcgtgactcgtctttctctcggcctccgacgtcgtcggcacggccgaccggtccctcccgtacgaactaactctccgtcggcctaccggcggtcggtaggggacgacggtcgttagtaatttagttacgtttgtcgtttagttactagttacggtcggtaccgggttagtaaggttacgggttacgggtacggggtaaggggttcgggttaccggggacggggtaaagggaaccggtaaacggggtaccggttaacccggtcgttaacgggtaccaccggtaccccgtaacggtcccgtcccggtcccccgttcgggtaccccg

SEQ ID NO: 129665 - DNA, 670 bp, Homo sapiens
  misc_feature: GYAE6OF01EYHBM.49.52.E08.1.454.CMB.1.raw
  modified_base (222)..(222): a, c, t, g, unknown or other
  misc_feature (222)..(222): n is a, c, g, or t
  modified_base (240)..(240): a, c, t, g, unknown or other
  misc_feature (240)..(240): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggcagacggccaggatcacctgctctgganatgcattgccaaaaccgntatgcttattggtaccagcagaacgccggccacggcccctgtgtggtgatgtaataaagacacgtgagacggcctcgagggactcccgtgagcgtattctcgttggcttaccgacgggtcgaaggggtaaccgaaacgggttccactacgtttacggaccctaatccgaaggttcgggaacggttcccgaagggaccaagggaacgggaaccggagggaccttaggtaacctttaagtttacgtttaggtaaccaaacttaccgaaaacctaacggaacctaacccgtaagtttacgggtttaaactttacgttacggttaccgtttacgggaaacttcgaacccgtaaccgtaacggtaccctaacccggttccgtacgggtaccaccggaaccccgaacggacccctaacccccgtcgtccgtacccg

SEQ ID NO: 129666 - DNA, 633 bp, Homo sapiens
  misc_feature: GYAE6OF01AWA5N.49.52.E08.1.454.CMB.1.raw
  modified_base (326)..(326): a, c, t, g, unknown or other
  misc_feature (326)..(326): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcaccatctcctgcactgaaaccagcagtgatgttgggaattataaccttttctcctggtaccaacaacacccaggcaaacgcccccaaactccatccatttatgaggccgatcagcggccctnacggggtctctgatcgcttctctggctccacgtctggcagcacggccctccctagaccaatctcgtcgggctccgaggcgtggggacgagctagtactttattattacgtcttgttacattagtcggtccggtagtaacgttaggttacgggtaccggtaaggggttcgggttaccgggacgggtaacgggggaaaccgtaaacggggttaccgggacccgggttaccgtaacggggtccgaaacccgggtacccccgaaaacggggtcccctacccgggtccccccccggttgggttaacccccgg

SEQ ID NO: 129667 - DNA, 766 bp, Homo sapiens
  misc_feature: GYAE6OF01CRSWW.49.52.E08.1.454.CMB.1.raw
tcagagtcgagagacacgaccggtgctcgatttagtcgagctctctcggcggggggggtcacaagaggcagcgctctcgggacgtctccacgatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatggttagggaattacttaaccttttctcctaggtaccaacaaccaccaggacaaaccgacccccaaactctactctaatttagtaggacggaccgatcgacggccggtccctcgacgggtctctgactccgtcttctcgtacgtcctacctacggtcgtcggctacgccgacccggtccctcccgtacgaacctacttccgtcggttccgggacctaccggaaggggtcggttaaggggggaccgtgggtcttaggttaactttagtttaggttcgtacgtttacgtttctaaacgtttcgggtaccgggtaccggggttaggttaacggttaacgggttccgggggtaacccgggggttaaagggggtttccgggtttaccggggggaccggggggaaaccgggggtaaacccggttaacgggggtcccggttaacccccgggtttacgggacgggtttaccccggaaccgggaccccggtaaacggggttaccccgttcccccggttcccccggttacccggggtttacccc

SEQ ID NO: 129668 - DNA, 554 bp, Homo sapiens
  misc_feature: GYAE6OF01BBER5.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccacccctcggtgtcagtcgtccccaggacagacggccaggatcacctgctctggagatgcattgccaaaaccgatatgcttattggtaccagcagaagccgggccaggcccctgtgttggtgatgtataaagacactgagagccctgagggatcccgtgagcgtattctcgtggtcctccgaggtccgaggggaaccaacggttcaacgtagttgggacccatcgaagtgggacgtccaggacaggaggacgaggactgacttattattgtacaatcaacgtagaccacctattggttacttattcgtcgttagaactgacgaccgtaaggtccaccgtcgtacgggtacacggacccgaacggacccaacccctgtcgtacccg

SEQ ID NO: 129669 - DNA, 704 bp, Homo sapiens
  misc_feature: GYAE6OF01CE5KP.49.52.E08.1.454.CMB.1.raw
  modified_base (315)..(315): a, c, t, g, unknown or other
  misc_feature (315)..(315): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggcacggcccctgtgttggtgatgtaataaagacactgagaggccctnacgggatccctgacgcgtattcgtcgtcggctaccgaggtcaacggggtacaaacggttccaatagttcggaccaatcgtaacggttcgggaagttcccgaaggccgaagggaagggaaccggaagggccgttaggtaaccttaagtttaagtttacggtaccaaaacgttacaaaacgaaggtaaccctaaacccgtaagtttacggttaacgtttaacttcgttaaccgtttaccgggtaaacttcggtaacccggtaaccccgaaaaccgggtttaccccgaaccccggtttcccgggttaccggggttaaccctaaacccgggaacccccgtaaaacgggacccccccctaaaacccccgtacccgttaaccgggttaacccccg

SEQ ID NO: 129670 - DNA, 163 bp, Homo sapiens
  misc_feature: GYAE6OF01B22UL.49.52.E08.1.454.CMB.1.raw
  modified_base (163)..(163): a, c, t, g, unknown or other
  misc_feature (163)..(163): n is a, c, g, or t
tcagagtcgagagacacgaccggtgctcgatttagtcgagctctctcgcgagcacgaccggtgctcgatttagtcacgcgagaaagggaaaggggctggccctgacgtgtttctgttcccgcccctctctctcgactctgagcgggctggcaaggcgcatagn

SEQ ID NO: 129671 - DNA, 775 bp, Homo sapiens
  misc_feature: GYAE6OF01BZ1IB.49.52.E08.1.454.CMB.1.raw
  modified_base (226)..(226): a, c, t, g, unknown or other
  misc_feature (226)..(226): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacagggtcctgggcccagtctgccctgactcagcctgcctccgtgtctgggtcctcctggacagtcgatcaccatctcctgcactgaaaccngcagtgatggttaggaattattaacctttctctagtaccaacaacaccaggacaaaccgcccccaaatcatctatttagagtacggccatcgacggccggtaccccgtcgtaacggggttcctcgtcgtactccggtccttcgttccgtcggtccttacccgtacggttccgtacgggcctacggcccgtacccggtccccttaccgtacggaacctaacgttcccgtccggttacgggtccctaccggacgggtccggtacgggggaccggaggtccgttaggtaacttttacgtttagttacgttcctttaggtttacgaacgtttaacgttccggggtaccggttagggtacggtttaacgggtaccggggtaaccggggtaaggggggtttccgggtttaaccggggggaccggggtaaacggggaaacggtaaacgggggttacccgaaccccgggtttacggttaaccggggtaaccgaacccggtacccccggtaacgggtacccccgttccccggtaccccccgggttcggttaccccccg

SEQ ID NO: 129672 - DNA, 568 bp, Homo sapiens
  misc_feature: GYAE6OF01B28DX.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgcattgaccaaaccgatatgcttattggtaccagcagaacgccggccacggcccctgtgttggtgatgtaataaagcactgaggacgccctgaggactcccgtgagcgtattctcgtcggtctcgaggtcgagggaaccacggtcacgtagttcggacctatcgaggtggacgtccgaggacgaggacggacgaggctgaacttattatgtacaactacaacagaccacgtagttcgtaacttagtcgttacttacggtactcggaccgtaccgtacggttacctacccggtcgtcgggtacacccggacccgaacggaccccaacccctagttcgtaccc

SEQ ID NO: 129673 - DNA, 687 bp, Homo sapiens
  misc_feature: GYAE6OF01CGR3Y.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctcccctcctcactctctgcacaggctctgaggcctcctatgagctgacacagccaccctggtgtcagtcgtcccaggacagacggccaggatcactgctcgtggagtatgctattcgaccaaacgatatgctttattcggtacagacagaagcccggaccacggcccctggtcgttggtagattagtaataaagacacgtgacgacgcctcgaggtactccgtgacgcgattctacgtcggtcctaccgaggtacgaacgggaccgtaaacggtctaactagttacggaccctagtaccgtaggtacgggacgttaccgaggacgagggaacggacggtacgggactacggtaactttaagtttacgttacgttactaaacttaaccgaaccgtaacgaaccttaaccgtaacgttttacgggttaacctttaagttaccgttaccgtttaacgggtaacctccgggtaccgtaaacccggtaacggttacccgacccggttcccggtacgggtacccgtaacggtaccccgaaacggaccccctaaacccccgtacgttccgttaaccccg

SEQ ID NO: 129674 - DNA, 546 bp, Homo sapiens
  misc_feature: GYAE6OF01EKFL5.49.52.E08.1.454.CMB.1.raw
  modified_base (313)..(313): a, c, t, g, unknown or other
  misc_feature (313)..(313): n is a, c, g, or t
  modified_base (324)..(324): a, c, t, g, unknown or other
  misc_feature (324)..(324): n is a, c, g, or t
  modified_base (330)..(330): a, c, t, g, unknown or other
  misc_feature (330)..(330): n is a, c, g, or t
  modified_base (367)..(367): a, c, t, g, unknown or other
  misc_feature (367)..(367): n is a, c, g, or t
tcagagtcgagagacacgaccggtgctcgatttagtcgagctctcagagagaaagggggtgggtccaggaggcagaactctgggtttctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttatggtaccagcagaagccggccaggcccctgtgttggtgatgtataaagacactgagaggccctnagggacctcgngcgatntctcgtgctcgagtcggagacgacgcatgtcgactanagtgtacgacgtacgagacgaggacgaggacgtagacgtattattatcgtactatacaagacgaccaacttgttacgttacttagttgttaccgtacgtatcgaccgtaacgtacggtacctaccgttcggtcgtacgccgtaacccgaccgaccccaacccctcgtccgcttaccccg

SEQ ID NO: 129675 - DNA, 662 bp, Homo sapiens
  misc_feature: GYAE6OF01BXHRZ.49.52.E08.1.454.CMB.1.raw
  modified_base (255)..(255): a, c, t, g, unknown or other
  misc_feature (255)..(255): n is a, c, g, or t
  modified_base (515)..(515): a, c, t, g, unknown or other
  misc_feature (515)..(515): n is a, c, g, or t
tcagagtcgagagacacgaccggtgctcgatttagtcgagctctcagagagaaagggggtgggtccaggaggcagaactctgggtgtctcaccatggcctggatccctctacttcctccccctcctcactctctgcacaggctctgaggcctcctatgagctgacacacgcccacccgtcggtgtcagtcgtccccaggacaggaccggcgaggactcaccgtgctcgtggagtatgactattcgaccaaacgtntatgtcttagttacggtaccagacgaagaacggccgggaccaccggtcccctggtggttggtgtagttagtaaagtaacgacacgtaggagccgccgtacgacggtactcccgtagacgcgtacttcgtcggtcgtcgtaccgtaggtacgaacggtacgtaccggtacgtactacgttcggacctagtcggtagtcgggacgtaccggtaaggacgaaggacggacgtcggacgtagtaacgtttattacgttacgtanaaactacaaacgtacgaacctacgtagtttacgttacgttagtcgttacgttacggtaacgtcggaaccgtaaccggtacggtccctaccggttcgtacggaccgaacccgacccgaacccgaccccaaccgtccgtacgttacccg

SEQ ID NO: 129676 - DNA, 649 bp, Homo sapiens
  misc_feature: GYAE6OF01AFVYC.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgcattcgaccaaaccgatatgcttattggtaccagcagaagccggcacggcccctgtggttggtgtatgtaataaagactacgtgagacggtcccctacgacgggacttcccgtaggacgccgtaattccgtcgtacggtcctacccgaacgggtcgaacggggaaccgtaaacgggtccaacgtagttcgggaccagtacgaggtgggaacgtccgaagggacgaaggagggacgacgggtcttagacttagtttatcgtacaactacaaacgtacgaactacctaagtttacggttactttaacgtcgttacgttacggacgtcggtaccgaaaccggtaaggtacccacccggttcccgttacggggtaacccacgggtacccccaaacggaacccccaaacccctcgtccgttacccg

SEQ ID NO: 129677 - DNA, 623 bp, Homo sapiens
  misc_feature: GYAE6OF01AB2H9.49.52.E08.1.454.CMB.1.raw
  modified_base (245)..(245): a, c, t, g, unknown or other
  misc_feature (245)..(245): n is a, c, g, or t
tcagagtcgagagacacgaccggtgctcgatttagtcgagctctcagagagaaagggggtgggtccaggaggcagaactctgggtgtctcaccatggcctggatccctctacttcctccccctcctcactctctgcacaggctctgaggcctcctatgagctgacacagcccaccctcggtgtcagtcgtccccaggacagacggccaggatccacctgctctggagatgcattgaccaaaccgntatgcttattggtaccagcagaagccgggccacggcccctgtgttggtgatagtataaagacacgtgagacggccctagacggatcccgtagagcgtattctcgtcggctaccgacggtcgagggaccgtaacggtacacgtacgttcggacctagtccgagtagggacgtaccgaggtacaggaggacgagggtctagaactagttattcggtactaatactaacacgacaaccgtagttacgtaacttagtcttaccgttacgacgttacggaccgtaaccgtaacggtacccgtacccggttccggttacggggtaccaacccggtacccctaaacggggaacccccctaaccccgtaccgttccgttaaacccg

SEQ ID NO: 129678 - DNA, 656 bp, Homo sapiens
  misc_feature: GYAE6OF01CKE7V.49.52.E08.1.454.CMB.1.raw
  modified_base (244)..(244): a, c, t, g, unknown or other
  misc_feature (244)..(244): n is a, c, g, or t
  modified_base (306)..(306): a, c, t, g, unknown or other
  misc_feature (306)..(306): n is a, c, g, or t
tcagagtcgagagacacgaccggtgctcgatttagtcgagctctcagaagagaaagggggtgggtccaggaggcagaactctgggtgtctcaccatggcctggatccctctacttctccccctccttcactctctgcacaggctctgaggcctcctatgagctgacacagcccaccctggtgtcagtcgtccccaggacagacggccaggatcacctgctcgtggcgatcgctattgaccaaanatatgtcttactggtacaccgcaggacggccaggccacggcccctgtcgttggtgtatttanaaagtactttgagacggtccctagaccgggtacccctggacgcgtacttctcgtacggcctaccgagctacggaacgggaaccaaacgtacgtacctaccgttacgaacctactcgaaggtcggacgtcccggacgaaggtacgggacggacggtctacgaacgttattaccgtgtactacgtccgactaacggaccaggaccgtaggtacggtacgtaggtttagtcgggttacgttacgggtacggggacgggtaagggtaccgttacgggtccgttaccggtacccggttacccgttaaggtccgaaccggtacccgtaacggtcccgtcccggtccccgttcccgg

SEQ ID NO: 129679 - DNA, 584 bp, Homo sapiens
  misc_feature: GYAE6OF01BO43B.49.52.E08.1.454.CMB.1.raw
  modified_base (445)..(445): a, c, t, g, unknown or other
  misc_feature (445)..(445): n is a, c, g, or t
tcagagtcgagagacacgaccggtgctcgatttagtcgagctctcagagaggaaagggggtgggtccaggaggcagaactctgggtgtctcaccatggcctggatccctctacttcctcccctcctcactctctgcacaggctctgaggcctcctatgagctgacacagccaccctcggtgtcagtcgtccccaggacaggacgccaggatcacctgctctggagatgcattcgaccaaaccgatatgctttattggtaccagcagaagccgggcacggcccctggtgttggtgatgtaataaagacactgagacgccctagagggactcccgtgacgcgactttcgcgtcggctccgaggtcgaaggggacaacgggtcaacgtagttggccatcgaggtgagtccgagcgaggacggcgagctgacttattatgacaatcaanacgtaacaccgtagtttacgtactttaagtcgtaccgttacggaacgttcggaccgtaaccgtaacggtcccgtacccggttccgtcgggtaccgaccgtacccgaacggtaaccccgaacccctaagtccgtaacccg

SEQ ID NO: 129680 - DNA, 678 bp, Homo sapiens
  misc_feature: GYAE6OF01BZ33R.49.52.E08.1.454.CMB.1.raw
  modified_base (225)..(225): a, c, t, g, unknown or other
  misc_feature (225)..(225): n is a, c, g, or t
  modified_base (300)..(300): a, c, t, g, unknown or other
  misc_feature (300)..(300): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgttaggaattataacctttctctgtaccaacaacaccaggacaaacgccccaaactcatctatttangacggccatcacggccggccctcgtacgggtctctgactcgtcttctctcggcctccgtacgtcgtcggcacgccgaccggtccctccctagaacctacgttccgttcggtcgggtacccttcccggaagggccggttaggggggaaccgtaggggttccttaaggttaacttttagttacgtttcgtacgtttgtttacgaagtttacggttcgggtacccgggttaggtaacgttacgggtcggggtacccgggtaagggggttcggttaccggggcggggtaacgggaccggtaagggtacggtacccggttccggtaaggtcccgaaccggtacccggtaacgggtcccttcccgggtcccccgttcggtaccc

SEQ ID NO: 129681 - DNA, 695 bp, Homo sapiens
  misc_feature: GYAE6OF01DWH7D.49.52.E08.1.454.CMB.1.raw
  modified_base (233)..(233): a, c, t, g, unknown or other
  misc_feature (233)..(233): n is a, c, g, or t
  modified_base (486)..(486): a, c, t, g, unknown or other
  misc_feature (486)..(486): n is a, c, g, or t
  modified_base (503)..(503): a, c, t, g, unknown or other
  misc_feature (503)..(503): n is a, c, g, or t
tcagagtcgagagacacgaccggtgctcgatttagtcgagctctctcggcggggggggtctcaggaggcagcgctctcaggacgtcaccaccatggcctgggctctgctcctcctcaccctcctcactcgagggcacgagggtcctgggcccagtctgccctgactcacgcccgccctccggcgtccgggtctccgtggacagtctgtcaccatcctcctgcacgtggaaccngcagtgacggttggtgtattaataactatcgtccttccgtacggtaaccaacgacgtaacccaggaccaaaccgccccagacctacaattagtaatttacgcggtacggtacgaaggttaaccggcccggtccccgttacgggaccggggttcccctaggtaccgttccggtcctttcgtcgtcggtcctaccgtagtcgtacggaccaaccgccgtcccctcgtcgtaccgtcgtcggtcggccgtccgggntaggagtagtggacgtnttagttactttacgttcgtcgacgacgtctatacgtagtcgacgacggaactacgtaacttaaacgtttgtttacggaagttacggttacgggttcgggaacgggtaacggtaccgtaacggtcgttaccggacccgttaccgtacggtacccgacggtaaccggtaccggtcccgtcccggttacccccgg

SEQ ID NO: 129682 - DNA, 698 bp, Homo sapiens
  misc_feature: GYAE6OF01A2Y99.49.52.E08.1.454.CMB.1.raw
  modified_base (224)..(224): a, c, t, g, unknown or other
  misc_feature (224)..(224): n is a, c, g, or t
  modified_base (291)..(291): a, c, t, g, unknown or other
  misc_feature (291)..(291): n is a, c, g, or t
  modified_base (505)..(505): a, c, t, g, unknown or other
  misc_feature (505)..(505): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatgctaattgaccaaaccgatatgcttattggtaccagcagaacgccggcacggcccctgtgttggngatgtaataaagactactggagacggccctgaagggctcccgtgacgcgtattctcgtggctccgagtcgacgggacgaacggtcaactagttcggacctagtacgacggtacggtacgtaccgagggactaagggaaccgggtaacgggaacgggcgttacgggtaactttaagtttaacgtttacgtaccgtaaacttaccgaaaccgtaanaacccgtaaacccgttaagttttacgggttaaaccttttaggttacgttacccgtttacggtaaaccgtcgggaacccgttaaacccggtaaaccgggttccctaaaccccgggttccggttacggggaccctaaaccggtacccccgaaaccggtaacccccaacccccggttaacttcccggtaaaccccg

SEQ ID NO: 129683 - DNA, 593 bp, Homo sapiens
  misc_feature: GYAE6OF01CFIO9.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgcattgaccaaaccgatatgcttattggtaccagcagaagccggcacggcccctgtgttggtgatgtaataaagcactgagaggccctgaggactcccgtagacgcgtattcgtcgtcggcctccgaggtccgaagggactaacggtcacgtattcggaccatcgagtggacgtccgaggcgaggaggacggaggcgtagacttattattcgtacaatacgaacacgacctaccgtagtttacggttaacttagtaggttccgttacggaacttcggaccggtaaccgtaacggttccaacccggttccgtacggggtccaccggaccccgaacgggacccccaaacccccgtgtcccgttacccg

SEQ ID NO: 129684 - DNA, 624 bp, Homo sapiens
  misc_feature: GYAE6OF01CY5SC.49.52.E08.1.454.CMB.1.raw
  modified_base (242)..(242): a, c, t, g, unknown or other
  misc_feature (242)..(242): n is a, c, g, or t
  modified_base (429)..(429): a, c, t, g, unknown or other
  misc_feature (429)..(429): n is a, c, g, or t
tcagagtcgagagacacgaccggtgctcgatttagtcgagctctcagagagaaagggggtgggtccaggaggcagaactctgggtgtctcaccatgtcctggatccctctacttctccccctcctcactctctgcacaggctctgaggcctcctatgagctgacacagcccaccctggtgtcagtcgtccccaggacagacggccaggatcacctgctctggagatgcattgaccaaaccgntatgcttattggtaccagcagaagccgggcaggcccctgtgttggtgatgtaataaagacactgagacgccctcgagggatcccgtgacgcgtattctcgtcggctccgggtcaacgggactaacggtcaccgtagttcggacctaatcgaacggtggaacgtccgaaggtcgaaggagggaacggnggctgaacttattattgtacaattaccaacgtaacgacctaaccctaagtttggtaacctttagttacgttcgttacggtaaacctcggtaccgaaaccgaacgggtccctaacccgggttcccgttacgggtacccgaaaccgtcccgaaaaccgggtaccccaaacccctaacgtccggttaacctaaccccg

SEQ ID NO: 129685 - DNA, 671 bp, Homo sapiens
  misc_feature: GYAE6OF01CBPMQ.49.52.E08.1.454.CMB.1.raw
  modified_base (200)..(200): a, c, t, g, unknown or other
  misc_feature (200)..(200): n is a, c, g, or t
  modified_base (360)..(360): a, c, t, g, unknown or other
  misc_feature (360)..(360): n is a, c, g, or t
tcagagtcgagagacacgaccggtgctcgatttagtcgagctctctcggcggggggggtcacaagaggcagcgctctcgggacgtctccaccatggcctggctctgctgctcctcactctcctcactcaggacacgagggtccctgggcccagtctcgccctgactcagcctcgcctcgtgtctcgggtctccgtggacngtcgactcaccatcctcctgctactacgaaaccagtcagtgagtggttaggtaatttacttaacctttctccgtagtaaccaacaaccaccaggaccaaacgaccccaaatcatacctattcgacgacggacatcgacgccgtaccgtgtacgggtactntgactcgtctcgtctccggtctcacgtcgtgccacgcgtacccgcctcctagtactacgtcctcggtcggtccgtacggtacgggcggttacggggacgcggtacgttacgtaagtttaacgttcgttagtacgtttgttaaccgtaagttacgttcgggtaacgttcggtaaggttccgggttacggggaccggttaaggggtcgggtacgggtacggggaacgggtaaccggtacgggttacggtaaccggtaccggtacggacggaccgaccggtaacgtcccggtacccgtcccgttccgtacccgg

SEQ ID NO: 129686 - DNA, 718 bp, Homo sapiens
  misc_feature: GYAE6OF01C1MB7.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagcccaccctcggtgtcaggtcgtccccaggacagacggccaggatcacctgctctggagatgcattgaccaaaccgatatgtcttattcggtaccagacaaggaacggcccggggaccaacggtccccctggttcggtttgggtagataggtaataaaacgactacgtagacggacggcccctagacgggactcccgtggacgcgtacttctcgtcggtcctaccgaggtccgaacggggacctaaacgggtcaactacgttacggcctatcgtaggtacggtacggtacccgagggccaagggaacgggaaccggacggggtaccttagggtaaccctttaagttttaacgtttcggtaactaaaacttaccgaaacctaacggaacctaccttaacggtttacgttaacgttttaacgttcgttacccggtttacggaaccgttacggtaaccggaaccgtaaacgggtcccgtaccggttcccggttacgggtacccgacggtacccccgaaacgggtacccccaaaccccgtaccgttccgtacccg

SEQ ID NO: 129687 - DNA, 658 bp, Homo sapiens
  misc_feature: GYAE6OF01EJCLO.49.52.E08.1.454.CMB.1.raw
  modified_base (370)..(370): a, c, t, g, unknown or other
  misc_feature (370)..(370): n is a, c, g, or t
tcagagtcgagagacacgaccggtgctcgatttagtcgagctctcagagagaaagggggtgggtccaggaggcagaactctgggtgtctcaccatggcctggatccctctacttcctccccctcctcactctctgcacaggctctgaggcctcctatgagctgacacagcccaccctcggtgtcagtcgtccccaggacaggaccggccaggactccacctgctcgtggagatgctattcgacccaaaaccgatatgtacttattggtaccagcaaggaacgcccgggaccacggccccctggttggttggtgtatgtaataaagacacgtggagacggtccctagagggactcccgtgagcgtacttcncgtcggctccgaggtcgaagggaccaacggtcactagttcgacctatcgaggtggacgtacccgtaggaccgagggacgggaaccggagggtcgttagtaacgtttagtttaacgttacgtactaacttacaaacgaacgaccctaaccgttagtttacggttaacctttagtcgtttaccgttaacgggtaaccgttcggaccgtaaacccggtaacggtccgtacccggtccgtacgggtaccaaccggtaccccgaacggaccccccaacccgtcctcgtacccg

SEQ ID NO: 129688 - DNA, 498 bp, Homo sapiens
  misc_feature: GYAE6OF01BX5GN.49.52.E08.1.454.CMB.1.raw
  modified_base (240)..(240): a, c, t, g, unknown or other
  misc_feature (240)..(240): n is a, c, g, or t
  modified_base (409)..(409): a, c, t, g, unknown or other
  misc_feature (409)..(409): n is a, c, g, or t
  modified_base (419)..(419): a, c, t, g, unknown or other
  misc_feature (419)..(419): n is a, c, g, or t
  modified_base (490)..(490): a, c, t, g, unknown or other
  misc_feature (490)..(490): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggccaggccccctgtgttggtgatgtataaagacactgagaggccctcgagggactccctgagcgattctctggctcgaggtcaggggacaacggtcacattggccatcagtggagtccaggcagaggacgagctgactatntgcaatcaanagacacctattgtacttatgtctcgactgccgacaggtcaccgtcgtggtccagcccaaggcccaaccccntcgtaccc

SEQ ID NO: 129689 - DNA, 685 bp, Homo sapiens
  misc_feature: GYAE6OF01DZG3T.49.52.E08.1.454.CMB.1.raw
  modified_base (236)..(236): a, c, t, g, unknown or other
  misc_feature (236)..(236): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacgagggtcctcgggcccagtctcgccctgactcagcctcgcctccgtgtcgtcgggtctccgtggacagtcgatcacctatctctgactactacgaaaccngcagtgtagtggttaggtaactttacttaacctttctctacgtaacgtaaccaacaaccgacgacgaaccaacccaacctactactactacttagtagtacggacgtacacgcggaccggccgtcgtacgggtcgtactcgtacgtcgtcgttcgtccgtcggtcgtccctacgtcgtcggacgacgaccgccgtacctacccgtacaacaacgttcgtcggttacggcgtaccgtagggacgggtcgggacgacgggttactagttaagttacttacgacgtgacctgtaactaactaactaacgaaaactaacttaacgttacgggttacgggttcgggtaccggacgggttaaccggaaacccgttaacgtcgtcccggttaacgttaccgacgacccgaacccggtacggtcccgtacccggtcccccggttactcgttaacccg

SEQ ID NO: 129690 - DNA, 617 bp, Homo sapiens
  misc_feature: GYAE6OF01CL2MM.49.52.E08.1.454.CMB.1.raw
  modified_base (229)..(229): a, c, t, g, unknown or other
  misc_feature (229)..(229): n is a, c, g, or t
  modified_base (312)..(312): a, c, t, g, unknown or other
  misc_feature (312)..(312): n is a, c, g, or t
  modified_base (477)..(477): a, c, t, g, unknown or other
  misc_feature (477)..(477): n is a, c, g, or t
  modified_base (513)..(513): a, c, t, g, unknown or other
  misc_feature (513)..(513): n is a, c, g, or t
tcagagtcgagagacacgaccggtgctcgatttagtcgagctctctcggcgggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatccaccatcctcctgcactagaaaccngcagtgatggttaggaatttattaacctttctcctaggtaaccaacaaccaccagacaaaccgaccccaatcatctatttagngacgacctatcacgccggtccctagacggggttctctagacgttccgtacttctcgtcgcctccgtacgtcgtaggctacggaccgtacccggccctaccctacgaaccttaacttcgtacggtcggtaccacccggtagggtccgggtacggggtacgacggtnttacggtatttagtttatcgtctttgtacaacgttntccggtagtacggtagtaggtcgggtacggtagggttcggtacgggaggtaggaccgaggtacgacggtcgagtacgacgacctaggcctccgtcccgtcgtcc

SEQ ID NO: 129691 - DNA, 660 bp, Homo sapiens
  misc_feature: GYAE6OF01DX3NJ.49.52.E08.1.454.CMB.1.raw
  modified_base (180)..(180): a, c, t, g, unknown or other
  misc_feature (180)..(180): n is a, c, g, or t
  modified_base (648)..(648): a, c, t, g, unknown or other
  misc_feature (648)..(648): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtntcagtcgtccccaggacagaccggccaggatcacctgctcgtggagatgctattcgaccaaaccgatatgctttagttggtaaccagcagaacgccgggccacggcccctgtgttggtgatgtaataaagacacgtgagacggtccctcgaggactccctggacgcgattctctggcctaccgaggtccaggggaccaacggtcactagttcggaccctagtacgaaggttcgggacgttcccggaagggaccgaagggaacgggaaccgggaggaccgttaggtaaccgtttagtttaagtttacggtactaaacgtacaacgaacgtaccgtaacccgttaagtttacggttaactttagtacgtttaccgtttaccgggaaccgttggaacccgtaccggtaacgttacccgacccggttcgtaccgggtacaccggtaccccgaaacgacccccgtaaaccccngttccggtaccc

SEQ ID NO: 129692 - DNA, 666 bp, Homo sapiens
  misc_feature: GYAE6OF01B7YJ0.49.52.E08.1.454.CMB.1.raw
  modified_base (234)..(234): a, c, t, g, unknown or other
  misc_feature (234)..(234): n is a, c, g, or t
tcagagtcgagagacacgaccggtgctcgatttagtcgagctctcagagagaaagggggtgggtccaggaggcagaactctgggtgtctcaccatggcctggatccctctacttcctccccctcctcactctctgcacaggctctgaggcctcctatgagctgacacacgcccacccgtggtgtcaggtcgtccccagggacaggacggccaggactccacctgcctcgtgganatgctagttcgacccaaacgtatatgctttatggtaccagcaagacggccggccacgccccgtgtgtggtgatgtaataaagcacgtgacgacggccctagagggactcccgtagacggtacgtacgttactcgtcggctcccgtaacggtacgacggggacgtaaaccgggtctacgtacgttacgggacctacgtcgtaggtcggggtacgtaccggtaggccgaagggacgggtaacggaacgggtcgtagtaccttaagtttacgttagtactaacgtacaacgtaaccgtacctaaccgttagttaggttaaccttagttagttaccgttacggtacctcggacccgaacgtacggttacccgaccgttccgggacggtccaaccggtacccgaaccggtaccccaacccgtacgttccgtaacccg

SEQ ID NO: 129693 - DNA, 741 bp, Homo sapiens
  misc_feature: GYAE6OF01C5EK7.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagcccaccctggtgtcagtcgtccccaggacagacggccaggatcacctgctctggagatgcattgaccaaaccgatatgacttattcggtaccagcagaacgccggccaggcccctgtcgttggtcgtaattataaagaacacgtacgtagacggaccgtcgaggacgtccttacggagacgtacgttaccttcgtcggtcgtccgtaggtacgacgggtaacgaccgtacgtacctaagtttacggaccgacgtacgtacggtacggtaacggttaccgaacgggtagaacggaacgggaaacggtacgggtacccgttaggtaacccttaagtttaacttttcgggttaaacctaacgtaccgtaaacgaaacgtaacccgtaacccgttaagtttacgggttaacctttacgttacggtttaccgttaccggttaaaccgtacgtaccggtaacccgttaaacggtacccggtaacccggttcccggttacgggttacccgggaaccgaccccggtaaacccgggtaaccccgtaacccccgtaaccgtaccggtttcccgtaaaccccgg

SEQ ID NO: 129694 - DNA, 592 bp, Homo sapiens
  misc_feature: GYAE6OF01COPLJ.49.52.E08.1.454.CMB.1.raw
  modified_base (243)..(243): a, c, t, g, unknown or other
  misc_feature (243)..(243): n is a, c, g, or t
  modified_base (580)..(580): a, c, t, g, unknown or other
  misc_feature (580)..(580): n is a, c, g, or t
tcagagtcgagagacacgaccggtgctcgatttagtcgagctctcagagagaaagggggtgggtccaggaggcagaactctgggtgtctcaccatggcctggatccctctacttcctccccctcctcactctctgcacaggctctgaggcctcctatgagctgacacagccaccctcggtgtcagtcgtccccaggacagacggccaggatcactgctctggagatgcagttcgaccaaacgntatgcttattggtacagcagaacgccggcacggccctggtgtggtgatgtaataaagacatagagacgccctagacgggactccctagagcgtattctcgtggctcgaggtcgaagggaccaaacggtcactagttacgccatcgaggtcggagtccgaggacaaggaggacgagctgaactagtttattgactaacgtacaaaccgtagaacctaaccgttatttacgggttaacctttagttcgttaccgtttaaccggaacgtggtacccgaaacgtaacggtcccgtaacggttccggtggtacccacggtacccaacggacccctaaccccncgttcgtaaccc

SEQ ID NO: 129695 - DNA, 686 bp, Homo sapiens
  misc_feature: GYAE6OF01D0L1A.49.52.E08.1.454.CMB.1.raw
  modified_base (200)..(200): a, c, t, g, unknown or other
  misc_feature (200)..(200): n is a, c, g, or t
  modified_base (231)..(231): a, c, t, g, unknown or other
  misc_feature (231)..(231): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacgagggtcctgggcccagtctcgccctgactcagcctgcctccgtgtcgtgggtctccgtggacngtcgatcaccatctcctgacactagaaaccngcagtgagtggttaggtaattacttacgtttctccgtagtaaccaacaaccaccgaggaccaaaccgacccctaaactcatactattagtaggacgaccatcgacgccggtcccgtcggtacgggttcctcgtagtactcgtcttcgtcgtcggtcctaccgacggttcgtcggaccgacgtcccgaccgtccctccgtacgtaacctacgttccgttcggtacggtcccacggtcgggtacggtacggggacgtacgtacgttagttaatttacgttatttcgtcgttacgttactacgttacgtacgggtaccgttaggtacggttgggtacgggtaccgggttaagggttccgggttaccgggacggggaaccgttacgggacggtacggtacccggtacggtaggtaccgacccgtacggtacggccctaccccggtccccgtcggtcccg

SEQ ID NO: 129696 - DNA, 730 bp, Homo sapiens
  misc_feature: GYAE6OF01BT7MF.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctcccctcctcactctctgcacaggctctgagcctcctatgagctgacacagccaccctcggtgtcagtcgtccccaggacagacggccaggatcactgctctggagatgcattcgaccaaaaccgatatgtcttattggtaccagcagaagccggccacggcccctgtcgttggtgattagtaataaagacactagagacggccctcgacgggactcccgtggacgcgtattctcgtcgcgtaccgagggtacgaggggaactaaccgggtactaacgaagtttcggacccgtaagtaccgaggttacgggacggtacccgaagggaccgaagggtaacgggaaccggaggggtcccttaaggtaacgtttaacgtttaagtttacgttaacgtaaacttaaccaaaccgtaacggaaaccctaaccgtaagtttacgggtttaactttaacgttacggttaccgtttaaccgggtaaacctcgggtaacccgaacccggttaaccgggtacccgtaaccccggttcccgggttacggggtacccgtaaccggtaaccccccggaaaccgggtaaaccccccgtaaccccctaacccgggttgttaaaccccccg

SEQ ID NO: 129697 - DNA, 596 bp, Homo sapiens
  misc_feature: GYAE6OF01DQDN9.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaaccgatatgtcttattggtaccagcagaagccgggccacggcccctggtgttggtgatgtaataaagacactgagacggccctacgagggactcccgtagacgcgtattcgtcgtggcctccgaggtcgaagggacctaacggtcaacgtagttcggacctagtcgaggtaggacgtaccgaaggcgaaggaggacggaggctagacttatttagttcgtacaatacaacgagaacacgtagttaggtacttagtcgttacgttacggtaactcggtacgaaccgtaacggtacctaccggttccgtacgggtaccaccggacccgtaaccggacccctaaccccgacgttcgtacccg

SEQ ID NO: 129698 - DNA, 591 bp, Homo sapiens
  misc_feature: GYAE6OF01DGCXB.49.52.E08.1.454.CMB.1.raw
  modified_base (181)..(181): a, c, t, g, unknown or other
  misc_feature (181)..(181): n is a, c, g, or t
  modified_base (245)..(245): a, c, t, g, unknown or other
  misc_feature (245)..(245): n is a, c, g, or t
  modified_base (289)..(289): a, c, t, g, unknown or other
  misc_feature (289)..(289): n is a, c, g, or t
  modified_base (296)..(296): a, c, t, g, unknown or other
  misc_feature (296)..(296): n is a, c, g, or t
  modified_base (329)..(329): a, c, t, g, unknown or other
  misc_feature (329)..(329): n is a, c, g, or t
tcagagtcgagagacacgaccggtgctcgatttagtcgagctctcagagagaaagggggtgggtccaggaggcagaactctgggtgtctcaccatggcctggatccctctacttcctccccctcctcactctctgcacaggctctgaggcctcctatgagctgacacagcccaccctggtntcagtcgtccccaggacagaccggccaggatcacctgctcgtggagatgcattgaccaaacgtntatgcttatcggacagcaagagccggcacggccctgtgttgganatgtaanaaacgacatggagacggccctgaggactcccgngacgtcgtattctcgtgcctaccgaggtcgaagggacctaacggtcactagttcggacagtcgaggtgacgtccgaggcgaagacgggacgaggtctagaacttagtttattcgtaactaagtccgaaacagaacctaccgtaagttacggttaacttagttcgtacggttaccgaacgttgaccgtaaccgtaggttacccaccgttccggtagggaccaaccggtaccccgaaacggccccaaacccctgtcgtaacccg

SEQ ID NO: 129699 - DNA, 793 bp, Homo sapiens
  misc_feature: GYAE6OF01BS855.49.52.E08.1.454.CMB.1.raw
  modified_base (228)..(228): a, c, t, g, unknown or other
  misc_feature (228)..(228): n is a, c, g, or t
tcagagtcgagagacacgaccggtgctcgatttagtcgagctctctcggcgggggggtcacaagaggcagcgctctcgggacgtctccaccatggcctgggctctgctgctcctcactctcctcactcaggacacgagggtcctgggcccagtctgccctgactcagcctgcctccgtgtctgggtctccgtggacagtcgatcaccatcctcctgcactagaaaccngcaagtgattggtaggtaattacttaaccgttttctaccgtacggtaaaccaaacaaccaacccgaacggaccaaaccgacccccaaatccaataccgtatttaacgcggaacggccgaatccgaacggtccggtccctacggacggggttcctcgtggaacttccggtctttccgtcggtcggtaccgttcccgaacggttcgtcggggaccaacggtccgtaacccgggccctttacccggacgtaacctaacttccgtacggtcggtaccttccggaacgggtcgtaacgggggaccgtagggtaccttggttaaacttttacgttagttacgctttacggtttacctaagtacggtccggtaccgggttagtaacggtttacggtcgggggtaccgttaaagggggttccggttacggggggaaacccgggtaaagggaaaccggtaaaccggggttacccggtacccggttaacccggttacggggttaaaccccgaccggttaaaccccggacggttaccccggttacccccggaccccccggtttgggttaacccccg

SEQ ID NO: 129700 - DNA, 816 bp, Homo sapiens
  misc_feature: GYAE6OF01EKO6J.49.52.E08.1.454.CMB.1.raw
  modified_base (226)..(226): a, c, t, g, unknown or other
  misc_feature (226)..(226): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatccaccatctcctgcactgaaaccngcagtgatggttaggtaattacttaaccttttctcctaggtaaccaacaaccaccgagacaaaccgccccaaactcatctatttagtggacggccgatacgacggccggccctacggacgggttctcgtacgactcgtcttcgtcgtcgtcctacccgtacgttcgtcggaccgacgaccgtacccggtcccttaccccgtacggtaacctaacgttcccgttccgggtacgggtcccttacccggacgggtccggtacggggggaaccgtacgggtccgtttaggtaacttttaagtttacgttcgttaccgtttagtttacgtaacgtttacggtccgggttacccgggtaaggttaacggtttacggggtaccggggtaaccggggttaaacgggggtttccggggttaccgggggtaccggggtaaaacggggtaaaccgggttaaaaccggggttacccgggtaaaccccgggttacccgggttaaaccggggtacccgtaaaccccggggtaacccccgggtaaacggggttccccccggttacccccgggttaccccccccgggttccgggtttaaccccccg

SEQ ID NO: 129701 - DNA, 567 bp, Homo sapiens
  misc_feature: GYAE6OF01B7O3Y.49.52.E08.1.454.CMB.1.raw
  modified_base (338)..(338): a, c, t, g, unknown or other
  misc_feature (338)..(338): n is a, c, g, or t
  modified_base (556)..(556): a, c, t, g, unknown or other
  misc_feature (556)..(556): n is a, c, g, or t
tcagagtcgagagacacgaccggtgctcgatttagtcgagctctcagagagaaagggggtgggtccaggaggcagaactctgggtgtctcaccatggcctggatccctctacttcctccccctcctcactctctgcacaggctctgaggcctcctatgagctgacacagcccaccctcggtgtcagtgtccccaggacagacggccaggatcacctgcctctggagatgcattgaccaaacgatatgcttattggtaccagcagaagccggcaggcccctgtgttggtgatgtataaagacactgagaggccctcgagggactcccgtgagcgattcncgtggctccgaggtcaggggacaaacggtcaactattcggcctatcaggtggacgtccgaggcaggaggacgaggcgtagactattattgacaatacaacagaaccacctattacggtaatttatgttacttacggaactggacccgtaaccgaacggtaccaccggttcccgtaggggtacccaacggtacccccaaacggaccccaaacccccgtntccgttaaccc

SEQ ID NO: 129702 - DNA, 633 bp, Homo sapiens
  misc_feature: GYAE6OF01ASIHU.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgctattcgacccaaaccgtatatgtcttattggtaccagcagaacgccggaccacggcccctgtgtggtgatgtaataaagcacgtgagacgccctagaggactccgaggacgcgtacttcgtcgtggcctaccgaggtacgacgggaccgaacggtacacgtagttcggaccagtcgaggtggacgtccgaggacgaggacggacggagcgttagacttattattcgtactaactacaacgaacgacctaaccgtagtttacgggttaactttacgttacgttaccgttacggaacgttcggaacccgtaaccgtaacgggtcccgtaaccccggttcggtaccggggtaaccaccgggtacccccgaaccggtacccccaaaccccgttcgtacccggttaccc

SEQ ID NO: 129703 - DNA, 691 bp, Homo sapiens
  misc_feature: GYAE6OF01CKZKS.49.52.E08.1.454.CMB.1.raw
  modified_base (213)..(213): a, c, t, g, unknown or other
  misc_feature (213)..(213): n is a, c, g, or t
  modified_base (284)..(284): a, c, t, g, unknown or other
  misc_feature (284)..(284): n is a, c, g, or t
  modified_base (288)..(288): a, c, t, g, unknown or other
  misc_feature (288)..(288): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctctatgagctgacacagcccacctcggtgtcagtcgtcccagacagacgcaggatcactgctntggagatgctatcgaccaaacgatatgtcttatggtaccagcagaacgccggccaggcccctgtgttggtnagtntaataaagacacgtgagacgccctcgaggctccgtgacgcgtacttctcgtcggctacgaggtcgacgggaaccgtaacggtacacgtaacgttcggaccacgttccgaagggttcgaacggtcccgaaggacgaacggtaaaggggaaccggaaggggaccttacgggtaaaccgttaagttttaatttaacggtactaaaacttaccgaaaacgttaacggaacctaacccgtaagttttaacggttaacctttaagttcgtttacgtttaaccggaaccgttaacgacggtaaacccgtaaacgggttacccgtaacccggttccccggttacgggttaccaacggtaaacccccggaaaccgaacccccctaaacccccgtaaacgttccgttaacccc

SEQ ID NO: 129704 - DNA, 722 bp, Homo sapiens
  misc_feature: GYAE6OF01DCEKY.49.52.E08.1.454.CMB.1.raw
  modified_base (182)..(182): a, c, t, g, unknown or other
  misc_feature (182)..(182): n is a, c, g, or t
  modified_base (224)..(224): a, c, t, g, unknown or other
  misc_feature (224)..(224): n is a, c, g, or t
  modified_base (228)..(228): a, c, t, g, unknown or other
  misc_feature (228)..(228): n is a, c, g, or t
  modified_base (248)..(248): a, c, t, g, unknown or other
  misc_feature (248)..(248): n is a, c, g, or t
  modified_base (554)..(554): a, c, t, g, unknown or other
  misc_feature (554)..(554): n is a, c, g, or t
  modified_base (671)..(671): a, c, t, g, unknown or other
  misc_feature (671)..(671): n is a, c, g, or t
tcagagtcgagagacacgaccggtgctcgatttagtcgagctctcagagagaaagggggtgggtccaggaggcagaactctgggtgtctcaccatggcctggatccctctacttctccccctctcactctctgcacaggctctggacggcctcctatgagctagacacagccacccgtggtntcagtcgcccaggacaggacggccaggatccacgtgcttcgnggangtgctattcgaccaaacgtnttaatcgtactttaagttcggaaccagacgagaaccggcccggggaccgtaaccggtccccgttggttaggttgggtagtaagttagtaaagtaaaacggactacgtaggacggtacggtaccccttaggacggtaacctcccgtaggacggtaacgttcttacgtccgtcggtaccgttaccgaacgggttacggaacggggtacccgtaaaccgggtactaaacgttacggtaccggaccgtaagttccgaacggttacgggtacctaccgggaaggaccgaagggaacggggacgtaacgggntacggtaacgtttagttaagtttcgtaaacgtaactaacgaaccgtaagaccctaaccgtttagttacgttaacgttatcggttactacggtacgtcgacgaacggtacggtacccncggttccgtcgggtcaacgggtcccaacggcccctaaccctagtcgtaccc

SEQ ID NO: 129705 - DNA, 723 bp, Homo sapiens
  misc_feature: GYAE6OF01BF8OZ.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagcccacccgtcggtgtcaggtcgtccccgaggaccaggaccggccaggtactccacctgctcgtggagatgctattcgaccaaacgatatgtacttagttcggtaccagacaacggaacggcccgggaccaccggtcccctggtcggttggtagacgttagtaactaaacggactacgtacggaacgtaccggtacccgtacggaacgggtaccttacccgtaggtaacgcgttactttcgtcgtcggccgtacccgtacgggtacgaacggggtaccctaacgggtacaacgtacggtttccggacctagtcgaagggttcggaacgttaccgagggacgaacgggtaacgggaccgtacgggacttacggtaactttacgttagtttacgtaactaactaacgaacgtacgaacccgtaacgttacgtttacgttaacgttacgttacggtacgttacggtacgttacggaccgtaaccgtacggtcctacccggtgtccgggtacacccggtacccgaaacccggacccctaacccggtcgttccggtaaccc

SEQ ID NO: 129706 - DNA, 583 bp, Homo sapiens
  misc_feature: GYAE6OF01CWIYE.49.52.E08.1.454.CMB.1.raw
  modified_base (224)..(224): a, c, t, g, unknown or other
  misc_feature (224)..(224): n is a, c, g, or t
  modified_base (242)..(242): a, c, t, g, unknown or other
  misc_feature (242)..(242): n is a, c, g, or t
  modified_base (298)..(298): a, c, t, g, unknown or other
  misc_feature (298)..(298): n is a, c, g, or t
  modified_base (438)..(438): a, c, t, g, unknown or other
  misc_feature (438)..(438): n is a, c, g, or t
  modified_base (460)..(460): a, c, t, g, unknown or other
  misc_feature (460)..(460): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacgccaggatcactgctcgtggantgctatcgaccaaaccgntatgtcttagttcggtaccagcgagaacggccggccacggtcccctgtcgttggtntagtgtaagtaaagacacgtagagacgccctagacggactccgtgacgtcgtacttcgtcgtcggcctcgacggtacgacgggactaacggtcactacgttacgcctagtcgaggtgacgtacgagcgaagacgacgagntagactattatgtacatacaanacgacacgtgttagtaccttagtcgttacgtacgtaacgtcgtaccgtaaccgtacggtcccttaccggtcgtaccggtacacccgacccgtaaccgacccctaaacccgcgttccgtacccg

SEQ ID NO: 129707 - DNA, 667 bp, Homo sapiens
  misc_feature: GYAE6OF01D0YSY.49.52.E08.1.454.CMB.1.raw
  modified_base (230)..(230): a, c, t, g, unknown or other
  misc_feature (230)..(230): n is a, c, g, or t
  modified_base (407)..(407): a, c, t, g, unknown or other
  misc_feature (407)..(407): n is a, c, g, or t
  modified_base (428)..(428): a, c, t, g, unknown or other
  misc_feature (428)..(428): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacagggtcctgggcccagtctgccctgactcagcctgcctccgtgtcgtgggtctccgtggacagtcgatcacctatcctcctgcactagaaaccngctagtgagttggttaggaatttacttaaccttttctccgtacggtaaccaacaaccacccgaggaccaaaccgaccccaaactcactactattagtcggacgtaccatcgacggccgtcccgtcggacgggttctcgtagacgtcgtcttctcgtcgcctccgacgtcgtggcacnccggggacctccctaccgtanaactacttcgtacggtcggccttacggacggtacgggtacggggtacgacggtcttaaggtactttaagtttcgtcgtcgttagttacgtaattacggtcgggtaccggttagtaacgttacggggtcggtacgggtaggggttcggtccggggaacgggaacgggtaccggtaacgggtcgaacccggttccgtaggccgaaccgtaccggacgtcccgtccgtccccgtcggtaccc

SEQ ID NO: 129708 - DNA, 683 bp, Homo sapiens
  misc_feature: GYAE6OF01CS3SB.49.52.E08.1.454.CMB.1.raw
  modified_base (225)..(225): a, c, t, g, unknown or other
  misc_feature (225)..(225): n is a, c, g, or t
  modified_base (293)..(293): a, c, t, g, unknown or other
  misc_feature (293)..(293): n is a, c, g, or t
  modified_base (428)..(428): a, c, t, g, unknown or other
  misc_feature (428)..(428): n is a, c, g, or t
tcagagtcgagagacacgaccggtgctcgatttagtcgagctctctcggcggggggggtcaacaagaggcagcgctctcgggacgtctccaccatggcctgggctctgctgctcctcactctcctcactcaggacacagggtcctgggcccagtctgccctgactcagcctgcctcgtgtctgggtctccgtggacagtcgatcacatctcctgcactgaaaccngcagtgatgtggaattatacctttctctcgtacaacacaccaggacaacgcccaactcactctattgngacgacatcgacgccgtccgtcgacgggtctcgtgtactcggtcttctcgtcgtcctaccgtacgtcgtacgggctacgccgacggtccctacccgtagaacctaacgtccgttacggtccgggaccgtacccgngggtaccggttacgggggacgtagggtaccttaggttaaacttacgttttaacgtttcggtccttttacggtttcgtaagttaacgttccgggtacgggttagtacgttacggggtcgggtacggtaacggggttcggttaccggggagggtaacgggaacggtaaacggttcgggaacccggttacgggtaccggttacggaacccggtaccggtaacggtcccgtaccccgggtccccgttcccgggtacccg

SEQ ID NO: 129709 - DNA, 665 bp, Homo sapiens
  misc_feature: GYAE6OF01EVCN4.49.52.E08.1.454.CMB.1.raw
  modified_base (228)..(228): a, c, t, g, unknown or other
  misc_feature (228)..(228): n is a, c, g, or t
  modified_base (248)..(248): a, c, t, g, unknown or other
  misc_feature (248)..(248): n is a, c, g, or t
tcagagtcgagagacacgaccggtgctcgatttagtcgagctctcagagagaaagggggtgggtccaggaggcagaactctgggtgtctcaccatggcctggatccctctacttctccccctctcactctctgcacaggctctgaggcctcctatgagctgacacacgcccaccctggtgtcaggtcgtccccaggaccaggacggccaggatcacctgctcgtgganatgctattcgaccaaaccgntatgcttagttcggtaccagcaagaacgccggccacggccctggtgtggtgatagtataaagacacgtgacgacgcccgtagacggtactcccgtagacgcgtacttcgtcgtcgctccgacggtcgaagggacacggtcactagttcgactatacgtacggtagtacgtacgaggacgaggacgggacgacggtcgtacgtaacgttagtttagtacgtactaataccaaactaacgaacctaaccgtagtttaaccgggttaactttacgtacggttaccgttaacggtaacccgttacggacccgtaaaccgtaacgggttacccgacccggtttaccgtaccggggttaaccaacccgggtaacccccgaaccgggtaacccccctaaaccccggtcgttaccggttaacccc

SEQ ID NO: 129710 - DNA, 722 bp, Homo sapiens
  misc_feature: GYAE6OF01BMJY4.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtcgtccccagaccagacggccaggatcacctgctcgtggagatgcattcgaccaaaaccgattatgtacttagttacggtacccagcaaggaacggcccgggacctaaccggtccccccgttaggttcggtttgggtagtaagttaggttaaactaaacggaccacgtggaacggaccgtccccgtacgagggtaccttcccgtagacgtacgtattccgtcgtacggcctccgaaggttccgaaggggtaaccaaaccgggttcaacgtaaggttcggaccctagtaccgtaggtgggtaacccgtcgaacggtcgaacggaacgggacgggaacgggtccttaagggtaacctttaagttacggtttagtaactaaagttaaccgaaacacgtaaccaaccttagtttacggttaacttagtcgttacgtaccgggtaacttcggaccgtaaccgtacggtcccaacccggttcggtaccggtacaacccggtacccaaccgggaaccccctaaccccggtagtcccgttaacccg

SEQ ID NO: 129711 - DNA, 674 bp, Homo sapiens
  misc_feature: GYAE6OF01DIOKB.49.52.E08.1.454.CMB.1.raw
  modified_base (252)..(252): a, c, t, g, unknown or other
  misc_feature (252)..(252): n is a, c, g, or t
tcagagtcgagagacacgaccggtgctcgatttagtcgagctctcagagagaaagggggtggtccaggaggcagaactctgggtgtctcaccatggcctggatccctctacttcctccccctcctcactctctgcacaggctctgacggcctcctatgagctagacacacgcccacccgtggtgtcagtcgtcccaggacaggacggccaggatcacctgctcgtaggagatcgctagttcgaccaaacgtntactgtactttattcggtaaccagacaaggaacggcccgggacccacggtcccctggtggttggtgtagtgtaaataaagacacgtaggacgaccggtcctacggacggtacctccgtagaacgtcgtcttacgtcgtcggtccgtacgacgggtaccgtaacgggaaccgtaaaccggtcctacgtacgttacggcctaacgtcgtaggtacgggtacgtaccgaggtacgaagggacgggacggacgggtctacggtaactttagtttacgttcggtacgtaccgtaccgacgacgtaccgagtcgtacggtaggtcttaaggttgttacggttcggtacggtccgggagggtacgtacggtacgtccggtacgaccgttacggttacgaccggtaccgacccgacggtccgtaccccgg

SEQ ID NO: 129712 - DNA, 638 bp, Homo sapiens
  misc_feature: GYAE6OF01EIA51.49.52.E08.1.454.CMB.1.raw
  modified_base (317)..(317): a, c, t, g, unknown or other
  misc_feature (317)..(317): n is a, c, g, or t
  modified_base (345)..(345): a, c, t, g, unknown or other
  misc_feature (345)..(345): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacagggtcctgggcccagtctgccctgactcagccctgcctccgtgtctgggtctcctggacagtcgatcaccatctcctgcactagaaaccagcagtgtagttggttagggtaatttattaaccttttctcctggtaccaaactaaccacccaggaccaaacgcccccaaatcatcatttangaggccatcagcgccctgacgggtctcngactcgtcttctcgtggcctccacgtctcggctacgccaccggccctacccgtagacctaatcctagtcggctccgaggcgtagggggacagggtctagtactttagttgttcgtcgttgttacattacggtcggcccgggttagtaacgttagggtacgggaccgggttaaggggttcggttccggggacgggaacggggacccgtaaagggttcggaaccccggtttccggtaaacgggtccgaaccgggacccgaacgggcccctaccgggtccccccgtcgggtacccc

SEQ ID NO: 129713 - DNA, 723 bp, Homo sapiens
  misc_feature: GYAE6OF01D2OK7.49.52.E08.1.454.CMB.1.raw
  modified_base (242)..(242): a, c, t, g, unknown or other
  misc_feature (242)..(242): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacaggacggccaggatcacctgctctggagatgcattgaccaaaccgntatgcttattggtaccagcagaagccggccaggcccctgtgttcggtgatcgtataaagacactgagaggccctagagggactcccgtgacgcgtattcgtactggctaccgaggtcgacgggacaacgggtcacgtagttacgggcctatcgtaggtaggacgttacccgaaggcaaggaacgggaccgagggtaccctaggtaacctttaagtttaacgtttacgggttaaccaaagtttaacccgaaacgtaacgtaaacccgtaaacccgttaagttttaacgggttaaacccttttaagttaccgggtttacctttaacccggggttaaaccttcgggaacccggttaaacccgggtaaaacggggttacccaaccccgggtttcccggtacgggggttacccaaacccggggttaccccccaaaacggggtacccccctaaaacccccccggtacgtttcccggggtaaaccccc

SEQ ID NO: 129714 - DNA, 648 bp, Homo sapiens
  misc_feature: GYAE6OF01A22QG.49.52.E08.1.454.CMB.1.raw
  modified_base (301)..(301): a, c, t, g, unknown or other
  misc_feature (301)..(301): n is a, c, g, or t
tcagagtcgagagacacgaccggtgctcgatttagtcgagctctctcggcgggggggtcacaagaggcagcgctctcgggacgtctccaccatggcctggctctgctgctcctcactctcctcactcaggacacagggtcctgggcccagtctgccctgactcagcctgcctccgtgtctgggtctcctggacagtcgatcaccatctcctgcactgaaaccagcagtgatgttaggaattataaccttttctcctggtaccaacaacacccaggacaaacgcccccaaatcatcatttangagcgatcacgcgccctcgacgggtctctgactcgtcttctctggcctaccgacgtcgtaggcacgccgacccggcctcccgtagaacctaactccgtcgtcgggtcctacccgagggcgtgggggacagggtccttaggtatttattagttcgtacttcgttactaattacggtcggtacccgggttgtaacgttagggtacgggtaccggtaaagggggttgttaccgggggacgggtaacggggtaaccgtaaaaggggtccggtaacccggttccggttaaacgggtcccgaaccggtacccgaaacgggtacccgttcccggtccccccggttgttaccccg

SEQ ID NO: 129715 - DNA, 688 bp, Homo sapiens
  misc_feature: GYAE6OF01BBNV3.49.52.E08.1.454.CMB.1.raw
  modified_base (228)..(228): a, c, t, g, unknown or other
  misc_feature (228)..(228): n is a, c, g, or t
  modified_base (320)..(320): a, c, t, g, unknown or other
  misc_feature (320)..(320): n is a, c, g, or t
tcagagtcgagagacacgaccggtgctcgatttagtcgagctctctcggcggggggggtcacaaggaggcagcgctctcgggacgtctccaccatggcctgggctctgctgctcctcactctcctcactcaggacacagggtcctgggcccagtctgccctgactcagcctgcctccgtgtctgggtctccgtggacagtcgatcaccatctcctgcactagaaaccngcagtgagtggttagggaattattaaccttttctaccgtacggtaaccaaacaaccaccgagacaaacgaccccaaactcatactatttacngacgcgatcgacgccgtcctcgacgggtcctgtcgtactcgtcttcgtcgtcggcctccgtacgtcgtggacacgtccgaccggcccttaccgtagacctatccgtccgtcgggtcctaccggacgggtcggtacggggaacgacgggtcttaagtaacgtttagttccgttacgtacgtttcgttaacgtagttcggtacggtaccggttacgaaggttacgggttaccggggacgggtaacggggttcggtaccgggtaagggggtaacgggaaaccgtaacggggttaccggtaacccggtccgttacgggtaccctaccgggaccccgtaacggtcccgtcccgggtcccccgtccggttaccc

SEQ ID NO: 129716 - DNA, 637 bp, Homo sapiens
  misc_feature: GYAE6OF01C0OCE.49.52.E08.1.454.CMB.1.raw
  modified_base (626)..(626): a, c, t, g, unknown or other
  misc_feature (626)..(626): n is a, c, g, or t
tcagagtcgagagacacgaccggtgctcgatttagtcgagctctcagagagaaagggggtgggtccaggaggcagaactctgggtgtctcaccatggcctggatccctctacttcctccccctcctcactctctgcacaggctctgaggcctcctatgagctgacacacgcccaccctcggtgtcagtcgtccccaggacagacggccaggatcacctgcctctggagatgctattcgaccaaacgatatgtctttaagtcggtaccagcaaggaaggccggccacggcccctgtggttggtgatagtaataaagactagtagagacggccctacgagggactcccgtgaacgtcgtacgttcgtacgtcggtcctaccggtaggtaccgaagggacccgtaaacgggtcaacgtaagtttcggacctagtacgaggttgacggtccgaaggtccgaaggaacgggacgtacggacgtagtaaccttagttagtttacgactaaattacgaaacaagtaacccaacgttagttaggttaactttagtacgtacgttacggaactcggaccgacggtaacgtcctacccggtcgtaccggtacaccgtacccgaacgccccaacccngtaccgtaccg

SEQ ID NO: 129717 - DNA, 830 bp, Homo sapiens
  misc_feature: GYAE6OF01DW63K.49.52.E08.1.454.CMB.1.raw
  modified_base (257)..(257): a, c, t, g, unknown or other
  misc_feature (257)..(257): n is a, c, g, or t
  modified_base (480)..(480): a, c, t, g, unknown or other
  misc_feature (480)..(480): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacgagggtcctgggcccagtctcgccctgacctcacgcctcgcccttccgtcggtcgtcgggtcctccgtggacctaggtccgactccaacctacttcctcctgacctacgtaacgaaaaccngactagtgtagttggttaggtaatttactttaacctttctaccgtacgtaaccaaaccaaccgaccgaacggaaccaaaaccgaccccctaaactactaacttacttaagtttaacgacggaacggtaccgtaacgtaccgaacggtcccggtcccgtacgggtacgggttcctaccgtgtacctccgtcttcgtcgtcggtccctacgtcgtcgtcggaccncggtaccgtacccgcccgtacgtacgtacctacgttcggaccggtcggacccgtacgggacggtccggggagggaacgtcggtagttaagtttaacgttttacgttacgttcggtttaacgtttcgttaactaacgggttaccggttacgggacgggtttaaggttacgggtacggggttaacgggggtacccggggtttaagggggtccggggtaaccggggtaacgggtaaaccggggttaacggaaaccggggttccggttacccgggtaaacggtaccgggtaacccgaccggtaacccgggttaccgaccccgtttccccgggttacccggtccgttaaccccgg

SEQ ID NO: 129718 - DNA, 655 bp, Homo sapiens
  misc_feature: GYAE6OF01DQFZ8.49.52.E08.1.454.CMB.1.raw
  modified_base (252)..(252): a, c, t, g, unknown or other
  misc_feature (252)..(252): n is a, c, g, or t
  modified_base (312)..(312): a, c, t, g, unknown or other
  misc_feature (312)..(312): n is a, c, g, or t
tcagagtcgagagacacgaccggtgctcgatttagtcgagctctcagagaggaaagggggtgggtccaggaggcagaactctgggtgtctcaccatggcctggatccctctacttcctccccctcctcactctctgcacaggctctgaggccctcctatgagctgacacagcccaccctcggtgtcagtcgtccccaggaccaggacggccaaggatccacctgctcgtggagatgctattcgaccaaacgntatgctttattcggtaccagcagaacgccgggccacggcccctggtgttgtgattgtaanaagcactggagacggccctgagggactcccgtgacgtcgtacttctcgtcggtcctccgaggtacgacgggaccaacggtcacgtagttcggacctagtccgtaggtcggacgtaccggaaggacaaggacgggacggagggtactacggtaactttagtttacttcgaactaaataccgaaacaacgtaaccctaacgttaacgtttacggttactttaacgttcgttaccgttaccgggtaagtcgtaaccggtaaaccgtaaccggttccgaacccggtttcccgtcggttacgaacccggtacccgaaacgacccccaaaccccttcgtacgttacccg

SEQ ID NO: 129719 - DNA, 777 bp, Homo sapiens
  misc_feature: GYAE6OF01DIRHX.49.52.E08.1.454.CMB.1.raw
  modified_base (227)..(227): a, c, t, g, unknown or other
  misc_feature (227)..(227): n is a, c, g, or t
  modified_base (246)..(246): a, c, t, g, unknown or other
  misc_feature (246)..(246): n is a, c, g, or t
tcagagtcgagagacacgaccggtgctcgatttagtcgagctctcagagagaaagggggtgggtccaggaggcagaactctgggtgtctcaccatggcctggatccctctacttcctccccctcctcactctctgcacaggctctgaggcctcctatgagctgacacagcccaccctcggtgtcagtcgtccccaggacagacggccaggactcacctgctctgganatgcattcgaccaaaccgntatgtcttattggtaccagacaggaacggccgggccaggcccctggtgttggtgatgtaataaagactacgtggagacggtccctacgagggtactccctgagtcgtaattcgtactggtacctcgtacgggtaccgaacggggtacctaaacgggtccaacgttacggttcgggacctaacgttaccggtagggttacgggtaccggtacccgaacgggacggaaagggaaacggggaccggaggggtaccgtacggtaaacctttaagtttaacgttttacggtaacgtaaactaaccgtaaaaccgaacgtaaaccctaacccgttaaggttttacgggtttaaaccttttacgttacggtttacccggtttaacccgggtaaacctaccgggtaacccggaaacccggtaaacgggttacccccgtaccccgggtttcccggttaccggggtaaccctaaccggtaaaccccccggtaaacccggaaccccccgtaaaacccccgtccgttaccggttaaccccccg

SEQ ID NO: 129720 - DNA, 535 bp, Homo sapiens
  misc_feature: GYAE6OF01CLQQU.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcaagaagccgggccaggcccctgtgttggtgatgtaataaaagacactagagaggccctcgagggactcccgtgacgcgattctcgtggctccgaggtcaaggggacaaacggtcacagttcggctaatcgagtggagtaccgaggcaaggaggacgaggtctgaactagttatttgacaatcaacagacactattgtactatgtctacgactgaccgtacgaaggtcaaccgtcgtcgggtacacgacccgaacggacccaaacccctgtcgtacc

SEQ ID NO: 129721 - DNA, 824 bp, Homo sapiens
  misc_feature: GYAE6OF01DW66D.49.52.E08.1.454.CMB.1.raw
  modified_base (237)..(237): a, c, t, g, unknown or other
  misc_feature (237)..(237): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacgagggtcctgggcccagtctgccccgtgactcacgcctgccttccgtgtcgtgggtcctccgtggacagtcgatcaccattcctcctgccatacgaaaccngctaagtgagttggttaggtaatttaacttaacctttccgtaccgtacggtaaccaaacgaaccaacccgtacggaacctaaaacccgaccccctaaatcaacttacctaattttagacggtacggacctaagtccggacggccgggtacccccttagggtacggggttcctccttaggtacgttccgtcctttcgtccgtcggtaccctttcccgacgttcgtgggacccacgggtacccgtacccggtacccctttaccggaccggtaaccttaaccggtccgtttacccgggtaccgggttacccgtaaaccccgggtcggggtacccggggttcgggggaaccggtacgggttacgtttaaccggttaaagttttttacttaacggtttcgttaccgtttacggttaccgttaagttacggtacggttaccgggttagtaacgttgggtaccgggtacggttacggggttcggttacggggaccgggaacgggttaccgggaacggttcccgtacggttaccggtcgggaccgtaccggacccggtacgtaccccggtcccggtcccccgttggttacccccg

SEQ ID NO: 129722 - DNA, 626 bp, Homo sapiens
  misc_feature: GYAE6OF01C9FW4.49.52.E08.1.454.CMB.1.raw
  modified_base (302)..(302): a, c, t, g, unknown or other
  misc_feature (302)..(302): n is a, c, g, or t
  modified_base (614)..(614): a, c, t, g, unknown or other
  misc_feature (614)..(614): n is a, c, g, or t
tcagagtcgagagacacgaccggtgctcgatttagtcgagctctcagagagaaagggggtgggtccaggaggcagaactctgggtgtctcaccatggcctggatccctctacttcctccccctcctcactctctgcacaggctctgaggcctcctatgagctgacacagcccaccctcggtgtcagtcgtccccaggacagacggccaggatcacctgctctggagatgcagttcgaccaaacgatatgtcttagttcggtaccagcaagaacgcccgggaccacggccctggtcgttggtnagtagtaataaagacacgtgaggacgcctacgaggactccgtgacgcgtattcctacgtggtcctacgtaggtcgaacggggacctaacgggtcaacgtagttcggaccctataccgaggtacggacgtaccgaggccgaaggaacgggacgaggcgtacgtacttatttatcgtaacaactacaaacagaacctacgtattacggtaactttagtcgttaccgttacggtactcggaccgtaaccgaacggttaccctacccggttccgtacgggtccaaccggtaccccgaacggaccccctaaccccgngttcccgtaccg

SEQ ID NO: 129723 - DNA, 601 bp, Homo sapiens
  misc_feature: GYAE6OF01ETVZV.49.52.E08.1.454.CMB.1.raw
  modified_base (428)..(428): a, c, t, g, unknown or other
  misc_feature (428)..(428): n is a, c, g, or t
tcagagtcgagagacacgaccggtgctcgatttagtcgagctctctcggcgggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttaggaattataacctttctctgtaccaacaaccaccagacaaacgacccccaaactcatctatttatgaggccgatcgacgcggccctcgagggtctcgtgactcgcttctctcgctcccacgtctcggcacgcgaccggcctccctagactaacttccgtcgtcgggcctccgacggtcgtacggggacgnggctagtatttattatcgtcttgttcaagttagtcggtcggtagtagttaggtcgggaccgggtaggggtcggttacggggacgggtaagggtaacgaaacgggtcggtaacccggttccgtacgggtccaaccggtaccggacggtcccgtcccgtcccccggtggtacccg

SEQ ID NO: 129724 - DNA, 815 bp, Homo sapiens
  misc_feature: GYAE6OF01AP1C9.49.52.E08.1.454.CMB.1.raw
  modified_base (250)..(250): a, c, t, g, unknown or other
  misc_feature (250)..(250): n is a, c, g, or t
tcagagtcgagagacacgaccggtgctcgatttagtcgagctctcagagaggaaagggggtgggtccaggaggcagaactctgggtgtctcaccatggcctggactccctctacttcctccccctcctcactctctgcacaggctctggacggcctcctatgagctgaccacacgcccacccgtcgggtgtcaggttccgtccccgaggaccaggaccggccgaggactccacctggccttcgtaggagntgactagttcgaacccaaacgtatacgtcgtactttacgttacggtaaccagtacgaacggaaccggccccgggaccgacccggtccccgttggttcgggttagggtagtaagttaggtaaacgtaaacggtacctacgtacgggacggtacccggtaccccgtacggtaacggtcctacccggtaggtaccggtacgttacttccggttaccggttaccgtaccgtccggtacgggtacggacgggtaccgtaccggtactacgtacgtccgaccgtagttacgtaggtacggtaccgtaccggacggtacggaacggaacgggtaccggaggttacgtaacgtacgtttagttacgttaggtaacctaaacgtaccaacgaaccgtacgttaacgttacggtttagtttaaacgtttcgttacgttacccggttaacggtacgttaccgtaacccgggtaaacgtaccggttccccggtaacccgggttcccggtaccgggtaaacccgaccccggtaaccccggtacccgaacccccgtacccttccgggtccctaaccccg

SEQ ID NO: 129725 - DNA, 572 bp, Homo sapiens
  misc_feature: GYAE6OF01CN2RS.49.52.E08.1.454.CMB.1.raw
  modified_base (369)..(369): a, c, t, g, unknown or other
  misc_feature (369)..(369): n is a, c, g, or t
tcagagtcgagagacacgaccggtgctcgatttagtcgagctctctcggcgggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcaccatctcctgcactgaaaccagcagtgatgtggaattataactttctctgtaccacaacaccagacaaacgccccaaactcatcatttatgacgccgatcagccgccctcgacggggtctcgtgactcgtcttctctcggctccacgtctgcagcacggcctccngacatctcgtgggactccgaggcgtcggggacgaggctagtatttacgttattgcttgttactaattagtaggtccgttgaagttcggtacgggaccggaaggggttcgttacggggcgggtaacgggaccgtaagggtcgaccggttccgtaggaccgaaccggcccgtaacgggtccctccggtcccccgtcgggttaccc

SEQ ID NO: 129726 - DNA, 595 bp, Homo sapiens
  misc_feature: GYAE6OF01AVEWY.49.52.E08.1.454.CMB.1.raw
  modified_base (432)..(432): a, c, t, g, unknown or other
  misc_feature (432)..(432): n is a, c, g, or t
tcagagtcgagagacacgaccggtgctcgatttagtcgagctctcagagagaaagggggtgggtccaggaggcagaactctgggtgtctcaccatggcctggatccctctacttcctccccctcctcactctctgcacaggctctgaggcctcctatgagctgacacagccaccctcggtgtcagtgtccccaggacagacggccaggatcacctgctctggagatgcattcgaccaaaccgatatgcttattggtaccagcagaagccggccaggcccctgtgttggtgatgtataaagacactgagaggccctacgaggactccctgagcgattactcgtggtctccagggtcgacgggactaaccgggtcaacgagtttcgaccctatacgtacgttgggaacgttcgaacggcgaacggagggaacgngggactaggaacttagttagttgtactaactacaaacaagtaccaactatttacgggtaactttagtcgttcttacggtaacttcggaccgtaaaccgacggttcccacccggttcgtccgggtacaccggtcccaacggaccccaacccctcgtacgtaccc

SEQ ID NO: 129727 - DNA, 660 bp, Homo sapiens
  misc_feature: GYAE6OF01CY9J3.49.52.E08.1.454.CMB.1.raw
  modified_base (370)..(370): a, c, t, g, unknown or other
  misc_feature (370)..(370): n is a, c, g, or t
  modified_base (413)..(413): a, c, t, g, unknown or other
  misc_feature (413)..(413): n is a, c, g, or t
  modified_base (430)..(430): a, c, t, g, unknown or other
  misc_feature (430)..(430): n is a, c, g, or t
  modified_base (469)..(469): a, c, t, g, unknown or other
  misc_feature (469)..(469): n is a, c, g, or t
tcagagtcgagagacacgaccggtgctcgatttagtcgagctctcagagagaaagggggtgggtccaggaggcagaactctgggtgtctcaccatggcctggatccctctacttcctccccctcctcactctctgcacaggctctgaggcctcctatgagctgacacacgcccaccctggtgtcagtcgtccccaggacagacggccaggactcacctgctcgtggagatgctattcgaccaaacgatagtgtctttagttcggtaaccagacgaaggaacggcccgggaccacggtccccttggttcggttcggtcctattactactacaaagtactaaccgacggcccgccctagacgggtactccgngacgcgtacttcctcgtcgtcctacctacgtcgtacggacacncgcctactctacgaccncgtacgacggaccggactcgacgtctacgtcgagtaggngtacgtatactttaacgttcgtacgtacggacgggtcgggtacgggactacggcccggtacgtacgggttacggggttacggttaccggggcgggtaaacggacccgtaacggtccgttacgggacccggttacgtcgggtaacggtaccgaccggacccggaacggtcccgtcccggtcccccgtaccgg

SEQ ID NO: 129728 - DNA, 686 bp, Homo sapiens
  misc_feature: GYAE6OF01D3GM5.49.52.E08.1.454.CMB.1.raw
tcagagtcgagagacacgaccggtgctcgatttagtcgagctctctcggcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttaggaattataaccttttctctgtaccaacaacaccaggacaaacgccccaaactcatctatttataggacggaccgatcgacggccggtccctacgtacggggtctcgtggactcggtcttctctcggtcctccgacgtcgtacggcacgccgtacccggcccttccctagtacctaacttccgtccgtcgggcccttacccggaagggtccggttaggggggaccgtagggtacctttagtaagttttacgttagtttcggcctttagttactaagtttacgcggtaccgggttgtaacgttgggtaccgggtaccgggttaagggggttcggttacggggacggggtaacgggtaacccgtaaaggggttccgaacccggttaccggtacggtacccgaaccggtacccgaacgggtcccttaccccggtcccccggtgggttacccc

SEQ ID NO: 129729 - DNA, 861 bp, Homo sapiens
  misc_feature: GYAE6OF01BUG5W.49.52.E08.1.454.CMB.1.raw
tcagagtcgagagacacgaccggtgctcgatttagtcgagctctcagagagaaagggggtgggtccaggaggcagaactctgggtgtctcaccatggcctggactccctctacttcctcccctcctcactctctgcacaggctctgaggcctcctatgagctgacacagccaccctcggtgtcagtcgtcccaggacagacggccaggatcacctgctcgtggagatgcattgaccaaacgatatgtcttagttggtaccagacgagaacggcccgggaccgacggccccgtggttcggttggtgtagttagtaaataaaagacgtaacgtggaacggacggacccctacgggaacggggtaactccccggttggaacgtaccggtaacgtttccgtacgttacggtcccgtttacccggaacggggtttaccggaacgggggaaaccgtaaaaccggggtttacccaaaccgttaaacggtttccgggaacccgtaagtttaaccggtaacgggtttaccggggaacggttacccggaaacggggaaccggtaaacggggtaaccggggaaccgggtaacgggtacgttaaaccgggtaaccttttaacgttttaaacgttttacgggttaaactaaaaccgttaaccgaaaaccgtaaacggtaaaccccttaaaccgtaacgttttaacgggtttaacctttaaaggttccgttaccgtttaaccgggaaaccgtttcggacccgtaaacccggttaaacgggttacccgaaccccgggttcccggttacggggtacctaacccggaccccggtaaacccggaaccccctaaacccccgtaccgttccgttaaccccg

SEQ ID NO: 129730 - DNA, 666 bp, Homo sapiens
  misc_feature: GYAE6OF01CWXVU.49.52.E08.1.454.CMB.1.raw
  modified_base (228)..(228): a, c, t, g, unknown or other
  misc_feature (228)..(228): n is a, c, g, or t
  modified_base (319)..(319): a, c, t, g, unknown or other
  misc_feature (319)..(319): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccatcctcctgccactagaaaaccngctagtgagttggttacggaaatttacttaaccttttctcgtacggtaaccaacaaccaccaaggacaaaccgccccaaatcatctattangacgcgatcagccgacctgaggtctctgactcgtcttcgtcgtcgtcctcgacgtctcggcacgacctaccggtccctacgtagacctagtccgtacggtcggcctacggaggtcggtacggggacgtaggtcgtagttaagtttacgttagttcgtcgttgttacgtagttacgtcggtaccgggttagtaacggttacggtacgggaccgggttaaggggttcggttaccgggggacggtaacggggtacccggtaagggtaccggttacccggtcggttaacgggcccgtaaccgggtaccccggtaacgggtccctaccccggtccccgttcgggttaccccg

SEQ ID NO: 129731 - DNA, 709 bp, Homo sapiens
  misc_feature: GYAE6OF01D1SRT.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttcctccccctcctcactctctgcacaggctttgaggcctcctatgagctgacacagcccaccctggtgtcagtcgtccccaggacagacggccaggatcacctgctcgtggagatgctagttcgaacccaaaaccgtattacgtgtctttaagttcggtaaccagacgaaggaacggcccgggaccgacgggtccccttggttcggtttggtagtaagttaggttaaagtaaaacgaccgtaacgtaggaacggtaccggaccccgtacggaacgggtacctaccccggttaggacggtaccgttaactttccgtcgtacgggtccctaccggtaacggtaccggaacgggtaaacccgtaccgggtactaacgtagttccggaccgtagtaccggtagtcggacgtcgaggacgaggacggacggagtcgtagtaacttatttagtgtacaatacaacgacgaacacttagttacgttacttacgtacgtccgttagaccgttcgaccggtaacctaccggtcctacccggttcggtcgggaacccaccggaaccccgaaccgaaccccctaacccgtcctcgtccgtaaccccg

SEQ ID NO: 129732 - DNA, 711 bp, Homo sapiens
  misc_feature: GYAE6OF01DLTZ9.49.52.E08.1.454.CMB.1.raw
tcagagtcgagagacacgaccggtgctcgatttagtcgagctctctcggcggggggggtcacaagaggcagcgctctcgggacgtctccaccatggcctgggctctgctgctcctcactctcctcactcaggacacaggtcctgggcccagtctgccctgactcagcctgcctccgtgtctgggtctccgtggacagtcgatcaccatctcctgcactgaaaccagcagtgatgttggaattatactttctctgtaccaacaacaccagacaaacgccccaactcatcattatgaggccatcagccgcccgtcgacggggtcctctgtactcgtacttctcgtcggtcctccgtacgtcgtcggctacggccgtacccgggtcccttacccgtaggtaacctaaactcccgttacgtcggggtcccttacccggagggtccggttacggggggaccgacggggtcttaggttaagtttacgtttagttcgtactttggttactaattacgtcgggtcccggttaggaacgttagggttacggggaccggttaaacgggggttccggtttaccgggggaacggggtaaccggggtaacccaaagggggtttaccggaaccccgggtttaccggaacggttacccgaaacccgggtaacccccgtaaacggggtccccgttaccccggcccccccggttgggttaaccccccg

SEQ ID NO: 129733 - DNA, 688 bp, Homo sapiens
  misc_feature: GYAE6OF01AKMCA.49.52.E08.1.454.CMB.1.raw
  modified_base (233)..(233): a, c, t, g, unknown or other
  misc_feature (233)..(233): n is a, c, g, or t
  modified_base (251)..(251): a, c, t, g, unknown or other
  misc_feature (251)..(251): n is a, c, g, or t
  modified_base (482)..(482): a, c, t, g, unknown or other
  misc_feature (482)..(482): n is a, c, g, or t
tcagagtcgagagacacgaccggtgctcgatttagtcgagctctcagagagaaagggggtgggtccaggaggcagaactctgggtgtctcaccatggcctggatccctctacttcctccccctcctcactctctgcacaggctctgaggcctcctatgagctgacacacgcccacccgtcggtgtcaggtcgtccccaggacaggacggccaggactccacctgctcgtgganatgctatcgaccaaacgntatgtacttagttcggtaccagcaggaacgccgggaccacggtccccgtgtggttggtagatagtaataaacgactacgtagacggacggcccgtacggagggtaccttcccgaggtacgcgtagttcctacgtcggtcctaccggtacggtcgaacgggaccgtaacggtcctaacgtacgttcggacctagtcgaggtcggacgtcgacggcgtaagggacggtacggnggtctagtaacttagttagttcgtactaactacgaacgaacgtacctaacgttagttacggttacttacgttcgttaccgttaccggtaagtccggtaaccgaacccgtaacgggttccctaaccccgggttccggtaccgggttaacccgacccggtaaccccgtaacccggaacccccctaacccgttccgtccggttaacccc

SEQ ID NO: 129734 - DNA, 736 bp, Homo sapiens
  misc_feature: GYAE6OF01COB4T.49.52.E08.1.454.CMB.1.raw
  modified_base (243)..(243): a, c, t, g, unknown or other
  misc_feature (243)..(243): n is a, c, g, or t
  modified_base (292)..(292): a, c, t, g, unknown or other
  misc_feature (292)..(292): n is a, c, g, or t
tcagagtcgagagacacgaccggtgctcgatttagtcgagctctcagagagaaagggggtgggtccaggagcagaactctgggtgtctcaccatggcctggatccctctacttcctccccctcctcactctctgcacagctctgagcctctatgagctgacacacgcccaccctggtctcagtcgtccccaggacagacggccaggactcactgctcgtggagatagctattcgaccaaacgntatgtcttatggtacagcagaaggccggacacggtcccgtgtgttggtntagtagtaataaacgactacgtaggaaggacggtacccctaggacggggtacctcccgtaggacgtacgttaagttccttcggtacggtcctaccggacgggtacggaaacgggtaaccgtaaccgggttccaacgtacgtttccgggacccaagttaccgtagggtcggtaaccggtcgaacgggccggaaagggaaccgggtagaaccgggtcgtaacgttaaccgtttatttaacggttacgttaacgtaaaccttacgaaaccaacggtaacctaacccgtttaaggttacggttaaccttaaggtccgttaaccgttacgttaaccgcgtaaccggtaaccgaacggttacccgtacccgttcccggttacgggtaccctaacccgggtaaccccgtaaacccgggtaaccccaacccgttaaccgttccgtaaccccg

SEQ ID NO: 129735 - DNA, 738 bp, Homo sapiens
  misc_feature: GYAE6OF01C088S.49.52.E08.1.454.CMB.1.raw
  modified_base (403)..(403): a, c, t, g, unknown or other
  misc_feature (403)..(403): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgacggcctcctatgagctgacacacgcccacccgtcggtgtcaggttcgtaccccgaggacaggaccggccaaggtactccaccgttgctcgtaggagtatgactagttcgaccaaacgtatatcggtactttagttcggtaaccagacgacggaacggcccgggaccacggtcccctgggttggtttaggagtagttagtaaaagtaaacgaccgtacgtaggaacggaccggtccctagggacgggtaccttcccgnggaacgtcgttacttcgtacggtcggtaccgtacggtacgggtaccgaacgggggtaacctaaccgggtactaagtacgtttacggacctaagtccggaaggtcggtacggacgacggtacggaagggaacggacggagtctacggtaactttaagtttcgttaacggactaaccgtaacgaaactacggtaacctacgttacgtttacgttaacttagttacgttaccgttaacggtacctacggtaccgaaccgtagggtacccgtaccgggttacggcggttaacccaccggtaaccccggaacgaccccccgtaacctcgtcggtaacccc

SEQ ID NO: 129736 - DNA, 564 bp, Homo sapiens
  misc_feature: GYAE6OF01BEN21.49.52.E08.1.454.CMB.1.raw
  modified_base (178)..(178): a, c, t, g, unknown or other
  misc_feature (178)..(178): n is a, c, g, or t
  modified_base (302)..(302): a, c, t, g, unknown or other
  misc_feature (302)..(302): n is a, c, g, or t
  modified_base (344)..(344): a, c, t, g, unknown or other
  misc_feature (344)..(344): n is a, c, g, or t
  modified_base (428)..(428): a, c, t, g, unknown or other
  misc_feature (428)..(428): n is a, c, g, or t
  modified_base (443)..(443): a, c, t, g, unknown or other
  misc_feature (443)..(443): n is a, c, g, or t
tcagagtcgagagacacgaccggtgctcgatttagtcgagctctctcggcgggggggtcaacaagaggcagcgctcttgggacgtctccaccatggcctgggctctgctgctcctcactctcctcactcaggacacagggtcctgggcccagtctgccctgactcagcctgcctccgngtctgggtctcctggacagtcgatcaccatctcctgcactgaaaccagcagtgatgttgggaattataacctttctcctggtaccaacaccacccaggcaaatcccccaaaatcaatcatttangaggccatcagccggccctgtaggggtctctgatcgctttcnctcggctccacgtctggccaagcctaccggcctcccgtagacctaactctcgttcgggccttccgagggcgtggggactacggntacgatttatagttnctgttcatatcggcggtcgaagtggtacggccgaagggttcgtcggacgggagggaacgtaaacggtggtaccggtccgtaggtccaacgtacccgaaggcctcgtcccccgtggtacccc

SEQ ID NO: 129737 - DNA, 632 bp, Homo sapiens
  misc_feature: GYAE6OF01A9SYA.49.52.E08.1.454.CMB.1.raw
  modified_base (225)..(225): a, c, t, g, unknown or other
  misc_feature (225)..(225): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgtaggaattattaacctttctctggtaaccaacaacaccaggacaaacgcccccaaactcatctattatgagccatcacggcgccctcgacgggtctcgtagactcgtcttctactcggtctcctacgtctaggcacgcgaccggcctccctgaacctatcctcgtcgggcctccgacgggcggtacggggacgaggtctagtactttagttagttcgtcttgtactatacgtcggtcggttagtagttacggtcgggaccgggttaggggtacggttacgggggcgggtaacgggaaccggtaaacgggtccgggtaaccggttccggtaacgggtaccgaaccgggtaccccgaaacggggtcccgttaccccgtcccccgggttcggttaaccccg

SEQ ID NO: 129738 - DNA, 707 bp, Homo sapiens
  misc_feature: GYAE6OF01CBAAD.49.52.E08.1.454.CMB.1.raw
  modified_base (233)..(233): a, c, t, g, unknown or other
  misc_feature (233)..(233): n is a, c, g, or t
  modified_base (487)..(487): a, c, t, g, unknown or other
  misc_feature (487)..(487): n is a, c, g, or t
tcagagtcgagagacacgaccggtgctcgatttagtcgagctctctcggcgggggggggtcacaagaggcagcactctcgggacgtctccaccatggcctgggctctgctgctcctcactctcctcactcaggacacgagggtcctgggcccagtctgccctgactcagcctgcctccgtgtcgtgggtctccgtggacagtcgatcaccatcctcctgcaactacgaaaccngcagtgagttggttagggtaatttaactttaaccttttcctaccgttacggtaaccaaaccaaccacccgaacggaccaaaccgacccccctaaactcaacttactattttacgcggacggtaccgtactaccgacggcccggcccgtcgggtacggggttcctcgtacgtacgttccgtcttccgtcgtcggtcctcccgtacgtcgtcggcgacgccgacccgcccttcccagactacgtctcgtcggtccncggacggtcgggtgggacgtagggtcttagtagtttacttagttcgtacgttgttactagttacgtcgtacgttagtagtacggttacggtacggtacgggttacggttcgggtacggggtccggggacgggtaaccgggtacgtacgggttacccgtaccgggttaccgtacgggtacccgtaccgggaacccggtaccgtccggtcccccgtccccgg

SEQ ID NO: 129739 - DNA, 756 bp, Homo sapiens
  misc_feature: GYAE6OF01DYV00.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagtccaccctggtgtctgtcgtcctcaggacagacggccaggactcacctgctgtggcatgctagttcgaccaaaaacattatagtaccttaacgtcggtaacccagcgaacggacggaccgacggacccgacggtcccccgttggttccgtttgggttattaaacgttttaaagtaaaacggttacgtttttaggaacggtaccgggtaccccttacggtaaccgggtacccccgttaggaacggtaccggttaactttccgtaccggttcggtcccgttacccgaacggtccgtacggaacgggtaaccaaacgtacggtaccctaccgttacgaaccctatacgtacggtacggacggtcccggacgtaaggacggaacggacgtacgtacgtaacttacgttacttcggtaccgtaggtacccgcgtaaacgacgacgaccgtagggtacgacgttacgttaggttacgttacggttacgttccggggtaacgggtacgggtaaccgtaccgtcgggttccggtaacccggttactaccgggtacgaacccggtacccgaacggtcccgtaccccggtacccccgg

SEQ ID NO: 129740 - DNA, 643 bp, Homo sapiens
  misc_feature: GYAE6OF01B0ZEE.49.52.E08.1.454.CMB.1.raw
  modified_base (230)..(230): a, c, t, g, unknown or other
  misc_feature (230)..(230): n is a, c, g, or t
  modified_base (326)..(326): a, c, t, g, unknown or other
  misc_feature (326)..(326): n is a, c, g, or t
  modified_base (455)..(455): a, c, t, g, unknown or other
  misc_feature (455)..(455): n is a, c, g, or t
  modified_base (489)..(489): a, c, t, g, unknown or other
  misc_feature (489)..(489): n is a, c, g, or t
  modified_base (498)..(498): a, c, t, g, unknown or other
  misc_feature (498)..(498): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacgagggtcctgggcccagtctgccctgactcagcctgcctccgtgtcgtgggtctccgtggacagtcgatcaccatctcctgcactacgaaaccngctagtgtagttggttaggtaattacttaaccttttcctcctacggtaaccaaacaaccaccaggaaccaaccgaccccaaatcatcctatttagngacgaccgtatcgacgcccgtcctcgacggggtcttacgtgacgtccgtcttcgtccgtgcctcctacgtcgtacggaccagtacccgcgcccttccgtacgtactactcctcgggtcggccttaccgngggtcggtacgggcggacgtcgtagttacgtttnttagtcgtntttcgtactagtacgtcggtacgtagtacggtggtacgggtcggttaagggtcggtacgggtcgggaacggaccggtaggtaccggtacccttcggtacgtcccgacggacccgtacggtcctaccccggcccgttcgtaccccg

SEQ ID NO: 129741 - DNA, 672 bp, Homo sapiens
  misc_feature: GYAE6OF01DD78Q.49.52.E08.1.454.CMB.1.raw
  modified_base (179)..(179): a, c, t, g, unknown or other
  misc_feature (179)..(179): n is a, c, g, or t
tcagagtcgagagacacgaccggtgctcgatttagtcgagctctcagagagaaagggggtggtccaggaggcagaactctgggtgtctcaccatggcctggatccctctacttcctcccctcctcactctctgcacaggctctgaggcctctatgagctgacacagccacccgtcggtntcagtcgcccaggacagacggcaggactcacctgctcgaggagatgactattcggaccaaacgtatatgtactttagttggtaccagacaaggaacggccgggaccacggtcccctggttcggttggtagagtagtaataaagacctacgtagaacggacgtccctacggagggtactcccgtaggacgtcgtaacttcgtcgtcggtaccgtccggtacggtacgaacgggtaaccaacgggtacacgtacgttcgggacctagtccgaggtaggacgtaccgaggacgaagggacggaaggacgacgtagtaacttaagttagttagtactaactacgaacgaacgtactaaccgttagttacgttaactttacgtacgttacgttaacgacgttccgaccgtaaaccgtacgggttacccacccggttcggtacgggtaccgaccgtaaccccgaacggaaccccctaaccgtaccgtccggttaacccg

SEQ ID NO: 129742 - DNA, 275 bp, Homo sapiens
  misc_feature: GYAE6OF01EZQ77.49.52.E08.1.454.CMB.1.raw
  modified_base (219)..(275): a, c, t, g, unknown or other
  misc_feature (219)..(275): n is a, c, g, or t
tcagagtcgagagacacgaccggtgctcgatttagtcgagctctctcggcggggcacgaccggtgctcgatttagagagagtgtgttgggtttggggggaagaggaagactgaccggtccccccaggagttcaggtgctgggctacagcggccctgggctgcctggtcaaggacctacttcctctctcgactctgagcgggctggcaaggcgcatacgnnnnnnnnnnnnnnnnnnnnnnnnnnnnnnnnnnnnnnnnnnnnnnnnnnnnnnnnn

SEQ ID NO: 129743 - DNA, 708 bp, Homo sapiens
  misc_feature: GYAE6OF01BP5B0.49.52.E08.1.454.CMB.1.raw
  modified_base (226)..(226): a, c, t, g, unknown or other
  misc_feature (226)..(226): n is a, c, g, or t
  modified_base (322)..(322): a, c, t, g, unknown or other
  misc_feature (322)..(322): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactagaaaccngcagtgagttggttaggtaattacttaaccttttctccgtacggtaaccaaacaaccacccaaggaccaaaccgcccccaaactcatactatttanggacggccgatacgacggccggccctcgtacggggtctcgtcgtactcgtcttcgtcgtcggtcctccgacgtcgtcggctacgccgacccggtccctccgtacgacctaactccgtaccggtcgggtacctaccggacgggtccggtagggggaccgtacggtcgttagtacgttttacgttagttcgtactttagttactaacgttacggtcggtaccgggttagttaagttacgggtacgggtaccgggttaaggggttcgggtaccgggacggggtaaacggggtaccggtaacggggttccggtacccggttccggtacgggtaccgaccgggtacccgtaacgggtcccgttacccggtcccccggttcgggttaccccg

SEQ ID NO: 129744 - DNA, 844 bp, Homo sapiens
  misc_feature: GYAE6OF01DBG05.49.52.E08.1.454.CMB.1.raw
  modified_base (170)..(170): a, c, t, g, unknown or other
  misc_feature (170)..(170): n is a, c, g, or t
  modified_base (204)..(204): a, c, t, g, unknown or other
  misc_feature (204)..(204): n is a, c, g, or t
  modified_base (246)..(246): a, c, t, g, unknown or other
  misc_feature (246)..(246): n is a, c, g, or t
tcagagtcgagagacacgaccggtgctcgatttagtcgagctctctcggcggggggggtcacaagaggcagcgctctcgggacgtctccaccatggcctggctctgctgcctcctcactctcctcactcaggacacgacgggtcctcgggcccagtctcgccctgactcngcctcgcctcgtgtcgtcgggtcctccgtggacngtcgactccaaccatcctccgtcgcctaactacgaaaacccngtacctaggtgtagttagggttacggtaaaattttaaccttaacctttttccgtacccgttaacggtaaacccaaaaccaaacccgaccgaacggaaccaaaaccgaccccctaaactctaatacttaattacgcggacgccgataccgacggtccggcccgtcggtacggtctacgtgtactccgtcttcgtcggtcgtcctaccgcgtcgtggcgacgtccgaccgtccctaccgtagaacctacttccgtcggtaccgggtcccgtacgtacgggggtacgggttacgggggacgtacgggttcgttaaaggtttaattttagtttaacgttcggttcgttaacgggttttacaaacggtttacgttaccgggtaaccggggttgtaaacggtttcgggggttaaccgggggttacggttaaacgggggggtttccgggttaacgggggacgggggtaaacgggtaacccggggtaaacggttaccccgggttaaccggttccgggttaaacccggttcccgggaaaacccggtccccgggttaacgggaccccccgtttccccggggtacccccggtttccggttaacccccgg

SEQ ID NO: 129745 - DNA, 688 bp, Homo sapiens
  misc_feature: GYAE6OF01CNNX6.49.52.E08.1.454.CMB.1.raw
  modified_base (344)..(344): a, c, t, g, unknown or other
  misc_feature (344)..(344): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaacgatatgcttattggtaccagcaagaacgccggaccaggcccctggtgttggagtatagtaataaacgacactaggacgacggccctacgagggaactcccgtagngcgtaattcctcgtcggctcgaggtcgaacgggaccgaaacgtcaactagttacggccatacgaggtaggacgtaccgaaggccgaagggaacggacgacggcgttagtaaccgttattacgttacgactaaactaccgtaaacacggtaaccaaacccgtaggttttacggttaactttacgttagtttaaccggttaacggtaaccgttacgggaacccgttaaacccggtaaacgggttcccgtaaaccccggtttccgggtaccgggttacccggaaacccggtacccccgaaaaccgggtcccccctaaaaaccccggtcttacccgggttaaaccccc

SEQ ID NO: 129746 - DNA, 596 bp, Homo sapiens
  misc_feature: GYAE6OF01BKNNG.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgctattcgaccaaaaccgatatgactttattggtaccagcaagaacgccggccacggcccctggtgttggtgatagtaataaagacacgtgagacggcccctagagggactcccgtgacgcgattctcgtggctccgaggtcgagggacaacggtcacagttggccatcgagtggagtccgaggcaggaggacgaggctagacttagttagttgtacaatacaacgagaacacctagttacggttaacttagtcgtttccgtaacggtaacttggacccgtaaccgtaagggtacctaccccggttacggtacgggtacccaaccgtacccgaaaccggaccccctaaaccccgacgttccgtaacccg

SEQ ID NO: 129747 - DNA, 625 bp, Homo sapiens
  misc_feature: GYAE6OF01BWX1P.49.52.E08.1.454.CMB.1.raw
  modified_base (232)..(232): a, c, t, g, unknown or other
  misc_feature (232)..(232): n is a, c, g, or t
  modified_base (404)..(404): a, c, t, g, unknown or other
  misc_feature (404)..(404): n is a, c, g, or t
  modified_base (447)..(447): a, c, t, g, unknown or other
  misc_feature (447)..(447): n is a, c, g, or t
  modified_base (475)..(475): a, c, t, g, unknown or other
  misc_feature (475)..(475): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacgagggtcctgggcccagtctgccctgactcagcctgcctccgtgtcgtgggtctcctggacagtcgatccacctactctcctgcactacgaaaccngcagtgtagttggttaggtaattacttaaccttttctccgtacggtaaccaacaaccaccacggacaaaccgaccccaactcactactatttagtagacggacactacgacggcccggccctcggtacgggtctcgtgactcgtcttctcgtcgtcctacctcgtctcggcncgtccgaccgtccctctacgactactcgtcgtcggcctacggngggtcgtcgggacgtcgtctagtatttnttatgtacttgtatctaggtcgacggtgacgttcgggcggtacgggtagggtcggttacgggacgggaacgggtacgtaacggggtccgtacccggtcgtacgtaccgacggtaacccgtcgggtaccctccggtcccgttcggtacccg

SEQ ID NO: 129748 - DNA, 744 bp, Homo sapiens
  misc_feature: GYAE6OF01EX1KS.49.52.E08.1.454.CMB.1.raw
  modified_base (341)..(341): a, c, t, g, unknown or other
  misc_feature (341)..(341): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagcccacccgtcggtgtcagtcgtccccgaggacagaccggccaggatccacctgcctctgggagtatgctagttcgacccaaaaccgagttacgtgtactttaattcggtaaccgaagccgaaggaaacggcccgggacccgaacgggcccccgtttagggaggttggtagtangttagtaaagtaacgtacgtacgtacggacggaccggtaccgtacggtacggtaccgtaccgtacgtacggtacgttacgttaccgtccgtcggtaccgtaccggtacggtacggtaacggaacggtaaccgtacgtacgtacgttaccgtaccgtacgtacggtacgggtacggtacggtacggtacggacgaacgggaacgggacggtacgtcgtacgttacgttacgttacgttacgtaactaactaactaacgtaacgtaaccgtaacttaacgttacgtttacgtttacgttacgttaccgttaaccgtaccgtaccgtaccgtaaccggtaccgtacccgtacccgtaccggtaccggtaccgacccgaacccgaacccgaacccgtaacccgtacg

SEQ ID NO: 129749 - DNA, 688 bp, Homo sapiens
  misc_feature: GYAE6OF01CI8HD.49.52.E08.1.454.CMB.1.raw
  modified_base (203)..(203): a, c, t, g, unknown or other
  misc_feature (203)..(203): n is a, c, g, or t
  modified_base (407)..(407): a, c, t, g, unknown or other
  misc_feature (407)..(407): n is a, c, g, or t
  modified_base (638)..(638): a, c, t, g, unknown or other
  misc_feature (638)..(638): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacgacgggtcctgggcccagtctcgccctgactcacgcctcgcctccgtgtcgtgggtcctcgtggacngtcgactacacctactctcctgacaacgacgaaaccgagcgagtgtagttagggttaaggtaacttttaaccttacctttaccgtaccgtaacggtaaccaaaccaaaccaaccgaacggaaccaaacccgaccccaactacgtactacttattagacggtacgaccgtactacgaccggtccgtaccgacggtaggtctacgntacgtctctcgtctacgtcctaccgcgtcgcggaccgacgtcccgtaccgtccctacctacgaactacgtccgtacggtcccgtaccgacggtcgggtacggggacggtaaggtcggttacctaggtttaacgtttagttcttcgttagttaccaggttaaccagggtccgtacggtgttacgggtcggtacgggttacggaggggtacgtcggggacgggtacgaacggngtaccggtaccgagtcgaccgacggccagacccgttccgccgtctaccgg

SEQ ID NO: 129750 - DNA, 648 bp, Homo sapiens
  misc_feature: GYAE6OF01EQAAS.49.52.E08.1.454.CMB.1.raw
  modified_base (370)..(370): a, c, t, g, unknown or other
  misc_feature (370)..(370): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacgagggtcctgggcccagtctgccctgactcagcctgcctccgtgtctgggtctccgtggacagtcgatcaccatctcctgcactacgaaaccagctagtgtagttggttaggtaactttacttaaccttttctaccttacggtaacccaaacaaccaccgaaggaccaaaccgacccccaaactcaactctatttagcgacggccatcgacgccgtcctacggacgggttttcngtcgactcgtcttctcgtcgcctccgacgtctggcacgccgaccggtccctcccgtagactacgtccgtcgtcgggtacctccggagggcggtacggggacgacgggtcttagttactttagttcgttcgtcttcgtactagtcgtcggtcgtagtagttacggacggtaccgggtagggttcggtacgggacgggaacgggtaacgtaacgggtcgaacccggttcgacggtacgaccggtacccgtaacggtccctcccggcccccgttggtaccc

SEQ ID NO: 129751 - DNA, 943 bp, Homo sapiens
  misc_feature: GYAE6OF01EAI7E.49.52.E08.1.454.CMB.1.raw
  modified_base (300)..(300): a, c, t, g, unknown or other
  misc_feature (300)..(300): n is a, c, g, or t
tcagagtcgagagacacgaccggtgctcgatttagtcgagctctcagagaggaaagggggtgggtccaggaggcagaactctgggtgtctcaccatggcctggatccctctacttcctccccctcctcactctctgcacaggctctgacggcctcctatgagctgacacacgccctacccgtcggtgtcctaaggtccgtccccgaaggaccgaaggacccgggaccaacgggtactccaacccttggcctcggtgggaagtacgttcgacctagtttaccgaacccgtaaaaaccggtnttaagttacgtacgttttaacgttacggtaaacccgaagacgaacgggaaccggaccccggggaccgaacccggtccccggttgggttcggtttacgggtgtaaggttaggttaaaacgtaaaacggtacctaacgtacgggaacggtaccggtacccccgttagggtaacggggtaaccttccccggtaaggacggtaccggttaacgtttccgtccgggttaccggtaccggtttacccgaaacggggtccggtaacggggtaaacccgtaacgggtaacctaacgttaacggttcggaacccgttacggtaccgtaagggttacgggaaccggtttaaccgaagggaaccggtaacgggaacggggtaacgggaacggtaccgtttaagtaaccgttttaaacggtttatttaaccggtaacgtaaactaccgaaaaccgtaccgtaaacctaccgttaaaggtttcgtttaaacgttacgttacggtttaacccggttaacgaaccggttacgggtacccgtaaaccggtaaccgggttcccgttaacccggtcccggggttaccgtaccgggtaacccccggtaaccccggtaacccgggaaaccccccttaccccggtaaggttcccggttaacccc

SEQ ID NO: 129752 - DNA, 813 bp, Homo sapiens
  misc_feature: GYAE6OF01D407B.49.52.E08.1.454.CMB.1.raw
  modified_base (228)..(228): a, c, t, g, unknown or other
  misc_feature (228)..(228): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcaccatctcctgcactacgaaaccngcagtgattggttaggaatttacttaaccttttctccgtacggtaaccaacaaccaccaggaccaaacgccccaaactcatctatttagcggacgccgatcgacgccggccctggacgggtctctagtactcgtccttctcgtcggtcctaccgtacgtcgtcggacacgaccgaccggtccctcctacggtaactaacttcccgttcggtccgggtaccgttcccggacgggtccggggttacggggaaccggtacgggttacgtttaacgttaagtttttaacgtttaacgtttccgggtacttttccggtttaacgttacggtttaacggttccggggtacccgggtttagggttaaccggtttaacggggttaccgggggtaaccgggttaaacggggggtttccggggttacccggggggtaaaccgggggtaacccggggtaaacccgggttaacgggggttacccggtaaccccgggtttacccgggttaaccgggtaacccgaaccccgggtaccccggttaaacgggtcccccggtttacccccgggttcccccccggtttacgggttaacccccg

SEQ ID NO: 129753 - DNA, 789 bp, Homo sapiens
  misc_feature: GYAE6OF01EDIN5.49.52.E08.1.454.CMB.1.raw
  modified_base (241)..(241): a, c, t, g, unknown or other
  misc_feature (241)..(241): n is a, c, g, or t
  modified_base (359)..(359): a, c, t, g, unknown or other
  misc_feature (359)..(359): n is a, c, g, or t
  modified_base (366)..(366): a, c, t, g, unknown or other
  misc_feature (366)..(366): n is a, c, g, or t
  modified_base (396)..(396): a, c, t, g, unknown or other
  misc_feature (396)..(396): n is a, c, g, or t
  modified_base (748)..(748): a, c, t, g, unknown or other
  misc_feature (748)..(748): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacgacgggtcctcgggcccagtctcgccctgactcagcctcgcctcgtgtcgtgggtcctcgtggacagtcgactccactagtctcctgactaccgtacgaaaccgngcgtaggtgtacgttaggttacgggtaacttttacgtttaacccgttttccgtaccgttacgtaacccaaacgtaaccaccgacggaaccaacccgaccccaagtcactctattacgngacgcancgcgcgccgtacgcggtctgctagtccgtnttcgcgtcgccgttacgacgttccgtacgacgtaccgacgtaccgtcccgtaccgtacgaaccgtttaccgtccgtaccgtcgggtaccccgtacgggacggttaccggggttaaccgggggcttaacccggggttacttaagttacggtttaacgttttcggtttcggttaacggtcctttacgtaaggtcccgggtttacggtacgggttaaacggtttcgtacggggtacggggtaacccgggttgggggtcgggtttacccgggaacgggggtaaccgtaacccgggtttaggacccccgggtttacgttaccggccggggttaaccgaccccgggttaaacccgggngggtcccccttacccgggtacccccgtaccgggtttacccg

SEQ ID NO: 129754 - DNA, 646 bp, Homo sapiens
  misc_feature: GYAE6OF01EPOK5.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatccacctgcctcgtggagatgcagttcgaccaaaaccgataatgtcttattggtaccagacagaacgccggccacggcccctgtggttggtgagttagtaagaaagacactggacggacggccctacgacggtactcccgtgacgcgtacttctcgtcggcctaccgagggtacgacggggtaaccgaacggtaccacgtagttcggacctagtacgtaggtaggacgtaccgaggacgaagggacggaacggacggtccgtagtacctttaattacgttagtaacctaataccaaacgtacgaactaccgtagtttacgttaacgttattcgttacgtacgggtaacctcggaaccgtaaccgtaacgtacccgtaccggtccgtcgggtaccaaccggtacccgaaccggtaccccaacccgtatccgtacccg

SEQ ID NO: 129755 - DNA, 639 bp, Homo sapiens
  misc_feature: GYAE6OF01ALE8Q.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagcccaccctcggtgtcagtcgtcccccaggacagacggccaggatccacctgcctctggagatgctattcgacccaaaaccgattatgtacttatttacggtaccagcaggaacgcccgggccacggccccctgtgttggtgatgtataaagacacgtgagacgccctcgaggactcccgtgacgcgtattctcgtggcctcgacggtcgtacgggaacgacggtcacgtagttcggaccagtcgagtacgggacgtccgacgggacgtaagggacgggtacgagggtcgtacgtaacttaagttacttagtactaaattaccgaaacaagaaccctaccgtaagtttacggttaactttagttaccgttacgtttaccggaacgttcggtacccgaccgtaaacgggttccaacccggttccgtcgggtacctacggaccccgaacgaccccaacccctacgtgtaccccg

SEQ ID NO: 129756 - DNA, 640 bp, Homo sapiens
  misc_feature: GYAE6OF01BF5XL.49.52.E08.1.454.CMB.1.raw
  modified_base (250)..(250): a, c, t, g, unknown or other
  misc_feature (250)..(250): n is a, c, g, or t
  modified_base (441)..(441): a, c, t, g, unknown or other
  misc_feature (441)..(441): n is a, c, g, or t
  modified_base (468)..(468): a, c, t, g, unknown or other
  misc_feature (468)..(468): n is a, c, g, or t
tcagagtcgagagacacgaccggtgctcgatttagtcgagctctcagagagaaagggggtgggtccaggaggcagaactctgggtgtctcaccatggcctggatccctctacttcctcccctcctcactctctgcacaggctctgacggcctcctatgagctgacacagcccaccctcggtgtcagtcgtcccaggacaggaccggccaggactcacctgctcgtggagtatcgctattcgaccaaacgntatgtcttagttcggacagcaaggacgccggccacggtcctggtgttggtgtatagtaagtaaacgacacgtgacggacgtccctagacgggactccgtaggacgtcgtattccgtgtcgctccgaggtcgaggtacacggtcagtgtcgactgcaggtgtacgacgaggacaagggtacggacggacgtntacggtaattaacgtttagtacgtaanaaacgttaccgaaacaacggtacccaacgttagtttacggttaactttagtaccgtttacggtaacgtacgtacgtaccggaacccgttaacggtcctacccggttccggtacggttaacccacccggttaacccgaaacccgtacccccgtaaacccctgtaccggtaccc

SEQ ID NO: 129757 - DNA, 685 bp, Homo sapiens
  misc_feature: GYAE6OF01BQAZK.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttcctccccctcctcactctctgcacaggctctgaggcctcctatgagctgacacagcccaccctcggtgtcagttcgtccccaggacaggacggccgaggactcacctgctcgtggagatgctattcgaccaaaccgatatgtcttagttcggtaaccagaccgaaggaacggcccggggaccgtaaccgggtcccccgttggttcgggttgggtagtagttagtaaagtaaacgactacgtagacggaccggtacccgtacgacgggactcccgtacggtagaccgtattcgtccgtcggtacctccggacggtacggacggggaacgtaacggtcgactaggttcgacctatcgaggtggacgtaccgaggacgagggacggacggaggctagtaactttattagttgtacaactactaacgacgtaaccaccgttagtttacgttacttacgtacgttccgtacggtaactcggtaccgtaaccgtacggttacccgtacccggtccgtacggtacccgaaccggtaccccgaaccggaccccctaaaccccgtccgttacgtaccccg

SEQ ID NO: 129758 - DNA, 701 bp, Homo sapiens
  misc_feature: GYAE6OF01ANONL.49.52.E08.1.454.CMB.1.raw
  modified_base (223)..(223): a, c, t, g, unknown or other
  misc_feature (223)..(223): n is a, c, g, or t
  modified_base (336)..(336): a, c, t, g, unknown or other
  misc_feature (336)..(336): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacgccaggatcacctgctctgganatgcattcgacccaaaccgtatatgtacttattggtaccagcagaacgccggcacggcccctgtcgttggtgatgtaataaagacacgtgagacggcctacgaggactcccgngacgcgtattccgtacgtcggctaccgaggtacgaacgggtacctaacgggtcaacgtagttcgggaccctaagtcgtaaggtcggaacgtccgaagggtaccaagggtacgggaacggacggtaccgttacggtaacctttaagtttacgttacggttacctaaagtccgaaaacgtaacggaaccctaaccgttaacgtttacggttaacctttagttacggttaaccgttaccgggtaaccgttaccggtaaccggtaacccgtaacgggttccctaaaccccgggttcggttacccgggtaaccacccggtaaccccgtaaccggaacccccgtaaccccgtaaccgttccgttaaccccg

SEQ ID NO: 129759 - DNA, 865 bp, Homo sapiens
  misc_feature: GYAE6OF01BELHB.49.52.E08.1.454.CMB.1.raw
tcagagtcgagagacacgaccggtgctcgatttagtcgagctctcagagaggaaagggggtgggtccaggaggcagaactctgggtgtctcaccatggcctggatccctctacttctccccctctcactctctgcacaggctctggaggcctctatgacgctgacacacgcccacccgtcggtgtcagtcgtcccgaggacaggacggccaggactcacctgctcgtggagtatgactattcgacctaaacgatagtgtacttagttacggtaccagtacgaacggacggcccgggaccaccgggtccccgttggttggtttacgggtagtaacgttaggtaaactaaaacggacgtaacgtaggaacggtaccggtaccccgtacgggtaacgggtaacccgttcccgtagggacgtaccggttctttaccgtaccggttccggtacccgtaccgtaacggggttaccgaaaccgggggtaacccgtaaaccgggttacccaaacggttaaccggttccgggaaccccgttaagtacccggttaagggtaccggggtaaccgtaccgggtaacggaaccggtaacgggaacgggaacccgggaggtacccgttaggtaacgttttaagttacgttacggtaacctaaacgtacgaaaacgtaaccgtaacccgtacgttaacggttttacggttaaactttacggttaccggtttaacccgttaacgggttaaccggtacggtaaaccccgggttaaaccgtaaacccggttcccggtaacccggttccgggaccgggttaaacccgaccccggaacccggtaaccccggaccccctaaccccggtacgttcccgttaaccccg

SEQ ID NO: 129760 - DNA, 588 bp, Homo sapiens
  misc_feature: GYAE6OF01EFVIQ.49.52.E08.1.454.CMB.1.raw
  modified_base (244)..(244): a, c, t, g, unknown or other
  misc_feature (244)..(244): n is a, c, g, or t
  modified_base (276)..(276): a, c, t, g, unknown or other
  misc_feature (276)..(276): n is a, c, g, or t
  modified_base (292)..(292): a, c, t, g, unknown or other
  misc_feature (292)..(292): n is a, c, g, or t
  modified_base (301)..(301): a, c, t, g, unknown or other
  misc_feature (301)..(301): n is a, c, g, or t
tcagagtcgagagacacgaccggtgctcgattttagtcgagctctcagagaggaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctggagatgcattgaccaaaacgntatgcttagttggtaccagacagacgccggcncggccctgttgttggngatagtaanaaagcgagtgagacgcctcgaggtaccctgagcgggacttggctaggcgcgagtacgaggagaacgagtacgattagcgatcagtagcgtcaagcgacgagggacaaacgggtcaggtaccgtaattaacgttgtcgaaacttacaaacctaagaaacgttcgaacttaagggttaccttacttagtacgttacggtacctaaggtcccggacgttaaacgggtcctacgtccccgtagggtcgtaacggtcccaacgggaccaacccttcccaaagtcgtaacccg

SEQ ID NO: 129761 - DNA, 826 bp, Homo sapiens
  misc_feature: GYAE6OF01DP6GA.49.52.E08.1.454.CMB.1.raw
tcagagtcgagagacacgaccggtgctcgatttagtcgagctctctcggcggggggggtcacaagaggcagcgctctcgggacgtctccaccatggcctggctctgctgctcctcactctcctcactcaggacacagggtcctgggcccagtctcgccctgactcagcctgcctccgtgtcgtgggtcctcgtggactagtcgactcaccatcctcctgacacgtacgaaaccgtgctaagttgaagttggttaagggttaacttaacgtttaacccttttccgtaccgttacggtaaacccaaaacaaccgaacccgaacggaaccaaaccgaaccccctaaaacttccaacttactagttttaagacggtacggacctacgtccaacggcccggtaccgtacgggtaacggggtctacgtgtaccgtcgtccttcgtcgtcggccttccgaacggttcgcggtacacggaccgtcccggtaccctccgtaacgaaccttaacgtccggttaccgtcgggcccttacgggaagggtccgggtaacggggtaccgggtacgtacgttacggttaaacttttaaggtttaccgttacggttacttacgtttaacgtacgtttaacggttccgggtacgggttaacgtaacggttacgggacggggttaaaccggggtagggggtttacccgggttacgggaaccggggggtaaaacggttaaccgggtacggggttaacccgggttaacccgggttcgttaaccgggaaccgtaaacggtaccccggtaaacggcccggttacccccggtcccggtaccgtttcccg

SEQ ID NO: 129762 - DNA, 662 bp, Homo sapiens
  misc_feature: GYAE6OF01EK1X5.49.52.E08.1.454.CMB.1.raw
  modified_base (218)..(218): a, c, t, g, unknown or other
  misc_feature (218)..(218): n is a, c, g, or t
  modified_base (222)..(222): a, c, t, g, unknown or other
  misc_feature (222)..(222): n is a, c, g, or t
  modified_base (296)..(296): a, c, t, g, unknown or other
  misc_feature (296)..(296): n is a, c, g, or t
  modified_base (306)..(306): a, c, t, g, unknown or other
  misc_feature (306)..(306): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctctatgagctgacacagcccaccctggtgtcagtcgtccccaggacagacggccaggatcacctgctntggngatgcattcgaccaaaacgatatgcttattggtaccagcagaacgccgggaccacggcccctgttacggttggngattagtaanaaagcactagacgacggccctcgagggcctccgtagcggactactcttcggcgtccacggtcgtacgggacggaaacgtcgtaacgacttaggtccgactcacgtggaggtcctacggcgaacgagggacggaacgggacgtgacgtaattacgttagttctaaactacaaacaacgaacgacccgtaactttaaggttaccgtttaaacttgttaccgtttcgggttaacgttaaccgtaccgggtacccgaaaaccgggttaccgaacccggttacccctttcggggtccggtaacgtcccccggaaaccggttaccgaaaccccccgaaccccgttacggttccgtaaccccg

SEQ ID NO: 129763 - DNA, 692 bp, Homo sapiens
  misc_feature: GYAE6OF01C0NFP.49.52.E08.1.454.CMB.1.raw
  modified_base (329)..(329): a, c, t, g, unknown or other
  misc_feature (329)..(329): n is a, c, g, or t
tcagagtcgagagacacgaccggtgctcgatttagtcgagctctcagagagaaagggggtgggtccaggaggcagaactctgggtgtctcaccatggcctggatccctctacttcctccccctcctcactctctgcacaggctctgacggcctctatgagctgacacacgcccacccgtggtgtcagtcgtcccaggacacggacgccagactcaccgtgctcgtaggagtactcgactacgttcgaacccgaaacgtatatcgtactttagtttcgggaacctagacgaaggaacggccggaccgacggtccccgtggtgttacggtnaagttgtaataaacgacgtacgtggacgacgccgtacgacggtaccgtaccctggacgtcgtacttcgtcgtcggtacctcggacggtcgaacgggactaacggcaacgtcgtacggactacgtcgacggttcgacggtaccgaggacgagggacggaacgacggtcaagttaccttaagtttacttacgtaactaacgaaccgtaaacgaacggtaaccctaaacgttatttacgggtttaactttaggtacgttaccgtttaacggaaaccttcggaccgaaccgttacggacccttcccggtcgtacggacccgaacgtaaccccggtaaccgaaccccaacccgtcgtcccggttaccc

SEQ ID NO: 129764 - DNA, 744 bp, Homo sapiens
  misc_feature: GYAE6OF01EPKR7.49.52.E08.1.454.CMB.1.raw
  modified_base (234)..(234): a, c, t, g, unknown or other
  misc_feature (234)..(234): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacgagggtcctgggcccagtctgccctgactcagcctgcctccgtgtctgggtctccgtggacagtcgatcaccatctcctgcactagaaaccagcagtnagttggttaggtaatttacttaaccttttctccgtacggtaacctaaaccaacctaccgaacggaccaaaccgacccccaaactcatactatttatcggaggccgatcgacggtcccgtccgtacgtacgggtctcgtaggtactccgtacttcgtcgtcgtacctccgtacgtcgcggccacggccgtaccgtccctacccgtacgtactacgttccgtccggttcggtaccgtcccggagggtcgggtacgggggtacgacgggttcttacggttaacttttacgtttacttcggtccgtttacgttacgtagttacggttaccgggtccgggtaaggtaaccggttagggtaccggggtaaccggttaggggttcgggttaccgggaccggggtaacggggtaacccggtaagggttaccgggtaaccccggttcggtaaccgggtccgtaacccgggtacccggtaacgggttccccgtccccggttaccccgtccgggttacccc

SEQ ID NO: 129765 - DNA, 697 bp, Homo sapiens
  misc_feature: GYAE6OF01AP75J.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttcctccccctcctcactctctgcacaggctctgaggcctcctatgagctgacacagcccaccctcggtgtcagtcgtccccaggacagacggccaggatcacctgctctggagatgctattcgacccaaaaccgattatgtactttagttcggtacccagcgaaggaacggcccgggccacggccccttggtggttggtgattagtaataaagacacgtggagacggcccctagacggggacttcccgtagacgacgtatttcctcgtcggtcctccgaaggtccgaacggggacctaaccggtcaacgtagttcggacctagtacgtaggtacgggacgtaccgaacgggcgtaacggacgggacggacggcgttagtaaccgtttaagttactttggtaaccaaacgttaccaaacgtaccgaacctaaccgttaagtttacgtttaacgttacgttacgttaccggttaccggttactacggtacccgtaacccggtaacggttccctacccggttccgttacgggtacccacccggaccccgtaaaccgggaccccctaaccccgtacgtccgttacccg

SEQ ID NO: 129766 - DNA, 658 bp, Homo sapiens
  misc_feature: GYAE6OF01A003N.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtcgtcccccagggacaggaccggccaggatcacctgctctggagatgcattcgacccaaaccgatatgtctttattggtaccagcaaggaacggcccgggaccacggcccccttggtggtttgggtgtattagtaagtaaaagacgaacgtggacgtacggccctcgagggtactcccgtggacgcgtacttccgtcgtcggctccgacggtcgaaggggaccgaacggtcacgtagttcggacctatcgaggtggacgtaccgaggcgaaggacggacggacgcgtaggtacttaagttagttacgtactaacgtacaaaccgtagaaccgtaacctaacgtttaggttaactttacgtacgttccgttaccggtaacgttcgtacccggtaaccgtaacggtccctaccggttcccgtacgggaccaccggaccccgtaaccggacccccaaccccgtacgccgttaacccg

SEQ ID NO: 129767 - DNA, 643 bp, Homo sapiens
  misc_feature: GYAE6OF01BQ348.49.52.E08.1.454.CMB.1.raw
  modified_base (229)..(229): a, c, t, g, unknown or other
  misc_feature (229)..(229): n is a, c, g, or t
  modified_base (495)..(495): a, c, t, g, unknown or other
  misc_feature (495)..(495): n is a, c, g, or t
  modified_base (502)..(502): a, c, t, g, unknown or other
  misc_feature (502)..(502): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacgagggtcctgggcccagtctgccctgactcagcctgcctccgtgtctgggtctccgtggacagtcgatcaccatctcctgcactacgaaaccngcagtgatggttaggtaattacttaacctttctctacgtaccaacaccaccagacaacgaccccaactcatactattagtgacggcatcgacgccggtccgtcggtacgggtctacgtcgtacgtcgtcttccgtcgtcgtccctaccgtacgtcggtacgacgacgccgacccggtccctaccgtacgtaacctacgttcctccggtcggtccgtcgacgggtacgggtacgggaccgaggtctagttaatttagttagttcgtnttacgtntagttacgtggtacgtagttaggtcggtacgggtacgggtagggttcgggtacgggtacgggaacggtaacggtaacggtaccgtaccgggttccgtacggacgtaccgtaccggacgtcccgtcccgtcccgtcgtcccg

SEQ ID NO: 129768 - DNA, 737 bp, Homo sapiens
  misc_feature: GYAE6OF01DZ4II.49.52.E08.1.454.CMB.1.raw
tcagagtcgagagacacgaccggtgctcgatttagtcgagctctctcggcgggggggggtcacaagaggcagcgctctcgggacgtctccaccatggcctgggctctgctgctcctcactctcctcactcaggacacgagggtcctcgggcccagtctcgccctgactcagcctcgcctccgtgtcgtcgggtctccgtggacagtcgactccacctatcctcctcgacactacgaaaccagcagtgagttggttaggtaattacttaaccttttctaccgtacgtaaccaacaaccaccgacgaccaaaccgaccccaactcatactattagtcgacggaccgtactacgacggccggtccctcgggggggggggtactcgtcgtagtactcgtcttcgtcgtcgtcctccgtacgtcgtcgaccgtcggccgaccggtcctaccgtacgtactacgtccgtcgtcggccgtacggacgggcgggtagggacggtaggtcttagtactttacgttacgtcgacgtacgtactaactaacgtaactaaactaaaccgttaaacttaaccggttacgggtttacggggttaccgggttccgggaaccgggttaaaccgggaaacccgttaaaccggtacccggttaacccggtacccggttacccgggtaccgaacccgggtacccggtaacccgggtcccgacccccggttaccccggtccggttcccgttaccccg

SEQ ID NO: 129769 - DNA, 703 bp, Homo sapiens
  misc_feature: GYAE6OF01D12WE.49.52.E08.1.454.CMB.1.raw
tcagagtcgagagacacgaccggtgctcgatttagtcgagctctcagagaggaaagggggtgggtccaggaggcagaactctgggtgtctcaccatggcctggatccctctacttcctccccctcctcactctctgcacaggctctgaggcctcctatgagctgacacagcccacccgtcggtgtcagtcgtccccaggacagaccggccaggatcacctgcctcgtggagtatgcagttcgaccaaaaccgatatagtctttagttcggtaccagcaaggaacggccgggccacggcccctggttggttggtgagtacgtaagtaaacgactacgtaggagaccggtccctacggacggtactcccgtaggagtccggtaatttccgtcgtcgggtcctaccgtaggtaccggaacgggaaccgtacgggtacaacgtagttacgggccctaagtccgtaggttcgggaacgttaccgaggtacgaaggaacggacggaggtcgtacgtagtagtttatgtaactaatacaaacgacgaacctaacttagtttaccgttaacgttacgtttcgtaccgttaaccggtaattccggaaccgtaaacccgggtaaccgttacccggtaccccggttaccgggtaccggtaccgaaccccgtaacccgaaacccggacccccaaaccccgtcgtcccgtaacccg

SEQ ID NO: 129770 - DNA, 613 bp, Homo sapiens
  misc_feature: GYAE6OF01CKSSA.49.52.E08.1.454.CMB.1.raw
  modified_base (307)..(307): a, c, t, g, unknown or other
  misc_feature (307)..(307): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagcccaccctcggtgtcaggttcgtcccccaggaccaggaccggccagggactccacctgctctgggagatgctattcgacccaaaccgatatgctttattcggtaccagcaagaagccgggccacggcccctgtgttggngatgtaataaagcacgtgaggacgccctcgagggactcccgtagacgcgtacgttcctcgtcggcctccgagggtcaggggaccaacggtcacgtagttcggaccagtcgaggtcggacgtccgaggcgaggaggacggaggcttagacttatttacgttacgtacaaagtcaacacgacctaaccgtagttacggttacttagtcgtacttacggtactcggaccgtaccgtaaggtcccgacccgttccggtcgggtaccctaccggacccaaccgggacccaaaccccgtcgttcgtaccccg

SEQ ID NO: 129771 - DNA, 237 bp, Homo sapiens
  misc_feature: GYAE6OF01BKG7I.49.52.E08.1.454.CMB.1.raw
  modified_base (216)..(237): a, c, t, g, unknown or other
  misc_feature (216)..(237): n is a, c, g, or t
tcagagtcgagagacacgaccggtgctcgatttagtcgagctctcgtcgcgggcacgaccggtgctcgatttagagagagtgtggttgggtttgggggaagaggaagactgaccggtccccccaggagttcaggtgctgggcacagcggccctgggctgcctggtcaaggactacttctctctcgactctggagcgggctgggcaaggcgcatagnnnnnnnnnnnnnnnnnnnnnn

SEQ ID NO: 129772 - DNA, 704 bp, Homo sapiens
  misc_feature: GYAE6OF01BOOZ3.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctcccctcctcactctctgcacaggctctgaggcctcctatgagctgacacagccacccgtggtgtcagtcgtcccaggacagacggccaggatcacctgctctggagtatgcattcgaccaaacgatatgtcttattcggtaccagcagaacgccgggtaccacggtcccctggtggttggtgtatagtataaagactactgacgacgcctagaggactccgtaggacgctattcgtcgtcggtactccgaggtacgaacgggtacaacggtcaacgtcgttcggaccctatcgaagttgggacgtaccgacggacgagggaacgggaccggtacgggtccgttaaggtaaccgtttaagtttacggtttacgtaaccggtaaacttaaccgaaaacggtaaccgaaacccgttaaacccttaggttttaaccgggtttaaacgttttacgttaccgggttaccgtttaaccgggaaccgttacgggaaccccgtaacgggtaaaccggttcccgtaacccggttcccggtacggtacccaacgggtaaccccaacggtaccccccaaaccctcgtcccgttaaacccg

SEQ ID NO: 129773 - DNA, 851 bp, Homo sapiens
  misc_feature: GYAE6OF01CA63X.49.52.E08.1.454.CMB.1.raw
tcagagtcgagagacacgaccggtgctcgatttagtcgagctctctcggcggggggggtcacaagaggcagcgctctcgggacgtctccaccatggcctgggctctgctgctcctcactctcctcactcaggacacgagggtcctcgggcccagtctgccctgactcagcctgcctccgtgtcgtgggtctccgtggacagtcgatcaccatcctcctgcctactacgaaaccagctagtgatggtaaggtaattacgttaacctttctaccgtacggtaaccaaacctaaccgaaccgtaacggacctaaaacccgacccccaaacctactaactcttaagtttacgacgggtaccggtccgaactcgaaccgcccggtacccgtacgggtacgggttcttacgtcgtaccgtccgtcgttccgtcgtccggtccgtaccctaccggttccgacggaccgacggcccgtaccgggtacccttacccgtacgtaacctacgttccgtccggtcgggtaccgttaccgggacggggtaccgggtacgggggtaacccggtacgggtaacgtttaacggtttaacgttttaaggtttaaccgtttcggtaacgttttaggtttaacccgtaaaggttccggttaacccgggttcccgggttaaaggttaaccggggtttaacgggaccccgggggttaacggggttaagggggttcccggggtaaacgggtaccggggaaaaggggttaaccggttaaacggggttcccggtaacccggggtttcgaccgggtaacccgaccgggtacccggtacggtacccggtccccccgttacccgggtccggtaccccg

SEQ ID NO: 129774 - DNA, 770 bp, Homo sapiens
  misc_feature: GYAE6OF01D9RVV.49.52.E08.1.454.CMB.1.raw
  modified_base (197)..(197): a, c, t, g, unknown or other
  misc_feature (197)..(197): n is a, c, g, or t
  modified_base (228)..(228): a, c, t, g, unknown or other
  misc_feature (228)..(228): n is a, c, g, or t
  modified_base (327)..(327): a, c, t, g, unknown or other
  misc_feature (327)..(327): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacgagggtcctgggcccagtctgccctgactcagcctgcctccgtgtctgggtctcctggacngtcgatcaccatcctcctgcactagaaaccngcagtgagttggttaggtaatttacgttaacccttttctaccgtacggtaaccaaactaaccaccgaggaccaaaccgcccccaaatcatctatttagnggacggccgatcgacggtcccggcccgtacggtacggggttacctcgtacgtacgtccgtctttccgtcgtcggtccttacccgtacggttccgtacgggtaccgacggtacccggtaacccggtccccttacccgtacggtaaccttaacgttcccgttaccggtccgggtacccttcccgggaacgggtcgggtacgggggaccgtacgggtccgttaggttaacttttacgtttacgttcgttacgtttaccgttagtacgtttacggtcgggtccgggttaaggttacggttacgggttcgggaccggggttaagggttccgggttaccggggaccggggaacgggtaccggtaacgggtccggtacccgggttacgtacgggttaccgacccgggtaccgaacgggtcccgtacccggtcccccgttacggtaccccg

SEQ ID NO: 129775 - DNA, 865 bp, Homo sapiens
  misc_feature: GYAE6OF01AGDB9.49.52.E08.1.454.CMB.1.raw
tcagagtcgagagacacgaccggtgctcgatttagtcgagctctcagagagaaagggggtggtccaggaggcagaactctgggtgtctcaccatggcctggactccctctacttcctcccctcctcactctctgcacgaggctctgacgcctctatgagctagaccacacgccctacccgtggtctctagtccgtaccccgaggacacggaccggcgaaggtaccttccgaccgtggtccttacggtaggacgtacgtcgacttacgttaccgaaacccgtaaaaccgttgttacgttacgttaccgtttaacgttaccgggtaacccgaaggtaacgtaaccgggaaaccggggtccccgggaacccgtccgggtacccccgttgggttacgggttaggtacggtaaggttacgtaaaccggttaaaacgccgtaacggtacggtaaccggtaccccgggtacctacgggtaacggttaccgtacccggtagtacgtaccgttacgttccgtcggtaccgtaccgtacggtacggtacggaacgggtacctaccggtacgtaccgttacgtacggtactaacggtcggtacggttacggaccgtaaccgggaggtaaccggacggacgggtaaccggagttaccgtaagttacgtacgtttctaaaccggtactaaacggttaccaaaccgtaccgtaaccgtacgttacgtttacgttaacttcggttacgtaaccggttaccgtaaggtaccccggaacgtaaccggttccgttacccgaacccggtttggtaaccccgggtaaccgaccccggtaaaccccggaccctaaaccccggtaccctacgttcccgttaaccccg

SEQ ID NO: 129776 - DNA, 713 bp, Homo sapiens
  misc_feature: GYAE6OF01EOAFL.49.52.E08.1.454.CMB.1.raw
  modified_base (243)..(243): a, c, t, g, unknown or other
  misc_feature (243)..(243): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgcattcgaccaaacgntatgtcttatggtaccagcagaacgccggaccacggcccctgttggttggtgatagtaataaagacacgtgagacggccctcgaggtactcccgtagagcgtattctcgtcgctcgacgtcgacggacgaacggtcactagttcgacctagtcgacggtagggtacgtacgacgggacgtaacgggaacgggtaccggacggtcgttacgtaacgtttaatttacgttacggttaactaacgtaaccgaaacgaacggtaccctaaccgtaacgttttaacggtttaacgtttaacgttacggtttacccgttaacgggttaaaccgttaccgggtaacccggtaaacccggttaaaccgggttacccccggtaaccgggttttaccccggtacgggggttaaccccaacccgggttaaccccgaaacccgggttaccccccaaaccccgttcggtacccgttaaccccg

SEQ ID NO: 129777 - DNA, 813 bp, Homo sapiens
  misc_feature: GYAE6OF01CAJG0.49.52.E08.1.454.CMB.1.raw
  modified_base (799)..(799): a, c, t, g, unknown or other
  misc_feature (799)..(799): n is a, c, g, or t
tcagagtcgagagacacgaccggtgctcgatttagtcgagctctcagagagaaagggggtgggtccaggaggcagaactctgggtgtctcaccatggcctggatccctctacttcctccccctctcactctctgcacaggctctgaggcctcctagtgagcctgacaacacgcccaccctggtgtcagtcgtcccaggacagacggccaagatcactgctagtggagatgactaattcgaccaaaacggtatatcgtacttagttggtaccagaccgaaggaaacggcccgggtaccaacgggtcccccgttggttcggtttgggtagaacgttaggtaaacttaaaagaccaacgttacggaaggaccgggacccccgttagaacgggggtaactttccccgtaggaccggtacgttaactttccgttcggttgggacccttacccggaagggttaccgaacgggggtaaacccaaacggggttccaaacgtaacgtttccggaccaacgttccgaagggttagggaacggtacccgtaagggaccgaaaggggtaaccgggaacgggaagggttacccgttaagggtaaccctttaagtttaaagtttaacggttaaccaaaacgtttaacctaaaacgtaaacggaacccctaaaccggttaaccgttttaagggttaaacccttttagttaccgttccgtttaacgggtaactaccggtaccggaaaccgtacgggtacctaaccccggtcggtacgggtacctacgggacccctaaacggacccccctaaaccnccgtttaggacccc

SEQ ID NO: 129778 - DNA, 722 bp, Homo sapiens
  misc_feature: GYAE6OF01A0435.49.52.E08.1.454.CMB.1.raw
  modified_base (180)..(180): a, c, t, g, unknown or other
  misc_feature (180)..(180): n is a, c, g, or t
  modified_base (242)..(242): a, c, t, g, unknown or other
  misc_feature (242)..(242): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagtcaccctcggtntctgtgtcctcaggacagacggccaggatccacctgctcgtggcgatgcattcgaccaaaanatatgtcttactcggtaccagcagacggccacggccacggtcccctgtcttggtgtatttaataaacgtactttagacggtacgccccgtacgaccgggacccctggacgcgtacttccgtccgtagggtccctaccgacgtccgtacgacggggaaaccaacgacgttaccctaacccgtttacgacctactacgtacggtagggtaccggtcccgggacccgaagggaccggacggacgggtccgtacgtaaccgttacttttaccgtcggttccgaacggtccccgactaaccggaaccgtaggtaccgtacgggttcgggtaacctacggtttacgtcggttaccgggttaacggttcccggggtacggggtacgggtaaccggtaccggtaccggttccggtaccccgggttacccgttaccgggtaccgacccggtaacccggaccggttcccgtacccccgggttccccccgg

SEQ ID NO: 129779 - DNA, 681 bp, Homo sapiens
  misc_feature: GYAE6OF01B91UL.49.52.E08.1.454.CMB.1.raw
  modified_base (161)..(161): a, c, t, g, unknown or other
  misc_feature (161)..(161): n is a, c, g, or t
  modified_base (229)..(229): a, c, t, g, unknown or other
  misc_feature (229)..(229): n is a, c, g, or t
  modified_base (449)..(449): a, c, t, g, unknown or other
  misc_feature (449)..(449): n is a, c, g, or t
  modified_base (470)..(470): a, c, t, g, unknown or other
  misc_feature (470)..(470): n is a, c, g, or t
tcagagtcgagagacacgaccggtgctcgatttagtcgagctctcagagaggaaagggggtgggtccaggaggcagaactcgtgggtgtctcaccatggcctggatccctctacttcctccccctctcactctctgcacaggctctgacggcctctatganctagacacacgccctaccgtcggtgtcagtcgcccaggacagacgccgaggactcacctgctcgtganatgactactcgaaccaacgtatatcgtacttagttacgacagacaggacggccggccaccggtccgttggtgttcggtagtattacgtaaataaacggactacggtaggacggtaccgtacccgtaggacgggtacctccgtagacgtcgtacgttctcgtcgcgtacggacggtacgaaggaccgtaacgtcacgtgtacgactagtcgaggtcgacgngaggcgtaaggacgggtacgngtacgtactaagttattacgtacaactaagtaaccaaccgtaagtaacctacgtttacgttacgtttaacttaccgttcggttaaccgttaacggtacccgtaggtaacccggtaaaccggttcggacccgttacccggtcccgggttacgggaaccctaccccggtaacccgtaacccggaccccctaaccgtaccgttacttaaccccg

SEQ ID NO: 129780 - DNA, 640 bp, Homo sapiens
  misc_feature: GYAE6OF01CREDJ.49.52.E08.1.454.CMB.1.raw
  modified_base (295)..(295): a, c, t, g, unknown or other
  misc_feature (295)..(295): n is a, c, g, or t
  modified_base (306)..(306): a, c, t, g, unknown or other
  misc_feature (306)..(306): n is a, c, g, or t
  modified_base (550)..(550): a, c, t, g, unknown or other
  misc_feature (550)..(550): n is a, c, g, or t
  modified_base (630)..(630): a, c, t, g, unknown or other
  misc_feature (630)..(630): n is a, c, g, or t
tcagagtcgagagacacgaccggtgctcgatttagtcgagctctcagagagaaagggggtggtccaggaggcagaactctgggtgtctcaccatggcctggatccctctacttcctccccctcctcactctctgcacagctctgaggcctcctatgagctgacacacgcccacctcggtgtcagtcgccccaggacagacgccagatcacctgctcgtggagatgctattcgaccaaacgtatatgacttagtggtaccagacgagaacgccgggcacggtcccctgtggtggtnatgtaataaanacagtgagacgccctagaggtactccgtaggacgtacgtattccgttcgacggtcctaccggaggtaccggaagggaccgaaacggttccaagtaagtttccgggaccctaagttacgaacggttacgggacgtaaccgagggaccgaaggtaagggacggtaacgggtactagtaaccttaagtttacgttagttacaaacgttacaaacgtaacgacctaacgtactttaggtacttaagtntaccggttacgatcggaccaaccggtaaggtcctacccgtacggtccgggtacaccgacccgtaaacgaccctaaccccnttcgtaaccc

SEQ ID NO: 129781 - DNA, 685 bp, Homo sapiens
  misc_feature: GYAE6OF01D5JE4.49.52.E08.1.454.CMB.1.raw
  modified_base (200)..(200): a, c, t, g, unknown or other
  misc_feature (200)..(200): n is a, c, g, or t
  modified_base (236)..(236): a, c, t, g, unknown or other
  misc_feature (236)..(236): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacgacgggtcctgggcccagtctcgccctgactcagcctgcctcgtgtcgtggtcctccgtggacngtcgactcacctatcctcctgaccactaagaaaccngtcgagtgtagttggttagtaatttaacttacctttctcgtacgtaaccaacaaccaccgaacggaaccaaaccgaccccctaactctacttactacttacgcggacgacctacgtcgacggcccgtacccgtgggtacgggtcttacgtcgtacgtccgtacttccgtcgtcgtccgtaccgtcggtcgtcggacgccgtccgacccgtcctaccgtacgtaactaccgtcggtccggtcggacctccgggagggtcgggtacggggaacgtcgtacgttaggttatttacggttgtcgtttacgttcttagacgttagggtccggtacgggtagtacgggtacgggtcggtaccgggtgggtccggggtacggacgggtaacgggaccgtacgggtaccgacggttcgacggtcaccggtacgcggtccgtcccgccgtcggtcccg

SEQ ID NO: 129782 - DNA, 682 bp, Homo sapiens
  misc_feature: GYAE6OF01EPXXF.49.52.E08.1.454.CMB.1.raw
  modified_base (180)..(180): a, c, t, g, unknown or other
  misc_feature (180)..(180): n is a, c, g, or t
  modified_base (228)..(228): a, c, t, g, unknown or other
  misc_feature (228)..(228): n is a, c, g, or t
  modified_base (249)..(249): a, c, t, g, unknown or other
  misc_feature (249)..(249): n is a, c, g, or t
tcagagtcgagagacacgaccggtgctcgatttagtcgagctctcagagagaaagggggtgggtccaggaggcagaactctgggtgtctcaccatggcctggatccctctacttcctccccctctcactctctgcacaggctctgaggcctcctatgagctgacacagcccaccctggtntcagtcgtccccgaggacaggaccgccaggactcacctgctcgtgganatgctattcgaaccaaacgtntacgtgtacttagttacggtaaccacgacgaacggaacggcccgggaccgaccggtccccttagggttggttgggtacgtagttaggtaaacgtaaaacgaccgtacgtacggaacggtacggtcccctaggacggtacctcccgtaggacgtacgtacttcgtcgtcgtccgtacgacggtcgaggaccgacgtacacgtacgtcgactagtacgaggtagacgtacgaggacgaggaggcgaggtctagtacttattacgtgtaacctaataccaaacgtaacgtactaaccgttagtttacgttaactttacgttacgttaccgttaacgacgtaccggaaccgtaaccggtacggtacccgtaccggtccggtaccgggtaccaaacccggtcccgaaaccgaaccccctacccgtcgtccgttacccc

SEQ ID NO: 129783 - DNA, 667 bp, Homo sapiens
  misc_feature: GYAE6OF01ARGXA.49.52.E08.1.454.CMB.1.raw
  modified_base (244)..(244): a, c, t, g, unknown or other
  misc_feature (244)..(244): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgaccacagcccaccctcggtgtcagtcgtccccaggacagcgccaggactcacctgctctggagatgctatcgaccaaaccgntatgcttagttgtaccagcagaacgccgggccacggccccctggtggttggtgagttacgtaagtaaacgacacgtggaacgacggccccgtacgacgggactccccgtggacgtcgtactttccgtacgtcggtcctccgtacggtacggaacgggaaccgtaacggtaccgaacgtacggttcggaccctacgttcgaaggttggtaacggtcccgaggaccgagggacggacgacgggctagacctttaagtttattcggtacaactccaaacgtaacgaacctaacgtagttcggttaacttagttcttacggttacgacgtaccgtaccgaaccggtacggtacccgtacccggtccgttccgggtacccgaaccggacccgtaaccggaccccctaaccccgtccgtacgtaccccg

SEQ ID NO: 129784 - DNA, 1089 bp, Homo sapiens
  misc_feature: GYAE6OF01ENVZQ.49.52.E08.1.454.CMB.1.raw
tcagagtcgagagacacgaccggtgctcgatttagtcgagctctcagagagaaagggggtggtccaggaggcagaactctgggtgtctcaccatggcctggactccctctacttcctccccctctcactctctgcacgaggctctgacgtcctctatgagtctagacacgacgccctacccgtggttcgtctacgtccgtacccccgaaggaccgacggaccggaccgaaggtacttccgaccgttcgtccttaggtacggaagtacgtcggtaccttagttacccggaacccgtaaaacgtattacgttacgttacgtttaacgttaaccggttaacccgaggtaaccggaaacgggtaaccggggcccccggggtaacccgtaacccggggttcccccgtttgggggtttacgggtttaccggtaaggttaacgttaacggttaaaaacgtaaaccggtaacccgtaaacgttacgggaaccggttaacccgggtaccccgttaaacggggaaccccgggtttaaccgttaccccgggtaacgggtaaccggtttaccggtttaaaccgtttttacccggtccgggttaacccggtttccccggttaaccggggtaaaccggggttaacccgggaaacgggttaaaaccggtaaccccggttacgtaaaccggtttacgggtaccggtaaccgttaaccggtaacgtttaacccgggtaacggggtaccgtaacccgggtaacgggaaccggtaacgggttaaaaccggggacggtttaacccgggtacgtttaaccggttaaccgtttttaaacggttacgtttttaaccgaacccgtttaaacgtaaccccgtaaacgtaacccggttaaaccttaacccgggttaagtttttaacggttttaacctttaagggtacccgttttccgtaaaccgggttaccctacgggtaaaccccggtttaaaccggtaccggttcccccggttaaccggttacccgggtacgggttaaacccacccccggggttaaacccgtaaaccccggggaaccccctttaacccggaaccgtttccgttaaacccccgg

SEQ ID NO: 129785 - DNA, 758 bp, Homo sapiens
  misc_feature: GYAE6OF01EYLE7.49.52.E08.1.454.CMB.1.raw
  modified_base (232)..(232): a, c, t, g, unknown or other
  misc_feature (232)..(232): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacgagggtcctgggcccagtctgccctgactcagcctgcctcgtgtcgtggtctccgtggacagtcgactcaccatcctcctgcacgtaacgaaaccngcagtgtagttaggtacggttaactttacttaaccttttccgtaccgtacggtaaacccaaaaccgaaccctaacccgaacggaacctaaaaccccggtaccccctaaaaacttccaacgtttaacttaacgttttaacgcggacggtacccgtaactccgacggcccggtcccgtacggtacgggttcctcgtacgtacgttctaccgtttcgtcgtccgtctaccgtacgtcgcgaccgacgtccgaccgttacctacctaacgacctacgttccgtcgtacggtcgtacggacgggtacggtacggggtacgtacgtacgttaaggtttacttagtttacgttcgttacgttacgttagtacgttacgtccggtacggttatacggtagggtaccgggtacgggttagggttccgggtaggggtaaccggtaaagggtacggtaacggtacccggtcggtaaccgggtacgtacccgaacggtacccgggtactacccgtacccggtccccggtagtaccccg

SEQ ID NO: 129786 - DNA, 656 bp, Homo sapiens
  misc_feature: GYAE6OF01B35H9.49.52.E08.1.454.CMB.1.raw
  modified_base (202)..(202): a, c, t, g, unknown or other
  misc_feature (202)..(202): n is a, c, g, or t
  modified_base (515)..(515): a, c, t, g, unknown or other
  misc_feature (515)..(515): n is a, c, g, or t
  modified_base (521)..(521): a, c, t, g, unknown or other
  misc_feature (521)..(521): n is a, c, g, or t
  modified_base (624)..(624): a, c, t, g, unknown or other
  misc_feature (624)..(624): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacgacgggtcctgggcccagtctcgccctgactcgagcctgcctacgtgtctcgggtctccgtggacngtcgatccactatcgtcctgcactacgaaaccagcgtagtggattggttaagggtaatttacttaaccttttctcctacggtaaccaacaaccaccacggaacaaaccgaccccaactctactactatttacgacggaggaccgtacgtacgacggtccggcccgtaacggtacgggttcctacgtcgtaccgttcgccgttcgtcgttccggtacctaccgtcgtcgacgcgtacgccgtacccggccttaccacgtacctagtccgtgtcgccgtcgtaagggcggtaacgggctgtctagttaattcgtnttcgtnttcggtctaagtccgttgacgggttgacggttacggtccgggtaggtaaggtcgggtcgggacggtaacggcggtaacggtcgacgtccgtacgtccgaaccncggtaacggtccctcgtcccccgtgtaacccg

SEQ ID NO: 129787 - DNA, 787 bp, Homo sapiens
  misc_feature: GYAE6OF01EGH1M.49.52.E08.1.454.CMB.1.raw
  modified_base (504)..(504): a, c, t, g, unknown or other
  misc_feature (504)..(504): n is a, c, g, or t
  modified_base (755)..(755): a, c, t, g, unknown or other
  misc_feature (755)..(755): n is a, c, g, or t
tcagagtcgagagacacgaccggtgctcgatttagtcgagctctctcggcggggggggtcacaagaggcagcgctctcgggacgtctccaccatggcctgggctctgctgcctcctcactctcctcactcaggacacgacgggtcctcgggcccagtctcgccctgactcagcctgcctcgtgtcgtcggtctccgtggacagtcgatcacctactcctcccgcaactacgaaccagactagtagtagttaggttaaggtaaactttaacctttaacccttttcgacccgtaagtaacccaaacaacccgacccgaacggaaccaaacccaccccccctaaatactaacttactaagtttagacggaccggaccgtactaccggacggtccccgtcccgtaacgggtcgggttcctacgtagtaccgtccgtttcttaccgtcggtcccggtacctccggtacgtcgacggcctacgtacccgtaccggtccctacccggtaanaaccgtacgttccgaccgggttccggaccgtaccgggacgggtccgggtaaaggggtccgtaaacgttcgtttaacgttaacgttttaacgtttcgttcggtaccgtttacctggttaaacgtccgggttaccggtaccgggttagtaaacggttcgggggtaacgggtacccggggtagggttacgggaccggggtacgggtaaacggtacgtaacgggtcccgaacgttcgacgtacggaccgtaccgngtcccgacccgtcccggtcgtaccttcccggg

SEQ ID NO: 129788 - DNA, 942 bp, Homo sapiens
  misc_feature: GYAE6OF01C3L16.49.52.E08.1.454.CMB.1.raw
  modified_base (165)..(165): a, c, t, g, unknown or other
  misc_feature (165)..(165): n is a, c, g, or t
  modified_base (497)..(497): a, c, t, g, unknown or other
  misc_feature (497)..(497): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacgaggtcctggcccagtctgccctgactcngcctgcctcgtgtctcgggtctcccgtgacgtcgtactactaccacctctcctcgcgacctaacgacgaaacgcgacgtagtagtagttaggggttaacttaactttaccgtttacctttccgtacgtaaccgtaaccaaaccacccgtaaccggaaacgtaaccgaaaccccctaacccctaataccttattaaccgttagttacgtaaggacccgaacgttagacccgaacgggtcccgtacccgtggggtaccgtcttaccgtacgtaccgttccggttacttcccggtacggtccggtacccctttaacggtcccgttaacccggggngtaacccgtaccccggtacccggttccccgtacccgttaaccggtaacgttaacccgtttccgtaccggggttacccggtacgggttacccgggtaacggggtaacggggtacgggggttaacccggggaacggttacgtttaacgtttaacgtttacggttttaacctttcggtacggttttacgttaaccggtttacgtaacggttaccggggttaccgggttaacggttacggttacggttaacgggggttacccggggtacccggggtttaacggggttccggggaacgggtaaacgggtaaaacccggggtaacggtacccgggttacccgggttaacccggttcccggggttaaacgttaaacccccggggtaaccccgtaccgggttacccccgggtcccccgtttaccccggttaaccccgggttcccgttaacccg

SEQ ID NO: 129789 - DNA, 795 bp, Homo sapiens
  misc_feature: GYAE6OF01EGJU0.49.52.E08.1.454.CMB.1.raw
  modified_base (199)..(199): a, c, t, g, unknown or other
  misc_feature (199)..(199): n is a, c, g, or t
  modified_base (237)..(237): a, c, t, g, unknown or other
  misc_feature (237)..(237): n is a, c, g, or t
tcagagtcgagagacacgaccggtgctcgattttagtcgagctctctcggcggggggggtcacaagaggcagcgctcgtcgggacgtctccaccatggcctggctctgctgctcctcactcctcctcactcaggacacgtagggtcctgggcccagtctggccctgactcgagcctgcctcgtgtctgggtctctgacngtcgatccacgtatcctccgtgaccaactacgaaaccngacagtgtaatcggtaggtaattacgttacctttctaccgttacgtaccaaactaaccaccgacggaaccaaaccgacccctaaatccaatctagtttagcggtacgacctagtccgacgtcccggtccttaccgggtacgggttccttacgtaggttacgtccgttccgttcgtaccgttcggtcctaccgtaccggttcgtacgacggaaccgcccgtacccggtacccgtacccgtaacgtaaaccgtttacgttccggtttaccggtaaccgggttccccgtaacgggtaaccgggtacggggttaacccgggggaccgttaacggggtttacccttaagggttttaaaccgtttagttttaaccgggttcgttacgtttacgtttaccgaagtttacggtaccggttacgggtagttaaacggttcggggtacgggtaccggggttaagggttccgggtaaacgggccgggtaaagtaccggtaacgggtccttaacccggtcggtacgtaccgaccgttaccgacgtcccgtccggtacccgtcggttaccc

SEQ ID NO: 129790 - DNA, 778 bp, Homo sapiens
  misc_feature: GYAE6OF01E1FNZ.49.52.E08.1.454.CMB.1.raw
  modified_base (181)..(181): a, c, t, g, unknown or other
  misc_feature (181)..(181): n is a, c, g, or t
tcagagtcgagagacacgaccggtgctcgatttagtcgagctctcagagagaaagggggtgggtccaggaggcagaactctgggtgtctcaccatggcctggatccctctacttctccccctctcactctctgcacaggctctgaggcctctagtgagctgacacagcccacccgtcggtntcagtcgtccccgaggacacggacggccaggactcaccttggctacgtggaagactgacctagttaccggaaccctaaaaccgtattacgttcgtacttttaacgttacgggtaacccaggaccgtaaggaaccggcccggggaccctaaccgggtcccccttaggttcggtttaggtggtacgttaggtaaataaacggacctacgttaggaacggtacggtccccgttaaggacgggtacctcccgtaggacgtacgtacttaccgtcgtcggtaccgtaccggtacgggtacgaacggggtacctaacccgggttacaacgtacgtttacgggaccctagttcccggaaggttaccggtacgtacccggagggtaccgaaagggacgggaaccggaggtaccgttaggtaactttacgtttaagttcggtaacctaaagtaccgaaccgaacggtaacccgtacgttaagttacggtttaacttcggttacgtttaccttacggaccgttacggacccgtaaccgtacggttcccgtaaccgtcggttaccggaccaccgtacccgaccgaacccctacccgtgtcgtaacccg

SEQ ID NO: 129791 - DNA, 727 bp, Homo sapiens
  misc_feature: GYAE6OF01CJTLH.49.52.E08.1.454.CMB.1.raw
  modified_base (183)..(183): a, c, t, g, unknown or other
  misc_feature (183)..(183): n is a, c, g, or t
  modified_base (238)..(238): a, c, t, g, unknown or other
  misc_feature (238)..(238): n is a, c, g, or t
tcagagtcgagagacacgaccggtgctcgatttagtcgagctctcagagagaaagggggtgggtccaggaggcagaactctgggtgtctcaccatggcctggactccctctacttcctccccctcctcactctctgcacaggctctgacggcctctatgagctgacacacgcccaccctggtntcaggtccgtccccgaggacacggaccggccaggactccaccgtgctcgtagganatcgatattcgaaccaaacgtatagtgtactttagttcggtacctagactaaggaacggcccgggaccgtacggtccccgttgggtggttcgggtagtaagttaggttaaactaaaacggaactaacgttaggacgggtaccggacccgtacggaaccgggtacttacccggtagaacgtcgttacttccggtgtccggtccgtaccggtacgggtacggaacgggtaacgtaaccggtactacgtacgttacggacctaacgtaggacggttacgggacgtaccgacggacgtagggaaggacggacggtcgtacgtaacttaagtttacgttacgtaacttaaaccacaaaccgaactaaccgtacgttagtttaaggttacctttgtacgttaccggttcggtaatccgaccgtaaccgtacggtacctaccggtcggttacggaccgaccgacccggaacaccccgtaaacccttcgtcgtaccc

SEQ ID NO: 129792 - DNA, 700 bp, Homo sapiens
  misc_feature: GYAE6OF01ATJ13.49.52.E08.1.454.CMB.1.raw
  modified_base (230)..(230): a, c, t, g, unknown or other
  misc_feature (230)..(230): n is a, c, g, or t
  modified_base (327)..(327): a, c, t, g, unknown or other
  misc_feature (327)..(327): n is a, c, g, or t
tcagagtcgagagacacgaccggtgctcgatttagtcgagctctctcggcggggggggtcacaagaggcagcgctctcgggacgtctccaccatggcctggctctgctgctcctcactctcctcactcaggacacgagggtcctgggcccagtctgccctgactcacgcctgcctccgtgtctgggtctcctggacagtcgatccaccatcctcctgacactcgaaaccngcagtgattggttaggtaattacttaaccttttctccgtacggtaaccaacaaccacccaggaccaaaccgacccccaaactccatctaatttacgngacggccgatccgacgccggaccctcggacggggtctcgtcgtactccgtcttcctcgtcgtcctccgtacgtcgtcggaccacgccgtacccggtccctacccgtacgaactacgtcccgttcgtacgggtcctaccggtacgggtccgggtacggggaaccgtgggtaccgttaggttaaccgttttagtttacgttcggttaccgttacgtttactacggttacggtcggtaccgggtaggttaccggttacgggtacgggtacgggttagggtccgggttacgggcgggtaacgggtacggtacgggtccgacccggttacgcggtacccgacggtacccgacggtacctcccggtcccgtccggtccc

SEQ ID NO: 129793 - DNA, 705 bp, Homo sapiens
  misc_feature: GYAE6OF01C7IWD.49.52.E08.1.454.CMB.1.raw
  modified_base (63)..(63): a, c, t, g, unknown or other
  misc_feature (63)..(63): n is a, c, g, or t
  modified_base (175)..(175): a, c, t, g, unknown or other
  misc_feature (175)..(175): n is a, c, g, or t
tcagagtcgagagacacgaccggtgctcgatttagtcgagctctctcggcggggggggtcaanaagaggcagcgctctcgggacgtctccaccatggcctgggctctgctgctcctcactcctcctcactcgaggaccacgacgggtcctcgggcccagtctcgccctgacctcncgtcctgtccctcgtgtcgtcgggttctccgtggacgagtcgactccacctactctcctcgacctacgtacgaaaccagctaggtgagttggttacggtaattacttacctttaccgtcctacggtaacccaacgaaccaaccgacggaaccaaaccgaccccaactctactaccttattagcgaacgacgctacgaccgccggtcccgtacggacggtcgtactagtaccttcgttaccttcggtccgtcgtaccctacgtacgtcgtcggaccgacgccgtccgtccctaccgtacgaactaccgtcgttcgaccggtcgtaccgacgggcgggtaacgggcgtaggtctaggttattacgtttactcgttacgttagtacgttagtacggttcgggtacggttagtaggtacgggtacggtagggtacgggttgggtccgggacgggtacggacgggtacggtcgtaccggttcgaccggtaccgtacggaccgtaccggccgtacccggtacccgtcggtaccccg

SEQ ID NO: 129794 - DNA, 1001 bp, Homo sapiens
  misc_feature: GYAE6OF01DZN5S.49.52.E08.1.454.CMB.1.raw
  modified_base (301)..(301): a, c, t, g, unknown or other
  misc_feature (301)..(301): n is a, c, g, or t
tcagagtcgagagacacgaccggtgctcgatttagtcgagctctcagagaggaaagggggtggtccaggaggcagaactctgggtgtctcaccatggcctggactccctctacttcctccccctctcactctctgcacgaggctcgtggacgtcccttctagtgagctgacacacgccctacccgtggtctcgtagtccgtaccccgaggaccacgggaccggccgaaggtactcccgaaccgttgcccgttaggtaggagtacgttcgaccttaagttacccggaaaccctaaaacggtnttacgttacggttacgttttaacggttacggtaacccgagtaaccggaacgggtaaaccgggccccgggtacccggtaacccgggttccccggttagggtttacggggtttacgggtaacggttaacgttaacgttaaaacgtaaaaccgtacgttaaccggtaggtaaccgggacccggtaccccgtaacgggtaaccggtaccgtacccgtaggtaccggttacgttaccgtttccgtacggtaccggtacccgtaccgggtaacggtaaccggtaaaccggggtaaacccgtaaacccgggttaccgtaaacggttaaccggtttcccgggtaacccgttaacggttacccgggttaaagggttcccggggtaaacccggtttaccgggaaaccgggtaacgggtaaacggggtaacggggaacccgggttaacgttaccggtttaacgtttaaacggttttaacgttttaaccggttaacgttaaacgttaaccgaaaccggtaaacgtaacccggttaacccgtaaacgttttacggtttaaccgtttaaccgttttacggttacccggttaaccgttaacggtaacccgtaccggtaacccggttaaccggtaccggttacccgttacccgggtccgtaaccgggacccaacccggaccccgtaacgaacccccctacgtcgtccgttaacccg

SEQ ID NO: 129795 - DNA, 741 bp, Homo sapiens
  misc_feature: GYAE6OF01DBUF8.49.52.E08.1.454.CMB.1.raw
  modified_base (212)..(212): a, c, t, g, unknown or other
  misc_feature (212)..(212): n is a, c, g, or t
  modified_base (233)..(233): a, c, t, g, unknown or other
  misc_feature (233)..(233): n is a, c, g, or t
  modified_base (341)..(341): a, c, t, g, unknown or other
  misc_feature (341)..(341): n is a, c, g, or t
  modified_base (656)..(656): a, c, t, g, unknown or other
  misc_feature (656)..(656): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacgagggtcctgggcccagtctgccctgactcagcctgcctcgtgtcgtcgggtctccgtggacagtcgatccacctntcctcctgacactacgaaccngacagtgagttcggttaggtaattacttaccttttcctccgtacggaaccaaccaaccaccgagaccaaaccgacccccaactcactactatttagaggacgaccacncgaacggcccggtcccgtacggagggttcctacgtcgacttcgtccgttcgtcgtccgtcctaccgtacggtcgtcggtaccgacgtcccgtacccggtcccctccgtacgtaacctaacgttccttccgggtaccgggtcccttacccgggacggggtacgggtcgggggtaacccgtacgggttacgttaggttaactttttaggtttaccgtttggttactttaccggtttataccggttaggttacggtcgggttacggtaaggttacgggtaccggggtacgggttaagggggttccgggttaaccgggngggtaaacgggtacgtaacgggttccgaccgtttacggacgtaccggacggccgaacggtccccgccggttcccgtcggtacccg

SEQ ID NO: 129796 - DNA, 734 bp, Homo sapiens
  misc_feature: GYAE6OF01DN8CH.49.52.E08.1.454.CMB.1.raw
  modified_base (164)..(164): a, c, t, g, unknown or other
  misc_feature (164)..(164): n is a, c, g, or t
  modified_base (166)..(166): a, c, t, g, unknown or other
  misc_feature (166)..(166): n is a, c, g, or t
  modified_base (175)..(175): a, c, t, g, unknown or other
  misc_feature (175)..(175): n is a, c, g, or t
  modified_base (234)..(234): a, c, t, g, unknown or other
  misc_feature (234)..(234): n is a, c, g, or t
  modified_base (239)..(239): a, c, t, g, unknown or other
  misc_feature (239)..(239): n is a, c, g, or t
  modified_base (263)..(263): a, c, t, g, unknown or other
  misc_feature (263)..(263): n is a, c, g, or t
tcagagtcgagagacacgaccggtgctcgatttagtcgagctctcagagaggaaagggggtgggtccaggaggcagaactcgtgggtgtctcaccatggcctggactccctctacttcctcccctcctcactctctgcacgaggctctggacgcctctatgacncngaccacacnccctaccgtggtgtacagtccgacccgaggacaggaccggcgagactcaccgtgctggngagtntcgctagtacgaaccgtaaacgtntacgtcgttacgttagtacgtacacgacgacggaccggcccggaccgacggtcccgttggttacggttaggtagtaggtaagtaaactaacggtactacggtacggaacgtaccggacccgtacggtacggtacctcggtacgacgttaccgtcttcgtcggtccgtaccgtacggacggtaacggaacggtaccgtaaccgtacgtacgtacgtcgtactacggtacggaggtcggtacggagacggacgtaagggacggaacgtggtctaacgttattagttacgaacgtttaacactaaccgattaaccgtaaccgtacggttaactttcgttaccgtttagtaccggttaccggtaacggtaggtacccggtaaccggtaaccgtacccggtccggtaacccggtccggttaccgaaaccggtaccccgaaccggtaccccgaaaccctccggtactcccgttaacc

SEQ ID NO: 129797 - DNA, 619 bp, Homo sapiens
  misc_feature: GYAE6OF01AZCAQ.49.52.E08.1.454.CMB.1.raw
  modified_base (372)..(372): a, c, t, g, unknown or other
  misc_feature (372)..(372): n is a, c, g, or t
  modified_base (609)..(609): a, c, t, g, unknown or other
  misc_feature (609)..(609): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacacgcccaccctcgggtgtcaggtcgtccccgaggacacggacggccaggactcacctgctcgtggagatgcattcgaccgaaaccgatatcgtcttattcggtaccagcagaacgccggccacggtccctggtgttggagtagtagtaataagacacgtaggacgacgtcctaggacggtactcgagtgcgtattctgtcgctcgngtcgaggacacgtcactgtcgcctagtcgtaggtcggacgtccgaggaccgaagggaacgggtacgacggtactaacggtattagtttacgtacggttaacaacgttaacaaacgaagtaacctaccgttaagtttaccgttaatttcgtagtttaccgtacgtagtacgaccggttaacggaccgttagtaccggttcggtcgggaccaaccgcgaacccggtacccaacccgttntccggtaccc

SEQ ID NO: 129798 - DNA, 804 bp, Homo sapiens
  misc_feature: GYAE6OF01DO7WW.49.52.E08.1.454.CMB.1.raw
  modified_base (243)..(243): a, c, t, g, unknown or other
  misc_feature (243)..(243): n is a, c, g, or t
tcagagtcgagagacacgaccggtgctcgatttagtcgagctctcagagaggaaagggggtgggtccaggaggcagaactctgggtgtctcaccatggcctggatccctctacttcctccccctcctcactctctgcacaggctctgacggcctcctatgagctgacacacgcccacccgtcggtgtcgagtccgtaccccgaggacaggaccggccgaggactccaccgtgcctcgtagganatgctattacgaaccaaacgtatatcgtactttagttacggtaccagtacaacggaaccggcccgggaccgaccgggtcccccgttgggttcggtttacggtaggtaagttaggttaaaagttaaaacggacgtaacggtacggaacggtacccggtacccgtacgggaacggggtaccttccccgtagggaaccggtaccggttaactttccgttccggtacggtccgtacccggtaagggttaccggaacggggtaaaccgttaaacccgggtactaaccgtaacgtttaccggaaccgtagtacgtagggtacgggacgtaccggaggtacgaacgggaacggacggagtaccgttagtactttaagtttacttacgtaactaactaacgaaacgtaacgaaccgtaaccgtttaagtttcggtttaactttacgttcgttaaccggttacgtacgttaccggaaccgttacccggtaaacggttcccgtacccggttacggtccggtacaccggtaacccgtaccggaaccccctaacccgtcgtaccgttaccccg

SEQ ID NO: 129799 - DNA, 730 bp, Homo sapiens
  misc_feature: GYAE6OF01CG4FH.49.52.E08.1.454.CMB.1.raw
  modified_base (206)..(206): a, c, t, g, unknown or other
  misc_feature (206)..(206): n is a, c, g, or t
  modified_base (718)..(718): a, c, t, g, unknown or other
  misc_feature (718)..(718): n is a, c, g, or t
tcagagtcgagagacacgaccggtgctcgatttagtcgagctctcccggcgggggggtcacaagaggcagcgctctcgggacgtctccaccatcggcctgggctctgctgctcctcacttctctcactcaggacacgagggtcctgggccctagtctcggccctggactcacgcctcgcctccgtgtcgtgggtcctcgtaggacnggtcactcacctgtcctcctgacacacgaaacctgcagtagtagtacggtttaggaactttacttaacctttttcacgtacgtaaccaaacgaaccaccgaacggtaccaaaccgacccctaaatcgtaactactagtttacgacgacggactaacgcgaccggtcccggtacctcgggtaacgggttcctcgttacgtactttccgtttcgttcgtcgttacggccttacccggacgttcgacggcgtaaccgccgtccgtcctaaccgtacggtaacctaacgtcgttaccggcgggtacctcggacggggcggtacgggacgtacggatttacggtaatttagtttgtcgttcgtacgtttacggatttacggaaccgggtcgttaaggtacggttaccggcggggttaacgggtaacggggttcgggtcgggtaaccggggacgtaacccggtaggtacccggacgtttacggcgaccgtaacgacgtaccggtctaccccggtcccnggttaccctccg

SEQ ID NO: 129800 - DNA, 264 bp, Homo sapiens
  misc_feature: GYAE6OF01A53HZ.49.52.E08.1.454.CMB.1.raw
  modified_base (215)..(215): a, c, t, g, unknown or other
  misc_feature (215)..(215): n is a, c, g, or t
  modified_base (221)..(264): a, c, t, g, unknown or other
  misc_feature (221)..(264): n is a, c, g, or t
tcagagtcgagagacacgaccggtgctcgatttagtcgagctctctcggtcggggctacgaccggtgctcgatttagagagagtgtggttgggtttggggggaagaggaagactgaccggtccccccaggagttcaggtgctgggcacgagcggccctgggctcgcctggtcaaggactacttcctctctcgactctgagcgggctggcaaggcncatagnnnnnnnnnnnnnnnnnnnnnnnnnnnnnnnnnnnnnnnnnnnn

SEQ ID NO: 129801 - DNA, 798 bp, Homo sapiens
  misc_feature: GYAE6OF01C99ZD.49.52.E08.1.454.CMB.1.raw
  modified_base (224)..(224): a, c, t, g, unknown or other
  misc_feature (224)..(224): n is a, c, g, or t
  modified_base (247)..(247): a, c, t, g, unknown or other
  misc_feature (247)..(247): n is a, c, g, or t
tcagagtcgagagacacgaccggtgctcgatttagtcgagctctctcggcggggggggtcacaagaggcagcgctctcgggacgtctccaccatggcctgggctctgctgctcctcactcctcctcactcgaggacacgacgggtcctcgggccctagtccgtcgcccctagacctcgacgcctcgcctcgtgtcgtcggtctccgtggacagtcgatccaccncttctctcgacacgtacgaaccngactagtggtagttaggttaacggtaatttaccgtttaaccttttccgtaccgttaacggtaaaccaaaccgaaccgaaccgaacggaacccaaacccgaacccctaaacgtaccttaacgtacttaacgtttacgacggacggtaccgtacgtaccggaaccggcccgtcccgtacggtacgggtcctacgtacgtactccgttactcgttcgacgtccgtacgtacgtcgacggaccgtacgacccgtcccgtacccgtacccgtacgtaaccctacgtcccgttacgggccggtaccgttcccggacgggtcggggaaccgggtcgtaggaccgtttagttaacgttttagtacgtttcgactttaacgttacgtagttaccggttggtaaccgggttgtaacggttcgggtaacggtacgggtaggggttaccggacggggtacgggaaacggttacggtaaaccgggtacggtacccggttacggttacggaaccccgtaacggtacccggtacggaccgtttcccccggtacccgtggtaacccg

SEQ ID NO: 129802 - DNA, 713 bp, Homo sapiens
  misc_feature: GYAE6OF01B33L6.49.52.E08.1.454.CMB.1.raw
  modified_base (182)..(182): a, c, t, g, unknown or other
  misc_feature (182)..(182): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgacggcctcctatgagctgacacagcccaccctcggtntcagtcgtccccaggacagacggccaggatcacctgctctggagatgctatcgaccaaacgtatatgtacttattaggtaccagacaagaacgccgggaccacggccccgtgttaggttggtagagtgtaaataaagaccaacgtggaacggacggtacccctacggacggggtactcccggtagacggcgtacgtttctcgtcggtcctacccgagggtacgaacggggaaccaacggtacactaacgttcggacctagtacgaggtacgggacgttaccgaggaccgaagggtacggaacggacggtaccttaaggtacctttaagtttacgttaacgttacaaacgttaacgaaccgtaaacgtaaccctaaccgttaagtttacggtttaactttagttaccggttaccgttaccggaacgttcggaacccgttaaccggtaacggttacccgtacccgggttcccggtagggtaacccgacggtaaccccgaccggtacccccaaccccgtacgtcccgtaacccg

SEQ ID NO: 129803 - DNA, 1022 bp, Homo sapiens
  misc_feature: GYAE6OF01CC2ZW.49.52.E08.1.454.CMB.1.raw
tcagagtcgagagacacgaccggtgctcgatttagtcgagctctctcggcgggggggtcacaagaggcagcgctctcgggacgtctccaccatggcctgggctctgctgctcctcactctcctcactcaggacacagggtcctgggcccaggtctgccctgactcacgcctgcctccgtgtcgtgggtctccgtggacagtcgactacaccatcctacctcgcaactacgaaaccagacgagtagtagttggttaggtaactttacttaacccgttttactcccgtaacggtaaccaaacctaaaccacccaacgaaccccgtaaaaccgaccccctaaaacctcgtaactacctttaagtttaacggtcggaacgggtaccgtaagtccgtaacggccccgggttccctaacgggtcggggttacctttggtacggtacgttaccgtcctttacgtccgttcggtcccgtacccgtacgggttccgtacggtaaccgcccgaccggtaacccggtccccttaccgtacgtaaccgtaacttcccggtacggttccgggtacccgtaccccgggtagggtaccgggttaacggggggtaaccctacggggttacgtttaaacgggttaaacgtttttaacgttttaaccgttcgggtttaccgttttaacgggttttaccaaaccggtttttacgggttaacccgggggttaaccccgggggtttaaaggttaaaccggggttttaacggggtaaccccggggggtttaacccggggtttaaagggggggtttaccccggggggtttaaacccggggggggttaacccgggggtaaaacccgggggtttaaaaccgggggtaaaaacggggtttccccgggggtaaaccccccggggtttacctttaaacccgggggggtaaccccgaacccgggggttaaacccccggttaaacccggggttcccccgggttttaaacccccccgttccccccgggggtttaccccggtttaacccccggg

SEQ ID NO: 129804 - DNA, 783 bp, Homo sapiens
  misc_feature: GYAE6OF01CALGI.49.52.E08.1.454.CMB.1.raw
tcagagtcgagagacacgaccggtgctcgatttagtcgagctctcagagagaaagggggtgggtccaggaggcagaactctgggtgtctcaccatggcctggactccctctacttcctcccctcctcactctctgcacaggctctgacggcctcctatgagctgacacacgcccacccgtcggtgtcacgtcgtaccccgaggacacggaccggacgaggactccaccgtgtcctacgtaggagtacgtcgtctacgttaccgaaccctaaacgtagttacttacgttacgtttacgttacggtaaccacgacgaacgggaccggcccgggaccgtacccggtcccgtttaggtcggtttagggtagtaacgttagttaaaacgtaaaccgtaccgtaacggtacggaacggtacccggtacccgtaacggtaccggtaccgtcccgtaggaccgtacgttacgttccgtccgtcggtccctacggtaacggtacggaacgggaccgtaaccggtactacgttacgtccggactacggtacggtagggtcgggaaccgtccggaagggacggaagggaacggccgggtaagtaccgttaaggtaacttttaacgtttagtacgtaacgtaacctacggaaacctaccggttaactacgtttaggtttaccgttaatttacgtcggttacgttaccggacgttaccgaacggtaaccggtacgtaccccgtcggttaccggtcgaccacccggacccgaaccgacccctacgtactcgtaaccc

SEQ ID NO: 129805 - DNA, 694 bp, Homo sapiens
  misc_feature: GYAE6OF01C512A.49.52.E08.1.454.CMB.1.raw
  modified_base (147)..(147): a, c, t, g, unknown or other
  misc_feature (147)..(147): n is a, c, g, or t
  modified_base (486)..(486): a, c, t, g, unknown or other
  misc_feature (486)..(486): n is a, c, g, or t
  modified_base (511)..(511): a, c, t, g, unknown or other
  misc_feature (511)..(511): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcgaggacacgacgggtccncgggcccagtctcgccctgactcacgcctcgccctccgtgtcgtcggtcctccgtagacagtctactccacctatcctcctgacctaacgtaacgaaacctgacgtagtgagttggttaggtaatttacttacctttctcgtacgaacaacaaccaccgaagaccaacctaccccaatcactatattagcgacggtcatcgacgccgccgtaggtacggtctcgtagtcgtcctcttcgtacgtcgtacctcctacgtcgcggacacgccgtaacccgtcctaccgtacgactacgtcgtacggtcggcctacggtacggcgggtacgggacgtacgtnttaagtacttttgtacgttccggtntttaacgtactacggtcgtacggtacggtaagtacggtacggtaccggggtaaggtacgggtttccgggaacgggaaaccggggtaacgtaacgggtaccggttacccgggtacctaacggggttaccgaaccggacccgtacccggtaaccgtcccggacccccgttcccggtacgtacccc

SEQ ID NO: 129806 - DNA, 803 bp, Homo sapiens
  misc_feature: GYAE6OF01BWNOX.49.52.E08.1.454.CMB.1.raw
  modified_base (229)..(229): a, c, t, g, unknown or other
  misc_feature (229)..(229): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacgagggtcctgggcccagtctcgccctgactcacgcctgcctccgtgtctgggtcctcgtggacagtcgatcaccatctcctgcactagaaccngcagtgagttggttaggtaattacttaacctttctcgtacgtaccaacaaccaccgaggacaaaccgacccctaaactcactactatttagtaggacggtacgtatcgaacggtcccggtaccccgtacggtacggggttcctcgtacggtatccgtccgtttactcggtccggtacctccccgtacggttcgtagggacccgtacggacccgtaccccggtaccccttcccgtacggtaaccgtaccgttacggttcccgggtccggtccgtaccccgtaggggtccgggtacgggggacgtaccggggtccttaggttacttttaacgttgtttacggttcgtttacctttacgtacgtttaccggttaccgggttaccggttagggttaacgttacgggggtccgggtaacggggtacggggttacggggttaccggggaccgggggttaaaagggtaacccggttaaggggttacccggtaacccggtttccgggtaaccgggttacccgaaccgggtaacccggtaccgggttaccccgttccccgggtcccccggttgggttaccccg

SEQ ID NO: 129807 - DNA, 721 bp, Homo sapiens
  misc_feature: GYAE6OF01D4O9K.49.52.E08.1.454.CMB.1.raw
  modified_base (252)..(252): a, c, t, g, unknown or other
  misc_feature (252)..(252): n is a, c, g, or t
  modified_base (528)..(528): a, c, t, g, unknown or other
  misc_feature (528)..(528): n is a, c, g, or t
tcagagtcgagagacacgaccggtgctcgatttagtcgagctctcagagagaaagggggtgggtccaggaggcagaactctgggtgtctcaccatggcctggactccctctacttcctccccctcctcactctctgcacaggctctgaggcctcctatgagctgacacacgcccacccgtggtgtcagtcgtcccgaggacaggaccggccaggatcacctgctcgtgagatcgctatacgacccaaacgtntacgtgtactttagttacggtaaccaggtacaacggaaccggtccgggaccgtaccggtccccgttgggttcggtttacgggtagtaacgttaggtaaagtaaaacggaccacggtaggacggaccggtcccgtacgagggtacctccgagacgtcgtattccgtcggtcgtccgtaccggtacggtaccggaacgggtaaccgtaaccggtctacgtacgtcggacctagtaccggtaggtacggtacgtaccggaggacggaaggacggaccgnggtactacgtacttagttagtacgactaactaacgaaacgtaacgtactaaccgttagttacggttaacttagttacgttccgttaacggtacgtacgggaacctaacgggtaaccgttaccgtacccggttccgtacgggtacccaaccgggtacccccgaacggaccccctaaacccgtcgtcctaacccg

SEQ ID NO: 129808 - DNA, 897 bp, Homo sapiens
  misc_feature: GYAE6OF01EEV43.49.52.E08.1.454.CMB.1.raw
tcagagtcgagagacacgaccggtgctcgatttagtcgagctctctcggcgggggggggtcacaagaggcagcgctctcgggacgtctccaccatggcctgggctctgctgctcctcactctcctcactcaggacacgagggtcctcgggcccagtctcgccctgactcacgcctcgcctccgtgtcgtcgggtctcctggacagtcgatccactatcctcctcgactacgtacgaaaccgacgcaggtcgtagttggttacggtaactttactttaaccttttccgtaccgtacggtaaccaaaccaaccgaccgaacggaaccgaaaccgaccccctaaactctaactacttaactttaggacggacggtaccgtacgtaccgaccggcccggtacccgtacggtacggggttcctacgtcgtacgttccgtccttaccgtcgtcggtcctaccgtacgtcgtcggaccgtaccggtaccgtacccgtcccttacccgacggtaaccttacgttcccggtaccgggtccgggtacccggtacgggtacggggtcgggtaacgggggtaccggtaacgggttccgtttaagttaacgtttttagttaccggtttcgttaacgtttcggttaacgttacggtttacgggtacgggtacccgggtttaaggtaccggggtttaaccgggacgggggttaaccgggggttacgggggttacgggggtaaccggggggtacggggtaaaacggggtaaaccggggttaaaccgggtacccgggtttaacccgggttccgggttaaaccgggtacccgaaaccccggggttaccccgggtaacccggttacccccgggtttacccccccggttccccgggttaccccgtttaacccccggg

SEQ ID NO: 129809 - DNA, 714 bp, Homo sapiens
  misc_feature: GYAE6OF01DTJ0U.49.52.E08.1.454.CMB.1.raw
tcagagtcgagagacacgaccggtgctcgatttagtcgagctctctcggcggggggggtcacaagaggcagcgctctcgggacgtctccaccatggcctgggctctgctgctcctcactctcctcactcaggacacgagggtcctgggcccagtctcgccctgactcagcctgcctccgtgtctgggtctccgtggacagtcgactcaccatctctgacactacgaaacctgacaggtgagtggttaggtaactttaacttaccttttcgtccgtacggtaaccaaaccaaccaccgaaggaccaaacgacccccaactcatactattagtgacggacgatcgagccgtaccgacgtacggtctcgtgacgtcgtcttcgtactcggtctaccgtagtcgacgcgacgccgaccggtcctaccgagaacctaactccgttacggtccggaccgttccggacgggtacgggtacggggaaccgtacgtacggtttattaacgttttacgtttaaggttcgtacgtttagttacctaaaggttccgtaacgggttaccgggtagtaacggtttgggtaaccggggtacgggtaggggttaccggtaggggaaccggggtaaggtaaacggtaacgggttacccgaccggttacgggaaccggttacgacccggtaacccgacgggtcccgtaccccgtcccccggttgtaaccccg

SEQ ID NO: 129810 - DNA, 601 bp, Homo sapiens
  misc_feature: GYAE6OF01BDDYT.49.52.E08.1.454.CMB.1.raw
  modified_base (476)..(476): a, c, t, g, unknown or other
  misc_feature (476)..(476): n is a, c, g, or t
  modified_base (482)..(482): a, c, t, g, unknown or other
  misc_feature (482)..(482): n is a, c, g, or t
  modified_base (583)..(583): a, c, t, g, unknown or other
  misc_feature (583)..(583): n is a, c, g, or t
  modified_base (596)..(596): a, c, t, g, unknown or other
  misc_feature (596)..(596): n is a, c, g, or t
tcagagtcgagagacacgaccggtgctcgatttagtcgagctctctcggcggggggggtcacaagaggcagcgctctcgggacgtctccacatggcctggctctgctgctcctcactctcctcactcaggacacgagggtcctgggcccagtctcgccctgactcagcctgccgtccgtgtctcgggtctccgtggacagtcgatcacctatctcctgcactacgaaccagctagtgtagtggttaggtaattacttaccttttctacgtacggtaaccaacaaccaccacggaaccaaaccacccctaatcatactactttagcgacggtccatcgacgccgtactcggtggtctacgtcgtatcgtcttcgtcgtcggtcctcgtacgtcgcgcgacgtcaccgtcctacgtacactacgtcttcggcgtccacggacggtgggtacgggacgtagtcgtacgttattaagttntacgtnttcgtactaagtacgtcggtaccgtagtcggtacggtggacggttacggtgggtacgggaggtacgggacgtacggtcgcgtacgcgtacgcgacggtacncgtcccgcccgtntcccg

SEQ ID NO: 129811 - DNA, 711 bp, Homo sapiens
  misc_feature: GYAE6OF01C2VHB.49.52.E08.1.454.CMB.1.raw
  modified_base (182)..(182): a, c, t, g, unknown or other
  misc_feature (182)..(182): n is a, c, g, or t
  modified_base (189)..(189): a, c, t, g, unknown or other
  misc_feature (189)..(189): n is a, c, g, or t
  modified_base (246)..(246): a, c, t, g, unknown or other
  misc_feature (246)..(246): n is a, c, g, or t
  modified_base (318)..(318): a, c, t, g, unknown or other
  misc_feature (318)..(318): n is a, c, g, or t
  modified_base (542)..(542): a, c, t, g, unknown or other
  misc_feature (542)..(542): n is a, c, g, or t
tcagagtcgagagacacgaccggtgctcgatttagtcgagctctcagagagaaagggggtggtcaggaggcagaactctgggtgtctcaccatggcctggatccctctacttcctccccctcctcactctctgcacaggctctgacggcctcctatgagctagacacacgccacccgtggtntcagtcncccgagacaggcgcagactcactgctcgtaggacatgactagtccgaaccgaaacgnttagtcgtacgttagttaccggacacggacgaaggaaccggccggaccacggtcccctggttggttcggtanaattagtaactaaacgacgtagtacggacgaaccggtcccgtaggaaggtacctcggaggacgtacttcgttacgtcgcggtcctaggtacggtacggaaccggtaccggtaacgtctaggtacgtacgcgtaacgtacgtacggtcggtaacggacgtacggacgaaggggaacgaacgggcggttacaacgtttaactttagttacgttaccggtaactaanaacgtaacaacgaacctacgttaggtttaccggttaatttacgttaccggtaagttaccgggtaaccgtcgtaacccggtaaaccggtacggttaccccgtaaccggtcccgggtacgtacccgaaccgtacccccgggaaactacccccgaactcccggttcctaccg

SEQ ID NO: 129812 - DNA, 699 bp, Homo sapiens
  misc_feature: GYAE6OF01DJ2DB.49.52.E08.1.454.CMB.1.raw
  modified_base (197)..(197): a, c, t, g, unknown or other
  misc_feature (197)..(197): n is a, c, g, or t
  modified_base (230)..(230): a, c, t, g, unknown or other
  misc_feature (230)..(230): n is a, c, g, or t
  modified_base (325)..(325): a, c, t, g, unknown or other
  misc_feature (325)..(325): n is a, c, g, or t
  modified_base (366)..(366): a, c, t, g, unknown or other
  misc_feature (366)..(366): n is a, c, g, or t
tcagagtcgagagacacgaccggtgctcgatttagtcgagctctctcggcgggggggggtcacaagaggcagcgctctcgggacgtctccaccatggcctgggctctgctgctcctcactctcctcactcaggacacgagggtcctgggcccagtctgccctgactcagcctgcctcgtgtctgggtctcctggacngtcgatccaccatctcctgaccactagaaaccngctaggtgagttggttaggaatttacttaaccttttctccgtacggtaaccaaacaaccaccaggaccaaacgacccccaaatcatactaatttnaggacggccatcgacggccgtcctacggtacgggtctcgtnactcgtcttctcgtcgacctccgtacgtcgtcggctacgaccgtaccggtccctacccgtacgaacctaactccgttacggtcgggtcccgtacccggtagggtaccgggttagggggaaccggtacgggtacgttacggttaagtttaacgtttcgtttcgtcgtttagttacgtaagttcggttaccggtcgggttagaggttcggtacggggtcgggttaacggggttcggttacgggacggggtacgggaaccggtaacgggtaccgtaccggttaccgtacggtaccgaccggtacccggaacgtccgtcccggtcccgtcgtacccg

SEQ ID NO: 129813 - DNA, 631 bp, Homo sapiens
  misc_feature: GYAE6OF01A5XFE.49.52.E08.1.454.CMB.1.raw
  modified_base (177)..(177): a, c, t, g, unknown or other
  misc_feature (177)..(177): n is a, c, g, or t
  modified_base (225)..(225): a, c, t, g, unknown or other
  misc_feature (225)..(225): n is a, c, g, or t
  modified_base (245)..(245): a, c, t, g, unknown or other
  misc_feature (245)..(245): n is a, c, g, or t
tcagagtcgagagacacgaccggtgctcgatttagtcgagctctcagagagaaagggggtggtccaggaggcagaactctgggtgtctcaccatggcctggatccctctacttctccccctctcactctctgcacaggctctgaggcctcctatgagctgacacagccaccctggtntcagtcgtccccaggaccagacggccaggatccaaccttgctctgganatgccattcgaccaaaccgntactgcttagttcgtacctagcgtagaacgccggcacggcccctgtcgttcggtagtacttgtaactaaagacacgttggaacggacggtcccgtacgacgggtacttacccgtggaacgtccgtacttcctcgtcgcctaccgacggtacgaacgggcctaaacggtcaactacgttcggacctagtcgagtcggatccgaggcgaaggacgacggacgtcgtagacgtttagttagtgtacaagttcaacgtataccgactacgttcggttacttagtcgttacgtaccggtaactcggtacccgtaaccggtaccgttacccgaccggtttccgacgggtaccaaccggtcccgaacggtacccacccggttctcgttacccg

SEQ ID NO: 129814 - DNA, 876 bp, Homo sapiens
  misc_feature: GYAE6OF01EREBV.49.52.E08.1.454.CMB.1.raw
tcagagtcgagagacacgaccggtgctcgatttagtcgagctctctcggcggggggggtcacaagaggcagcgctctcgggacgtctccaccatggcctgggctctgctgctcctcactctcctcactcaggacacgagggtcctgggcccagtctcgccctgactcgacgcctcgcctcgtgtcgtggtctccgtggacagtcgactcacctatcctcctgacctaactacgaaacctgctaggtgtagttcggttaaggttaactttaccgtttaacccttttcctaccgttacggtaaaccctaaaccaaccgaaccggaacggtaaccaaaccctaccccctaaactacctaacttacgttaactttacgtacggacggaccgtacgtccgacggtcccggtacccggttacggtacggttccgtacgtacggtacgttccgtccttcgtccgtaccgtcctccggtacggttccgcggtaccgccggtaccgtacccggtcccttaccggttaacaacccgtttaccggttcccggttccgggtaccggtacccgttacggggtaccgggttcgggggtaacgggggtaccgtacgggtttacgttaacctttaagttttaaccggttccgtttcggttttacgttacgttaacgtacggttaacggttcccggggttaacgtttagggttacggggttaccgggtaacccgggggttacgggttaacggggttcgggtaacggggggaccgggtaaacggggtaacgggttacccggggttaggtaaccccgggttacgggtaccggtaacgggacccctaccggggttactaccccggggttccccgttaccccggtcggttaaccccg

SEQ ID NO: 129815 - DNA, 699 bp, Homo sapiens
  misc_feature: GYAE6OF01DHI3U.49.52.E08.1.454.CMB.1.raw
  modified_base (282)..(282): a, c, t, g, unknown or other
  misc_feature (282)..(282): n is a, c, g, or t
  modified_base (345)..(345): a, c, t, g, unknown or other
  misc_feature (345)..(345): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcagggcacagggtcctgggcccagtctgccctgactcagcctgcctccgtgtctgggtctccgtggacagtcgatccaccatctcctgcacgtcgaaccacaatcgacgttgtacttataattctgtctccgtgtaaccaacaacgtacccganaaaccgtacccaaactcatgtaattcttgagtctagtgacgtccggcccgtcgtacgggttcncgtagtccgtcttctccgctacgagtctggcacgtccgaccggtccctccgtacgtaccctacgttccgtcgttcggtccctaccgtaacgggtccgtaggacgggaacggtacggtcgttaagttactttacttacgacgacgcgtacctactaactaaacttaaacccaaaacttaacgttaaaaccgttcgggtttcgggttacggttccggggtaccgggaacccggttaaacgaaaccggttccgtaacccggttaccgtaaccggttacccgaacccgtacccggtaaccggtcccgttccccggtacccccttaccgggtaccctccccgttccgtttaaccccccg

SEQ ID NO: 129816 - DNA, 853 bp, Homo sapiens
  misc_feature: GYAE6OF01CRSQW.49.52.E08.1.454.CMB.1.raw
  modified_base (799)..(799): a, c, t, g, unknown or other
  misc_feature (799)..(799): n is a, c, g, or t
tcagagtcgagagacacgaccggtgctcgatttagtcgagctctcagagagaaaggggtgggtccaggaggcagaactctgggtgtctcaccatggcctggatccctctacttcctccccctcctcactctctgcacaggctctgaggcctcctatgagctgacacacgccaccctcggtgtcagtcgtccccgaggacaggccggaccgaggactcacctgccgtctgggagtatcgacctattcgaacctaaaccgtataacgttcggtctttaacgtttcggaaccgtaacgcgaaggaaaccggccccggggaccaaccgggtcccccgttggttggtttcgggtacgtaagttaggtaaagttaaacggactaccgtaggaacggtacggtccctaggacgggtacctcccggtagacggtccgttacgttccctacggtcgtacccgtccggttaacggaccggtaaacggggtaccgtaaccggggttccaaccggtttaccggtttacgggaccgtaacccgtttcggaaacggggttccgggtaaccggttacccgggaacggacggggttaaacgggtaccggggaaccgggtacgggttacccgttaagtaaccgttttaaacgttttaggtttacccgtaacgtttaaacgaacgttaaaccggaacttacccgtaacgttcgtttacggttaaccttagttaccgtttaccgtaaccggtaccgttcggaaccggtaacccggttaacggtccccggtacccgggttttcgaccggggttaacccncggggtaacccctaaacccgggaccccctaaacccgtcccgttacgggtacccc

SEQ ID NO: 129817 - DNA, 775 bp, Homo sapiens
  misc_feature: GYAE6OF01DJVVO.49.52.E08.1.454.CMB.1.raw
  modified_base (284)..(284): a, c, t, g, unknown or other
  misc_feature (284)..(284): n is a, c, g, or t
tcagagtcgagagacacgaccggtgctcgatttagtcgagctctcagagagaaaggggtggtccaggaggcagaactctgggtgtctcaccatggcctggactccctctacttcctccccctcctcactctctgcacaggctactgacggcctcctagtgagctagacacgagcccacccgttggtgtaccaggttcgaaccccgaagggaacaggaaccggccaaggtacttccaaccgtgcttacgaggagtatcgactacgttcgaaaccctaaaacggtnttaagtacgttctttaagtttacggaaccaacggacgaacggaacggcccggacccgaaccggtccccgttggttggtttgggtagtagtaggtaaattaaacggactacggtaggacgaccggtacctacggacggtactccgtagacgcgttacttccgtcggtcgtctacggaggtaccgaacgggaccgttaaccggtctaacgtgttaccggactaacgttacgtaggttaacgggacgacccgggtaaggcggaaacgggaacggaacggtaggtaccttacgttaaaccgtttatttaagttaccgaacttaacgaaccgtaaacgtaacgaaacccgttacctttaggttacgttaacgtttacggttacgttaggttaacccgtaacgtacggtaccgaaaccgttacggtaccccgtacgttacggaccggtacgacccgtaacccggaaacgtccccctaaactccgttacgtaaccccg

SEQ ID NO: 129818 - DNA, 714 bp, Homo sapiens
  misc_feature: GYAE6OF01DC7YT.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctagacacacgcccaccctcggtgtctagtcgtacccccgaggacaggaccggccaggactccacctgctcgtaggagatcgactagttcgaacccaaaccgtattatcgttacgtttaacgttacgggaaccctagaccgaaggtaaccgggcccggggacccaccgggtcccccttggttggttcgggtatagttaggtaaacgtaaacgaccgtacgtaggaacgggaccgtcccgtaaggacggaccttcccgaggtacgtcgttaccgtttcgtccgtggtacccgtacggtacggtaccggaacgggaccgtaacggcctagtacgttcggacctactacgtacgggtggaccgtaccggaggtacgaagggaacgggaccgagggtactagttaacttagtttagtacgaactactaacgaaacgaaccgttacctaacgttaggtttacggttactttaggcgtttaccgtaccgtacgtcgtaccgacgtaacgtcctacggtcgtacgtacgaccgtaccgaaccgacccaaccctgtccgtacc

SEQ ID NO: 129819 - DNA, 698 bp, Homo sapiens
  misc_feature: GYAE6OF01CCIO1.49.52.E08.1.454.CMB.1.raw
  modified_base (229)..(229): a, c, t, g, unknown or other
  misc_feature (229)..(229): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacagggtcctgggcccagtctgccctgactcagcctgcctcgtgtctgggtctccgtggacagtcgatccaccatcctccgtgcactagaaaccngcagtcgatggttaggaattacttaaccttttcacctggtaacccaaactaacacccgagaccaaaccgaccccaaatcatctattatcggacggcagtcacggccgtcccgtcggacgggttctacgtacgtcgtactcttcgtcgtacggcctccgtacgtcgtacggcctacgccgacccggtcccttacccgtcggtaacctaccgttcgtccgggttacgggtaccctccgggtaacgggtccgggtaggggaccgtacgggtctaggttactttagttacgttcgtagttacgttcaagttcggtccggtcgggtagtacggttacgggccgggttacggtaagggggtttccgaccggggtacggggtaaaccggacggttcgggtaacccgggtaacccgttcggttaccggacggtaccggtccgaaccgggtcccacccggttccccgtgggttacccc

SEQ ID NO: 129820 - DNA, 739 bp, Homo sapiens
  misc_feature: GYAE6OF01CKD6T.49.52.E08.1.454.CMB.1.raw
  modified_base (280)..(280): a, c, t, g, unknown or other
  misc_feature (280)..(280): n is a, c, g, or t
  modified_base (723)..(723): a, c, t, g, unknown or other
  misc_feature (723)..(723): n is a, c, g, or t
tcagagtcgagagacacgaccggtgctcgatttagtcgagctctctcggcggggggggtcacaagaggcagcgctcgtcgggacgtctccaccatggcctgggctctgctgctcctcactctcctcactcaggacacagggtcctgggcccagtctgccctgactcagcctgcctcgtgtcgtggtcctccgtggactagtcgatccactattccgtcctgactaacgtcgaaaaccagtcaagtagtagttggttaggtaatttacttaaccgttttcnccgtacggtaaccaaacaaccaccgagaaccaaccgtaccccaaatcaacttctaattagagacgccgatcgaccgcgtccgtacggtacggttctacgtgtacgtccgtacttcgtcgtcgccctttacgacgttccgacggaccgtacgaacccgtccggtccccttaccgacgtaaccgttaacgttcctccggggtacgggacccttacccgggcgggtacgggtaccggggtaacgcgggtttaccgttagttaacgttttaacttacggttcgtaccgtttagtaacgttaacgtcggttccggtagggtacgtaggttacgggaccggggtacggtaacggggtcggttaccgggacggggtaaacgtacggtaacgggttacgacccggttaacgtccgggacgttaacccggaccgtaacgcccggtttacccncccggttcggttaccc

SEQ ID NO: 129821 - DNA, 656 bp, Homo sapiens
  misc_feature: GYAE6OF01C7FIS.49.52.E08.1.454.CMB.1.raw
  modified_base (236)..(236): a, c, t, g, unknown or other
  misc_feature (236)..(236): n is a, c, g, or t
  modified_base (325)..(326): a, c, t, g, unknown or other
  misc_feature (325)..(326): n is a, c, g, or t
tcagagtcgagagacacgaccggtgctcgatttagtcgagctctctcggcggggggggtcacaagaggcagcgctctcgggacgtctccacatggcctgggctctgctgctcctcactctcctcactcaggacacagggtcctgggcccagtctgccctgactcagcctgcctcgtgtcgtgggtcctccgtggacagtccgatccacctatcctcctgaccacgtaacgaaaccngcaggtgattggttaggtaattacttacctttctccgtagtaaccaacaaccaccagacaaccaccccatacatctatatgacggaccnncgacgccgaccgtcggcggtctcgtgacttcgtcttctcgtcgtccttcgtaccgtgtcgacgtacggccgtacccgtccctaccgtgtaacctacgtccgttcggtcggccgtaccggtaggtacgggtacgggacgacggtgttacgtattagtttgttcgtcttgttacgaatacgtcgggtacgtggtacgtagggtacgggtacgggtacgggttcggggtaccggggacgggtacggtaaacgggtcggtacccgggacggttccggtaccgggtaccgaccggtaccggaaccggtcccgacccggtcccggtacgtaccccg

SEQ ID NO: 129822 - DNA, 616 bp, Homo sapiens
  misc_feature: GYAE6OF01DPFOS.49.52.E08.1.454.CMB.1.raw
  modified_base (227)..(227): a, c, t, g, unknown or other
  misc_feature (227)..(227): n is a, c, g, or t
  modified_base (340)..(340): a, c, t, g, unknown or other
  misc_feature (340)..(340): n is a, c, g, or t
  modified_base (346)..(346): a, c, t, g, unknown or other
  misc_feature (346)..(346): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacagggtcctgggcccagtctgccctgactcagctgcctccgtgtctggtctcctggacagtcgatcaccatcctcctgccactacgaaaccngacagtgagttggttggaatttaataaccttttctctaggtaaccaacaaccaccaggaccaaacgcccccaaactcaattacgtattatggagccgatacagccgcctacgngggtcngtcagtctcttctcgtggcctcgactcgtcggcacgtcgacggtccctcctagacgtactcgtcgtcgggctaccggcgggcgtcggggaacgtgccttagtacgtttatttacgttgtcctagtttacagttagtccggtacgttgaagttcgggtcggtccggtaagggttcggtcggggaccgggtagggacccggacggtcggtaaccggttccgaaggtcccgtaacgccgtaaacggtcccgttaccggcccgtacgggtcccc

SEQ ID NO: 129823 - DNA, 745 bp, Homo sapiens
  misc_feature: GYAE6OF01CEYQ1.49.52.E08.1.454.CMB.1.raw
tcagagtcgagagacacgaccggtgctcgatttagtcgagctctctcggcggggggggtcacaagaggcagcgctcgtcgggacgtctccaccatggcctggctctgctgctcctcactctcctcactcaggacacagggtcctcgggccagtctcgccctgactcagcctgcctcgtgtcgtcgggtctcgtggacagtcgaatcctaaccattcctcctgacaaccgtacgaaaccaggactagtgtaagttggttaaggtaaactttacttaaccttttcgtaccgtacggtaaaccaaacaaccaccgaagaaccgaaaaccgaccccctaaactcaacttacgttaatttacgacggtacggccgaactacgacggtaccggtacccgtacggtaacgggttcttcgtagtaccgtcgtccgtttacgtcgtccgtaccgtcccgtaacgttcgtacggaccgacgtaccgacccgtaccctaccgtacgaccgttaacgtccggttccgtcggaccttaccggagggttaccgggaaggggtaccgtacggtacgttaacgtttaatttacgtttacgttggtacctttagtacgtaacttacgacggttacgggttagacggttggacggggtacggtacgggttacggtacgggaggaacggtaaacggacggttaccgacgtcggtacgacggaaccgacccggttaacgccgtaccccggtcccgttcgtacccg

SEQ ID NO: 129824 - DNA, 705 bp, Homo sapiens
  misc_feature: GYAE6OF01AWP5V.49.52.E08.1.454.CMB.1.raw
  modified_base (693)..(693): a, c, t, g, unknown or other
  misc_feature (693)..(693): n is a, c, g, or t
tcagagtcgagagacacgaccggtgctcgatttagtcgagctctcagagagaaagggggtgggtccaggaggcagaactctgggtgtctcaccatggcctggatccctctacttcctccccctcctcactctctgcacaggctctgaggcctcctatgagctgacacacgcccacccgtcggtgtccagtcgtccccgaggacaggaccggccaggactccactgctcgtggagatgctagttcgacccaaaccgtatagtgtacttagttacggtaaccagtacaacggaacggcccgggacccacggtcccccgtggttcggttcggtaggtaagtaggttaaacttaaaacggaacctacgttaggaacggtaccggtaccccgtacccggacgggtaccgttaccccgtacggtacggtacgtacgttaccgttccggtcgtccgtcccgtacggtacggtaacgggacggtaacgtaccgtactacgtcgtccgactcgtagtcggacgtaccgagacgaggacggacggacgggtacgtaacgtacgttagtactttagtaccgtaacttacaaacgtaacgaacgtacctaacgttagtttaccgtaagttgttaccggttacgtacgtccgtaacgaccgtacgtacgcccggtacgtcggacgaccgaccgaccgacccacccncgtccgtacccg

SEQ ID NO: 129825 - DNA, 782 bp, Homo sapiens
  misc_feature: GYAE6OF01CPFJI.49.52.E08.1.454.CMB.1.raw
  modified_base (278)..(278): a, c, t, g, unknown or other
  misc_feature (278)..(278): n is a, c, g, or t
  modified_base (696)..(696): a, c, t, g, unknown or other
  misc_feature (696)..(696): n is a, c, g, or t
tcagagtcgagagacacgaccggtgctcgatttagtcgagctctcagagagaaagggggtgggtccaggaggcagaactctgggtgtctcaccatggcctggatccctctacttcctccccctcctcactctctgcacaggctcgtgacggcctcctatgacgctgacacacgccctacccgtcggtcgtccacgtccgtaccccgaggacgacggaccggccgaaggactaccgactcgctcgtaggagatgacgtacttaccggaaccaaaccgtntaagttcgttactttaagtacggtaccaacgaacgaacgggaaccggacccggacccggtaaccggttccccgttggttacgggttaggtagtaagttcggtaaaacgtaacgaaaccgtacgttacggaccggtaccggtacccgtaccggacgggtaacctccgtacggaacgtcggtttaaccttcgtcgtacggtacgtcccggtaacggtaccggtaaacggggaccgtaaaccggtacgaaccggttacgtaccgtactaccggtaacggtcgggtacgggtaaccggtaccggaacgggtacgaaacgggtacgggacggtacgtccgttaaagtacgtttagtttacgtacgtaactaacgtacgaaacaccgtaacctacgttagttacgttaattggtacgttaccgngtaaccgtgaacccgtacggaccgtaccgtaccggtacggtccgtaccaccgtacccgaacccgtacctaccgtccgtcttacccg

SEQ ID NO: 129826 - DNA, 713 bp, Homo sapiens
  misc_feature: GYAE6OF01CN7KV.49.52.E08.1.454.CMB.1.raw
  modified_base (212)..(212): a, c, t, g, unknown or other
  misc_feature (212)..(212): n is a, c, g, or t
  modified_base (238)..(238): a, c, t, g, unknown or other
  misc_feature (238)..(238): n is a, c, g, or t
tcagagtcgagagacacgaccggtgctcgatttagtcgagctctctcggcggggggggtcacaagaggcagcgctctcgggacgtctccaccatggcctgggctctgctgcctcctcactctcctcactcaggacacgagggtcctgggcccagtctgccctgactcagcctgcctccgtgtcgtgggtctcctggactgtcgatccaaccnttcctcctgaccacgtacgaaaaccngctagtgtagttggttaggtaatttacttaaccttttctaccgtaggtaaccctaaacaacctacccgaagaccaaaaccgtacccccaaatcgaactctaatttacgcgacggtaccgactacgacggtccgggtaccctacggacggggtcttacgtcgtactcggtctttccgtcgtcgccttccgtacgtccgtagggccacgaccgtcccgtacccgtaccgtacgtaacgacttacgtccggtcggtaccgtaccggcgggtacggtacggggtacggacgggtcttaagtaactttagttacgttacgttcgttacgttactacgtaaggtcggttaccggtagtacggttggtaacgggcggttaacggggtgggtaccgggaacgggtagggaaacggtaacggtaccggtcgtaacggtcgacccggtacgcccggaacgcccggtccctccccggttcgtcccg

SEQ ID NO: 129827 - DNA, 756 bp, Homo sapiens
  misc_feature: GYAE6OF01AUIV4.49.52.E08.1.454.CMB.1.raw
  modified_base (116)..(116): a, c, t, g, unknown or other
  misc_feature (116)..(116): n is a, c, g, or t
  modified_base (224)..(224): a, c, t, g, unknown or other
  misc_feature (224)..(224): n is a, c, g, or t
  modified_base (240)..(240): a, c, t, g, unknown or other
  misc_feature (240)..(240): n is a, c, g, or t
tcagagtcgagagacacgaccggtgctcgatttagtcgagctctctcggcggggggggtcacaagaggcagcgctctcgggacgtctccaccatggcctgggctctgctgctcctnactctcctcactcaggacacgagggtcctcgggcccagtctcgccctgactcgagcctcgcctccgtgtctcgggtctccgtagacagtcgactacacctatcctccngacacgtacgaaaccngacagtgtagtggttaagggtaactttacgtttaacctttcgtaccgtaacggtaaccctaaaccaacccgaacccgtacgaaccgaaaaccccgtaaccccctaaacctaccgtaacttacgttaagtttaacgacggtaccggtccctacgtccggtaaccgggccccgtacccggtaccgggttaccgggttcttacggtactaccgttcgtaccttacgtccgtcgtacctcccgtgtacgtcgtaccgagtcccggacccgtcccgtcctacgtaactacgttcctacggtccggtctacgggcggtaccggacggggagtaccggtattacggttatttaacgttcgttacggttcttacgtcgttaggtacgtccgggtacggttacggtaggtacggtacggggtaggtacgggtcgggtccgggtacggacgggtaacggtacggtacgttacccggcgtacggacgacccggtacgtaccgaccggtcccgtccccggtctcccgg

SEQ ID NO: 129828 - DNA, 693 bp, Homo sapiens
  misc_feature: GYAE6OF01BEVNF.49.52.E08.1.454.CMB.1.raw
  modified_base (386)..(386): a, c, t, g, unknown or other
  misc_feature (386)..(386): n is a, c, g, or t
  modified_base (530)..(530): a, c, t, g, unknown or other
  misc_feature (530)..(530): n is a, c, g, or t
  modified_base (586)..(586): a, c, t, g, unknown or other
  misc_feature (586)..(586): n is a, c, g, or t
tcagagtcgagagacacgaccggtgctcgatttagtcgagctctctcggcggggggggtcaacaagaggcagcgctcgtcgggacgtctccaccatggcctgggctctgctgcctcctcactctcctcactcaggacacgagggtccgtcgggccctagtctccgccctcgactcacgtcctcgtccttcgtgttcgtgggttctccgtaggactagtcgactccacctacttcctccgcactacgtaacgaaccagcgtagtgtagttaggtagttaactttactttacctttcctacgtacgtaaccaaccgtaaccgaccgaacggtaaccaaacccgaaccctaaactctactacgttaattcggacgtacggtaccgtacnccgaccggccgtcccggttaacgggtcgttcgtacgtcgtacgttccgttccttacgtcgtaccggtcctccgttacgtcgcgtaccgcgtcccgtaccttcccgtaccgtacgtccgtcgtcggcggtcgcgtacgagtgagngtacgtcgtagttcttacgtctagcgtactagtctaagttcgacgacgtagtaacnttaccgtaagttttagacgttaggtagttaccgggtacgggaacggtacggtacgtacgtacccggttacgtccgggttacacggccgtacggtaccggtacccggg

SEQ ID NO: 129829 - DNA, 702 bp, Homo sapiens
  misc_feature: GYAE6OF01CMJ1I.49.52.E08.1.454.CMB.1.raw
  modified_base (231)..(231): a, c, t, g, unknown or other
  misc_feature (231)..(231): n is a, c, g, or t
  modified_base (539)..(539): a, c, t, g, unknown or other
  misc_feature (539)..(539): n is a, c, g, or t
  modified_base (633)..(633): a, c, t, g, unknown or other
  misc_feature (633)..(633): n is a, c, g, or t
tcagagtcgagagacacgaccggtgctcgatttagtcgagctctctcggcgggggggggtcacaagaggcagcgctctcgggacgtctccaccatggcctgggctctgctgctcctcactctcctcactcaggacacagggtcctgggcccagtctcgccctgactcacgcctgccctcgtgtcgtgggtctccgtggacagtcgatcaccatctcctgcactagaaaccngcagtgattggttaggtaactttacttaaccttttcgtccgtacggtaaccaactaaccacccgaggaaccaaaccgaccccctaaaactcacttactaatttacgtaggacggtaccgtaactcgacgggcccgtccccgtacgggtacggggtccttacgtagtacgttcgtccttccgttcgtcgtaccctaccgtacgtcgtagggcacgacccgacccggtccctcccgtacgaactacgttcgtacggtcgaccgtcgaggtccgggagggacgtaggcttaggtactttacgtagttcgtnttacgtacttaatacggtcggtacgggtgtaacgtacgggtcggtacgggtaggggttcgggttacgggaccgggtagggtaaaggtaaccggngggtacccggttacggacggtacggaccgaccggtacggtcccgtaccccggtccccgttacgtccccg

SEQ ID NO: 129830 - DNA, 759 bp, Homo sapiens
  misc_feature: GYAE6OF01CMT4J.49.52.E08.1.454.CMB.1.raw
  modified_base (230)..(230): a, c, t, g, unknown or other
  misc_feature (230)..(230): n is a, c, g, or t
tcagagtcgagagacacgaccggtgctcgatttagtcgagctctctcggcggggggggtcacaagaggcagcgctcgtcgggacgtctccaccatggcctgggctctgctgctcctcactctcctcactcaggacacgagggtcctcgggcccagtctcgccctgactcacgcctcgcctccgtgtcgtcgggtctccgtggactagtcgatccaacctgtccttaccgngacctaacgacgaaaaccgagcgtagtgttaaggttgggtttagtaaactttaccttaacctttttccgtaccgttacggtaaaaccaaacctaaccgaacccgaacggtaaccaaacccgtaacccccctaaaacgtacctaaacttacttaaactttagtacgggaaccgtaccgtagtaccggtaaccggcccggtacccgtacgggtacgggtcttcgtacggtaccgttccgtcgttcctacgttccggccttaccgtcggttcagggaccacgccgtacccgacccttccgaacgtactaccgttccgtcgccgggtcttaccgggacggcgggtaacggggacggtaacgttcggttattaactttagttcgttacgtcgtttagttaccgtagttacgtcgggtcgtaagtgtacgggtaccgggaagttcgggacggtcggggaaccgtaggacccgaacgggttcaccgttccgggaacgtccgacgtaccccgtagtcccggacctccccggcttccg

SEQ ID NO: 129831 - DNA, 700 bp, Homo sapiens
  misc_feature: GYAE6OF01EOLPA.49.52.E08.1.454.CMB.1.raw
  modified_base (206)..(206): a, c, t, g, unknown or other
  misc_feature (206)..(206): n is a, c, g, or t
  modified_base (218)..(218): a, c, t, g, unknown or other
  misc_feature (218)..(218): n is a, c, g, or t
  modified_base (226)..(226): a, c, t, g, unknown or other
  misc_feature (226)..(226): n is a, c, g, or t
  modified_base (515)..(515): a, c, t, g, unknown or other
  misc_feature (515)..(515): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacgagggtcctgggcccagtcctcggccctgactcacgcctcgccctccgtgtcgtgggtcctccgtggacngtcgactcactntcctccgngccacgtacgaaaccgtagcgagtgtagttggtagtaatttacgttacctttctaccgtacgaaccaacacctaccgagaccaaaccgccctaaactctactacttagttacgcggacggactacgacggaccggccgtccgtacggtcgggtactcgtcgtacgttccgtcttccgtcgtacggtctacccgtaggttccgtggaccgtacggcccgtaccggtccctaccgtacgaactaccgtcgtcggtcggccctcgggacggtcggtacggggagtacgggtnttacggtatttacgttcgtacgttacttgtactcgtacggtcgtacggtacgtaggtacggtcgggtacggtaggggtcggtaccggggacgggtaaccgggacggtacggtacccggttacggtaccggacgtaccgacccggaccgtacccgggtcccttcccgggtcccgtcgttaccccgg

SEQ ID NO: 129832 - DNA, 911 bp, Homo sapiens
  misc_feature: GYAE6OF01EU644.49.52.E08.1.454.CMB.1.raw
tcagagtcgagagacacgaccggtgctcgattttagtcgagctctcagaggaggaaagggggtgggtccaggaggcagaactcgtgggtgtctcaccatggcctggatccctctacttcctccccctcctcactctctgcacaggctctgacgcctcctatgagtctagacacacgccctaccgtcggtacgtcaggttcgtccccgaggacgagaccggcgaggactccacctgcgtcgtaggacgatcgacgtagttacgaaccgaaaccgtattagtcgtaacgtttacgttacggtaaccaggaccgaacggaccggcccggaccggtaccggtccccgttagggttcggtttagggctaaggttaacgtaaacgaaacgtacgtacggtacggaacggaccggtaccctaacgggaccgggtaccttcccggtacggaagtccggtttacgtttccggtcggtaccggttccgtaaccggttacggaaaccgggtaaccggtaaacccgtaggttaacccgtaagttacggtttaccgggacccttaaggtaccggttacgggggtaacgtaccgggtaacccggaaccggtaaacggacggggtaacgggaaccgggttacgggttaaccgttaacgtttaaacgttttacggtaacgttttactaaacttaacgtaaccgaaaccgttaaccgaaccctttaaggttaacgtttacggtttaacctttaacggttcggtttaaaccccggttaggtaaaccgttacccgggtaaccgaaacccggtttaaccgggtacccgttacccggggttttacccgggccggttaacccccgaacccggtaaacccccggaaccccggaacccccgtttaaacccccgttaggtacccccgtttaacccg

SEQ ID NO: 129833 - DNA, 828 bp, Homo sapiens
  misc_feature: GYAE6OF01D6OIG.49.52.E08.1.454.CMB.1.raw
  modified_base (84)..(84): a, c, t, g, unknown or other
  misc_feature (84)..(84): n is a, c, g, or t
  modified_base (138)..(138): a, c, t, g, unknown or other
  misc_feature (138)..(138): n is a, c, g, or t
  modified_base (264)..(264): a, c, t, g, unknown or other
  misc_feature (264)..(264): n is a, c, g, or t
  modified_base (266)..(266): a, c, t, g, unknown or other
  misc_feature (266)..(266): n is a, c, g, or t
  modified_base (563)..(563): a, c, t, g, unknown or other
  misc_feature (563)..(563): n is a, c, g, or t
tcagagtcgagagacacgaccggtgctcgatttagtcgagctctcagagagaaaggggtggtccaggaggcagaactctgggtntctcaccatggcctggactccctctacttcctccccctctcactctctgcacgnggctctgacggccttctatggatctagaccacagccccaccgtggtctcgacgttcgccccgaggacacggacggcaggtactccacctgtactcgtaggagtatcggctagtcgaccgaaacgtntntcgtacttaggttcgtacagtacgaaggaccggccggaccgaccggtcccgttaggttcggttcggtaagtacgttagttaaacgaacgtacgtcgttcggaacggtacccgtaccgtacggtaccggtaccgtaccgtaaggtacggtacctttaccgtttcgtaccgttcccggggtaccttaaccggttacggggaccggaacggggtaacccgttacgggttaccgaacgtttccggtaacggtcccaagttccggtagggtaaccggtcgttaacgggactagggggaacgngggtaaaccgtcggttaccgtaaggtagttttacgtaattacccggttaaacacgttaacccgaaagttaaccgaaccgtaacgtttttaacggttaccgtttaacggtttacttaccggtttaacccggttaaggttaaacccgtccggttaacccgggtaacggtaccgttaccccggttaaccggttcccggtacgggtaaccctacccgtaaacccggtacggttaacccccccaaacgtttcccggtccggttaaacccc

SEQ ID NO: 129834 - DNA, 683 bp, Homo sapiens
  misc_feature: GYAE6OF01CELCI.49.52.E08.1.454.CMB.1.raw
  modified_base (240)..(240): a, c, t, g, unknown or other
  misc_feature (240)..(240): n is a, c, g, or t
  modified_base (364)..(364): a, c, t, g, unknown or other
  misc_feature (364)..(364): n is a, c, g, or t
  modified_base (417)..(417): a, c, t, g, unknown or other
  misc_feature (417)..(417): n is a, c, g, or t
tcagagtcgagagacacgaccggtgctcgatttagtcgagctctctcggcggggggggtcacaagaggcagcgctctcgggacgtctccaccatggcctgggctctgctgcctcctcactctcctcactcaggaccacgtacgggtcctgggcccagtctcgccctgactcagcctgcctccgtgtcgtgggtcctccgtggacagtccgatccaccatcctctgacacgtagaaaaccngctagtgataggttaggtaattactaacctttctccgtagtaaccaacaaccaccgagaacaacccgacccctaaatctactacgtatttagacgacggtaccgattacgacggccgtacccgnggtacggtctcgtgactcgtacttcgtcgacgtctacgtacgtgtcgacgacnccgtccgacttccgtagaactactcgacgtccggcacggcgtacggacggggtacgtacgggtctaagttaacgttagtttagtcgtcgttacgtactaacgtaccgtcgggtaacggtaggtaacggttggtaacccgggtacgggtaggggttcggttaccggggacgggaaccggttaacgggaacggtaccggaacgttaccggtaacggtaccgaccgtacccggaacgtcccgtacccgttccccggtcggttaaccccg

SEQ ID NO: 129835 - DNA, 683 bp, Homo sapiens
  misc_feature: GYAE6OF01EIW4V.49.52.E08.1.454.CMB.1.raw
  modified_base (517)..(517): a, c, t, g, unknown or other
  misc_feature (517)..(517): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacgagggtcctgggcccagtctcgccctgactcagcctgcctcgtgtcgtgggtctccgtggacagtcgatccacctattcctcctgacctactacgaaaccagctagtgtagttggttaggaaatttactttaaccgtttcctaccgttacggtaaccaaaccaaaccaacccgaacggaaccaaaaccggtacccccctaaaactccaacttactaacttttaacgtacgggaacggtaccgacttccgaacgggccccggtacccgtacgggtacggggttccttcgtcgtacgttccgtcctttcgtccgtcggtcctaccgtacgtcgtcgcgacgccgccgtccctccgacactacgtccgtcgtcgggtactccgnggcgggtcgggacgtgtacgttgtacttttatatcgtcttacgtctaagtacgttcggacggttgaacgttcgggaggtacgggtggtcgggtacggaggaacggacgtacggtaggtacccgttagacgtacgactaccggacaccgtccggtcccgtcgtaccg

SEQ ID NO: 129836 - DNA, 769 bp, Homo sapiens
  misc_feature: GYAE6OF01EKFKW.49.52.E08.1.454.CMB.1.raw
  modified_base (338)..(338): a, c, t, g, unknown or other
  misc_feature (338)..(338): n is a, c, g, or t
tcagagtcgagagacacgaccggtgctcgatttagtcgagctctctcggcgggggggggtcacaagaggcagcgctctcgggacgtctccaccatggcctgggctctgctgcctcctcactctcctcactcaggacacgagggtccgtgggcccagtctcgccctgactcagcctcgcctccgtgtcgtgggtctcctggacagcgatcaccactcctcctgctacctacgaaaccgacgcagtgtagttaccccggttaggtaatttacttaaccttttcttccgttacgtaaccaacaaccaccaggaccaaccgaccccaactcatactattagnggacgcactcgacggccgcccgtggtacggttctcgtacgtacttcgtacttctcgtcgcctaccgacgtcgtcgtaccgacgccgaccgtcccctaccgtacgtaacctactccgtacggtcgggtacctaccgggtacgggtacgggtacggggaacggtcgggtaccttaagtttaacgtttaatttcggtttaggtccttttaaggtaccttaaggttaccgttaccggggtaccgggttagttaaccggggttcggggttaaccggggcggggtttaaacgggggttccggggttaacggggggaccgggtaaaacggggtaaccggaaagggggtttcccgtaaccccgggttaggttaccggacccggaacccggtcccgggaacggtccccggtttaccccggccccggtttaggtacccccg

SEQ ID NO: 129837 - DNA, 793 bp, Homo sapiens
  misc_feature: GYAE6OF01AW6F6.49.52.E08.1.454.CMB.1.raw
  modified_base (295)..(295): a, c, t, g, unknown or other
  misc_feature (295)..(295): n is a, c, g, or t
  modified_base (783)..(783): a, c, t, g, unknown or other
  misc_feature (783)..(783): n is a, c, g, or t
tcagagtcgagagacacgaccggtgctcgatttagtcgagctctcagagagaaagggggtgggtccaggaggcagaactctgggtgtctcaccatggcctggactccctctacttcctccccctcctcactctctgcacaggctctgaggcctcctatgacgctgacactacgccctacccgtggtgtacacggttcgaccccgaagggaccacggaccggaccgaggtactaccgaccgtcgtctacgtaggtaacgtagtcggactaacgttaccggaaccgtaaaaccggtnttaacgtcgttactttaggttaacggtaccagacgaacgggaaccggtcccgggaccgaccggtccccgttagggtttccggttagggtacgtagttacgtaaacgtaaacggacgtacgtacggacggtaccggtccctacggacggtaccgtcccgtagtacggtaccgttacgttcgtacgtcggtaccgtccgggtaaccggtaggttaacccgggaaccgtaaccggttaccgtaacgttaacggttcggacctaacggttcggaaggttcgggtaacgacggtaaggtaccgaagggacggggtaacggtacggttactaacggttaactttagttaacttacgtaactaacgtacgaaaccggtctaaccggtaccttaaggttacggttaactttaggtacttaccggtacgacgtacggaccgtaaccggtcgtacgtcccggtgtaccggtaccaccgtaccggacctacccgtaccngttccgtacg

SEQ ID NO: 129838 - DNA, 705 bp, Homo sapiens
  misc_feature: GYAE6OF01D54KT.49.52.E08.1.454.CMB.1.raw
  modified_base (200)..(200): a, c, t, g, unknown or other
  misc_feature (200)..(200): n is a, c, g, or t
  modified_base (540)..(540): a, c, t, g, unknown or other
  misc_feature (540)..(540): n is a, c, g, or t
  modified_base (566)..(566): a, c, t, g, unknown or other
  misc_feature (566)..(566): n is a, c, g, or t
tcagagtcgagagacacgaccggtgctcgatttagtcgagctctctcggcggggggggtcacaagaggcagcgctctcgggacgtctccaccatggcctgggctctgctgcctcctcactctcctcactcaggacacgagggtcctgggcccagtctcgccctgactcagcctgcctcgtgtcgtgggtcctcctggacngtcgatccacctactcctcctcgaccaacgtaacgaaaacccaggcaggttggtagtttaggttacgggtaaattttaactttaacccttttccgtaccgttaacggtaaaccccaaacctaaccaacccgacgaaacccgaaacccaaccccctaaactactaatactaagtttacgtacggacgaccgtactacggacgccggtccctacggtcgggtctcgtcgtctcgtccttcgtcgtcgtcctccgtacgtcgtcgcgacgccgtccggtcccttaccgacgtaacctacttccgtcgggtaccggtccgtcggaggggtcggacggggtacgnggttactggttacttagttcgtcgtnttgtactagttcgacggtcggtatagggtggtcggtacgggtaggtcgggtaccgaagggtagggtaacgaacgggttgaccggttacggaacggccgtaacggtccgtaacgtcccgtcccgtccggttccgtaaccc

SEQ ID NO: 129839 - DNA, 740 bp, Homo sapiens
  misc_feature: GYAE6OF01DPK0N.49.52.E08.1.454.CMB.1.raw
tcagagtcgagagacacgaccggtgctcgatttagtcgagctctcagagaggaaagggggtgggtccagggaggcagaactctgggtgtctcaccatggcctggatccctctacttcctccccctcctcactctctgcacaggctctgacggcctcctatgagctgacacacgcccacccgtcggtgtcagtcgtccccgaggacacggaccggaccaggtactccaccgtgcctcgtaggacgatgactagtcgaaccaacgatagtagtactttagttacggtaaccagacgaacggaaccggcccgggaccgaccggtccccgtttggtgggttacggtaggtaattaggtaaacgtaaaacgaccgtaacgtacggaccggtaccggtaccccgtacggtaacggggtaccttcccggtagtaacggtcttactttccgtcgtacggtccgtaacgtacggtacggaacggacgtaaaccgtcgacgtacgttacggcctagacgtagggtacgaccgtcggaaccgaggtaacgggacggacgaggtactagtacgtttatttcgtacgtaactaacgtacaacgtaacgaacctacgttagttacgttacttacgttgttaccggtaccggtaatacccgggtacgtaacccggacgttaccccgttcggtacccggttacggaaccgacccggtaacccgaacccggacccctaaccgtaccgtcgttacccg

SEQ ID NO: 129840 - DNA, 950 bp, Homo sapiens
  misc_feature: GYAE6OF01DG21Y.49.52.E08.1.454.CMB.1.raw
  modified_base (234)..(234): a, c, t, g, unknown or other
  misc_feature (234)..(234): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacgaggtcctgggcccagtctgccctgactcagcctgcctcgtgtctgggtctcctggacagtcgatccaccactcctacctgaccaactacgaaaccgngactaggtagagttcggttaggtaaacttttaacctttaacccgtttttccgtacccgttaacggttaaacccaaaaccgaacccgtaacccgaacggaacccgaaaaccccgtacccccctaaaactccgtaacttaccttaagtttacgtaacggtacggtacccgtaacgttaccgaaccgggccccggttaccccgtacgggtacggggttacctccggttacggtaccgtttccggtttacctttccgttcccggttacccggttaccctaccccggtttacccggttaccggttaccggaccgtaccggacccccggtacccggttccccgttacccgtaaacgtaacccgttaaccgtttcccggtaccggttaccgggtacccgtttaacccgggcgggttaaccgggggtaagggggaacccgtacggttaacggttacgttttaacgtttaacgttttaccggtttaccggttacttttacgttaaccgttaaggtttaccggtccgggtttaaccgggtagtaaccgggttcgggttacggggtaccgggtttaagggggttccgggttacggggaccggggaaccggggttaaaccggtaccgggttaacccggttaacccgggtaccggtacgggttaacccgaaccgggttaccccggaacgggttcccccgtacccccggtcccggttccgggttaacccc

SEQ ID NO: 129841 - DNA, 655 bp, Homo sapiens
  misc_feature: GYAE6OF01E5TBW.49.52.E08.1.454.CMB.1.raw
  modified_base (137)..(137): a, c, t, g, unknown or other
  misc_feature (137)..(137): n is a, c, g, or t
  modified_base (206)..(206): a, c, t, g, unknown or other
  misc_feature (206)..(206): n is a, c, g, or t
  modified_base (211)..(211): a, c, t, g, unknown or other
  misc_feature (211)..(211): n is a, c, g, or t
  modified_base (223)..(223): a, c, t, g, unknown or other
  misc_feature (223)..(223): n is a, c, g, or t
  modified_base (305)..(305): a, c, t, g, unknown or other
  misc_feature (305)..(305): n is a, c, g, or t
  modified_base (314)..(314): a, c, t, g, unknown or other
  misc_feature (314)..(314): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacngggtcctgggcccagtctgccctgactcagcctgcctcgtgtctgggtctccgtggacagtcatcaccntctcngcactgaaaccngcagtgagttgtaggtaattactaaccttttctctacgaaccaacaacaccgagacaaaccgaccccaaactcatctattangaggccgancgacgcgtcctcgaggtctcgtgatcgtcttcgcgtcggtctacccgcgtcgtcggactgccgtaccgtcccgtacctaggaacctaacgtcccgttacggtaccggtcgtaccgaaggggtccggtaacggggaacggtacggttcttaggttaaacgtttaaacgttttgtactcgttacgttatacgtaggtcgggtccggtagtaggtacggttcggccgggtaaagggttcggtacgggggagtaacggggtaaagtaaccgggtcgttaaaccggtcccgtaaggaccgttaacggacccggtaacgtcccgtcccggtaaccccgtgttaccgg

SEQ ID NO: 129842 - DNA, 596 bp, Homo sapiens
  misc_feature: GYAE6OF01CC9OR.49.52.E08.1.454.CMB.1.raw
  modified_base (225)..(226): a, c, t, g, unknown or other
  misc_feature (225)..(226): n is a, c, g, or t
  modified_base (312)..(312): a, c, t, g, unknown or other
  misc_feature (312)..(312): n is a, c, g, or t
  modified_base (341)..(341): a, c, t, g, unknown or other
  misc_feature (341)..(341): n is a, c, g, or t
  modified_base (411)..(411): a, c, t, g, unknown or other
  misc_feature (411)..(411): n is a, c, g, or t
  modified_base (443)..(443): a, c, t, g, unknown or other
  misc_feature (443)..(443): n is a, c, g, or t
  modified_base (467)..(467): a, c, t, g, unknown or other
  misc_feature (467)..(467): n is a, c, g, or t
  modified_base (474)..(474): a, c, t, g, unknown or other
  misc_feature (474)..(474): n is a, c, g, or t
  modified_base (578)..(578): a, c, t, g, unknown or other
  misc_feature (578)..(578): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctctgcactagaaaccnncagtgattggtacggaattacttaaccttttctcctaggtaaccaaacaaccaccgagacaaacgaccccaaatccatactattangacggccatacagcgccctgtacggtctntgactcgtcttctcgtggctaccacgttcagcaacgtcgacccggcctacccgtacgaacctaagttccncggttcgggacctcccgaggccgtaggggganacggtctagtactttaatagttcntgttacngtagtcggtagtcgaattggacgggtacggtaagggttggtacgggacggaagggtaaccaaaagggttcgacccggttacggaggtcacgaccgaacggtccnccgtaccccggcgtaccg

SEQ ID NO: 129843 - DNA, 816 bp, Homo sapiens
  misc_feature: GYAE6OF01DUKSS.49.52.E08.1.454.CMB.1.raw
  modified_base (193)..(193): a, c, t, g, unknown or other
  misc_feature (193)..(193): n is a, c, g, or t
  modified_base (212)..(212): a, c, t, g, unknown or other
  misc_feature (212)..(212): n is a, c, g, or t
  modified_base (243)..(243): a, c, t, g, unknown or other
  misc_feature (243)..(243): n is a, c, g, or t
tcagagtcgagagacacgaccggtgctcgatttagtcgagctctcagagagaaaggggggtgggtccaggaggcagaactctgggtgtctcaccatggcctggactccctctacttcctccccctcctcactctctgcacgaggctctggacggtcccttcctatggacgctgacacacgcccacccgtggtntcagtccgtacccaggacncggaccggccaggactccactgctcgtgganacgtgactacttacgaacccaaacgtatgtcgttacttaggttacggtaccaagcgaacgggaccggcccgggaccgtaccgggtcccgttggggtttcggttagggtagtaacgtttagaaaaccgtaaagtaccgacggtacgggacggtaccggtcccgtaggaacgggtaccctaccggtaggaccggttacgtttacgttccgtacggttccgtaccggtacccggtaacgggtaaccggaacgggggtaacccaccgggttacctacgttaaccgggttcccggaacgttaacggtcggttaagggtaccggggtaccgtaccgggaacgggtaacgggaacgggtaacggggaacggtcggttaccgttaagttaaccttttaggtttacgactaaccgtaagtaacccgtaaacgaaaccggtacttaacggtttaagttttacggtaactttacgtacgttacccggtacgtacgaccgtaccgaacggttaccggtcccttaccggtcggtaccgaccggtaacccgaacccgacccaacccgtacccctgttcccgtacccg

SEQ ID NO: 129844 - DNA, 761 bp, Homo sapiens
  misc_feature: GYAE6OF01EL241.49.52.E08.1.454.CMB.1.raw
tcagagtcgagagacacgaccggtgctcgatttagtcgagctctcgtcggcggggggggtcacaagaggcagcgctctcgggacgtctccaccatggcctggctctgctgctcctcactctcctcactcaggacacgagggtcctgggcccagtctgccctgactcagcctgcctcgtgtcgtgggtctcctggacagtcgatcaccatctcctgccactacgaaaccagctagtagattggttaggtaaatttacttaaccttttctaccgtacggtaaccaaactaaccaccgaaggaccaaaccgacccccctaaactctaactacctaattttacgacggacgggtacctaacgtcgaaccggtccccggtacccgttagggtaacggggttccttcgtacggacttccggtcctttactcggttccgaccctcccgtacgttccggacggccgaaccggtcccgacccggttacccttacccgtaaggtaacctacgtttccgtccggtacggtccctaccgggacggtaccgggtagggggaccggtaggtaccgttagttaacttttaacgttcgtttacggtccttagttacgtagttacggtcggtaccgggttagtaggttacggggtacggtacggggtaacgggttcgggtaccgggtacgggtaccgggtaacggtacgggtacggtacccggttcggtacgtaccgaccggccggtaacgtcccggtacctccccggtcgtaccccg

SEQ ID NO: 129845 - DNA, 801 bp, Homo sapiens
  misc_feature: GYAE6OF01C4BM9.49.52.E08.1.454.CMB.1.raw
  modified_base (657)..(657): a, c, t, g, unknown or other
  misc_feature (657)..(657): n is a, c, g, or t
tcagagtcgagagacacgaccggtgctcgatttagtcgagctctcagagaggaaagggggtgggtccaggaggcagaactctgggtgtctcaccatggcctggatccctctacttcctcccctcctcactctctgcacaggctctgacggcctcctatgagctgacacacgcccacccgtcggtgtcggtcgtcccgaggacaaacgccaggactaacctgactcgtaggagatcgactagttaacgaaacctaaaaaattgtcgtacgttttacggttacggtaaaccaaggtaaagaacggtacgaacgggacccggtaaccgggtcccgggtttggttccggtaccttaccgtatttaccggttagtacggtaaaccgaaccgtaaaaccggaaaaccccgtacccggtaccgggtaacctacccgtaggtaacgtagttacttcgtcggttcggtaccctacccgtaccttaccgggaacggaacccttacggtacccggtaccgtaacgtttacgtaaacgtaacggtccggaacgggtcccggggaacccggtaggggtagggaacgggttagtaacgggtaaacggtacgtaacgtttaacgttagtttaccgtacacccgtaacaacgaaacaccgtaagtaacaaacncgtaaacgaggtaagtagtaaccgggtcgggaacggtaacggactaccgtacgttacggacccgtacgttagggccgtaaccggaccctacggcccgtaacccgccccgttcgtccacttcccgttccggtcccctcccgttcc

SEQ ID NO: 129846 - DNA, 732 bp, Homo sapiens
  misc_feature: GYAE6OF01AMQFC.49.52.E08.1.454.CMB.1.raw
  modified_base (169)..(169): a, c, t, g, unknown or other
  misc_feature (169)..(169): n is a, c, g, or t
tcagagtcgagagacacgaccggtgctcgatttagtcgagctctcagagagaaagggggtgggtccaggaggcagaactctgggtgtctcaccatggcctggatccctctacttcctcccctcctcactctctgcacaggctctgaggcctcctatgagctgacacacncccaaccctcggtgtcaggtcgtccccaggaccaggacggcgaaggactccaccgtgtctcgtacggaggtatcggacgtagttaccgaaccgtaaaaccggtattaactcgtacttacgttacgggtaaccagacgaaggaccggcccggaccgaccggtccccgttagttgggttaggtaacgtagtagtaacgtaaacgactacggtggaacgacgtcccgagacgggtactaccgtagacgtcgacttccgtcgtgcgtaccgacggtacggacgggtaaccgtacggtacacgtacgttacgacgtacgtacgacgggttgaacgtccggaagggacaagggacggtacggacgcgttaaacgatttacgttagttacgtacgaagtaaccaaacgacgaaccttaagtcgttaacggttaacttacgggttaccttaccggttaaggaaccttcgggaaccccgaacggttaaaccggtccctttacgggtaacccgggttagtaccccgccggttaaacccggacgtaacccccgtacctaaccgtcggtaacccc

SEQ ID NO: 129847 - DNA, 715 bp, Homo sapiens
  misc_feature: GYAE6OF01EPOHX.49.52.E08.1.454.CMB.1.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (223)..(223): a, c, t, g, unknown or other
  misc_feature (223)..(223): n is a, c, g, or t
  modified_base (384)..(384): a, c, t, g, unknown or other
  misc_feature (384)..(384): n is a, c, g, or t
  modified_base (544)..(544): a, c, t, g, unknown or other
  misc_feature (544)..(544): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacgagggtcctgggcccagtctcgccctgactcagcctgcctcgtgtcgtggtctctgacngtcganccacatctctgcactacgaacngcagtgagttagggttaggtaactttaagtttaacccttttcgtaccgttacggtaaacccaaaccaacccaaccgaacggaaccaaaacccgacccccaaactcgtaataccttaatttagcggacggtaccagtcgacgcggtaccctggacgggttcncgtagtactccgtctttcgcgtcggacctccgtacgtcgtcggcacgcgacccgtcccttaccgaggtaacctacgttccgttcggtaccggtcccgttaaggcggggacgggttagggggaacctagggtctttagttacgttttattcggttacgttnttaccgttagtcgttacggtcggtacggttagtaggtacgggttccggacggggttaagggttcggtacggggaacggagggttaaccgaaagggttcccgaaccggttccgaacggtcgaaacccgggacccggttaccggccccgttaaccggtcccggttgtaccccg

SEQ ID NO: 129848 - DNA, 757 bp, Homo sapiens
  misc_feature: GYAE6OF01A4H7L.49.52.E08.1.454.CMB.1.raw
  modified_base (135)..(135): a, c, t, g, unknown or other
  misc_feature (135)..(135): n is a, c, g, or t
  modified_base (176)..(176): a, c, t, g, unknown or other
  misc_feature (176)..(176): n is a, c, g, or t
  modified_base (225)..(225): a, c, t, g, unknown or other
  misc_feature (225)..(225): n is a, c, g, or t
  modified_base (387)..(387): a, c, t, g, unknown or other
  misc_feature (387)..(387): n is a, c, g, or t
tcagagtcgagagacacgaccggtgctcgatttagtcgagctctctcggcggggggggtcacaagaggcagcgctctcgggacgtctccaccatggcctgggctctgctgctcctcactctctcatcaggcacgngggtcctgggcccagtctgccctgactcagcctgcctccgngtcgtggtctccgtggacagtcgatcaccatctcctgcactagaaaccngcagtgatggtaggtaattattacctttctaccgtcgtacaacaaccaccgaggactaaaccgacccctaaactcactctattagtcggacgccgtatcgacgtcgcccgtacgacgggtctcgtgtactcgtccttcgtcgtacggtctcccgtacgtcgnggtacgacgtccgacggtccttacccagtactaacgtcgtcgtcggtcttcccggagggtcggtacgggaccgtacggtacgtacgttaagttaactttcgttacgtaccgttgttacgtaaagttccggttacgggtaccggttaacggtaaggggttaccggttacggggtacccgggttaaggggttacccggggttacggggtaccgggggtaaaaccgggtaaacccgggtttaacgggggtaacccgttaaaccccgggggtttacggaaacccgggtttaccggaaaccccgggtacccgggtttaaaaccgggcccccgggtttaaaccccgttcccccgggtttaccgggggttaaccccc

SEQ ID NO: 129849 - DNA, 922 bp, Homo sapiens
  misc_feature: GYAE6OF01BYV00.49.52.E08.1.454.CMB.1.raw
  modified_base (255)..(255): a, c, t, g, unknown or other
  misc_feature (255)..(255): n is a, c, g, or t
tcagagtcgagagacacgaccggtgctcgatttagtcgagctctctcggcggggggggtcacaagaggcagcgctctcgggacgtctccaccatcggcctggctctgctgcctcctcactctcctcactcgaggaccacgtacgggtccgtcgggcccagtcctcgacccgtgactcacgtcctcgtcctcgtgtcgtggtcctcgtgactacgtcgatcctactactctactcgacctaacgtaaccgaaacgngacgtacggttacgtacggttttagggtaacggtttaacttttaaccgttttacccgttttaccggttaaccggttaaaccgtaaaaccctaaacccgtaacccgtaaccggaaaccggtaaacccgtaaaaccccgtaccccgtaaacttaccgtaaccgtttacgttaaacggttacggaaccgggtaccggtaaccgttacggtacccgtaccggttaccccggtaccggttacgggtacggttacctcgttacgtaccggttcctttcgttacgttccggtcccttaccgtaccgttcggtacgtcgaaccgtcgtaacccgtcccgttacctagtaacgtaaccgtcggttacccggtcggtaccggtccggtaaccgggtcgggtaccgggtacgggtaaccggtcggttaacgttaacggtttactttaaccgttacgtcgttaccggttaacgttacggttaacgggttacgggtaccgggtacggttaacgggtacggttacggggtaacgggttacgggttaccgggttcgggaaaccgggtaccggtaaacgggttacccgggtcggtaacccgttaacggttaccggacgtacccgggtaacccggtaccggtaccgttacccccggtacccggttacccggttcgttaccccgg

SEQ ID NO: 129850 - DNA, 896 bp, Homo sapiens
  misc_feature: GYAE6OF01ECULG.49.52.E08.1.454.CMB.1.raw
tcagagtcgagagacacgaccggtgctcgatttagtcgagctctctcggcggggggggtcacaagaggcagcgctctcgggacgtctccaccatggcctgggctctgctgctcctcactctcctcactcaggacacgagggtcctgggcccagtctgccctgactcagcctgcctccgtgtctgggtctcgtggacagtcgatcacctatcctcctgcactacgaaaccagcagtgtagttggttaggtaatttacttaaccttttcgtaccttacggtaaccaaacaaccacccgaaggaccaaaaccgccccccaaaacttcctaacgttcctaagttttacgtacgggtacgggtccgtaactccgaaccgggtcccgggtacccccgttacgggtacgggggtttccttccgtacgtaccgtcccgttcgtttccgtccgttcgggtacccttccgtaccggttcgtacgggacctacggcccgaccccgggtcccttaccctacggtaaccgttacgttacccgttcggtccgggtcccgtacccggtacgggtaccgggtagggggggaacccgacgggtaccgttaagtttaacgttttaagttttacggtttacggttcgttttacggttacgttaaacgtttcgggtacgggttaccccggggttagttaaacgggttcgggttacccgggggtaaccggggttaagggggggtttccgggttaccgggggtaaccgggggggtaaacgggttaaaccggggtaaaccggggtttacccgggtaaccccggtttaaccgggtaccggggttaccggaaacccgggttaccccgggaaacggttccccggttcccccggtacccccgggtttcggttaaaccccccgg

SEQ ID NO: 129851 - DNA, 929 bp, Homo sapiens
  misc_feature: GYAE6OF01B926Z.49.52.E08.1.454.CMB.1.raw
  modified_base (172)..(172): a, c, t, g, unknown or other
  misc_feature (172)..(172): n is a, c, g, or t
tcagagtcgagagacacgaccggtgctcgatttagtcgagctctcagagagaaagggggtgggtccaggaggcagaactctgggtgtctcaccatggcctggactccctctacttcctccccctcctcactctctgcacgagctctggaggcctcctatgacgctagacacncgcccacccgttggtcgtcgacgtcgtaccccgaggacgacggaccggccaggtactccaccgtggctgtggagtatcgactagtccgaaccgaaccgatagtgtactttagttacggtaccgaacggtacgaacggtaacggcccggggtacctaccgggtccccgttaggttcgggtttagggtacgtagttaacgtaaacgtaaaaaccggtaacgtaacgtacggggaaccgaaccgggttaccccgtacccgggtaacgggtaacccgttccccggtaacggaccggtaccggtttaacgtttcccgttcggggtacccgtaccggttaccgggtacgggtaaccggtaaacggggtaacccgtaaaccgggtacctacggttaaccggtttaccgggaaccttaacgtaacggtaacgggtaaccgggttacgggaccgggtaacgggtaacgggacggggaacgggtaacggacgggttacgttaaacggttaacccgtttaagttaccgtttaacgttaaacctaaacgttaaccgaaaccgtacctaacccgtaaccgtttaacgtttagggtttaaccgtttaggttccggtttaaaccggttaccggttaacggtacccggtaaccttaccccggggttaaaccgttccggtttaacccgggttcccggttaacggggtaccctaaaccgggaaccccccgaaaccgggaccccttaaacccccggtagttccccggttaaccccg

SEQ ID NO: 129852 - DNA, 752 bp, Homo sapiens
  misc_feature: GYAE6OF01DZO2L.49.52.E08.1.454.CMB.1.raw
  modified_base (229)..(229): a, c, t, g, unknown or other
  misc_feature (229)..(229): n is a, c, g, or t
  modified_base (261)..(261): a, c, t, g, unknown or other
  misc_feature (261)..(261): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacagggtcctgggcccagtctgccctgactcagcctgcctcgtgtctgggtctccgtggacagtcgatccaaccatctcctgcactacgaaaccngcagtgatggttaggaattacttaccttttcnctcgtaccaacaacaccaggaccaaacgaccccaactcactacctatttagacgtacggaccgtactaccgacggccccggtacccctacgggtacggggttcctcgtacggtaaccgttccgttacctttccgttaccgtcgggtccccttacccgtaaccggttccggtcgggaccgtaccggtacccgtaccccgggtaccccttacccgttacggaaacctttaacgttcccggttacgtcggggcccttaacccgggagggttccgggtaacgggggaccgtaggttcgttaaggttaacttttacggtttattcggttccttaggtttacctaattacgggtcggtaccgggttagtaggttaacgggcggtacgggttaaggggtcggtacggggacgggaaaggtaaccggtaacgggtccttacccgggtacgtagggtacccacggtacccgacggtcccgtcccgtccccgttgtacccg

SEQ ID NO: 129853 - DNA, 762 bp, Homo sapiens
  misc_feature: GYAE6OF01CRF0D.49.52.E08.1.454.CMB.1.raw
  modified_base (635)..(635): a, c, t, g, unknown or other
  misc_feature (635)..(635): n is a, c, g, or t
tcagagtcgagagacacgaccggtgctcgatttagtcgagctctctcggcgggggggggtcacaagaggcagcgctctcgggacgtctccaccatggcctgggctctgctgcctcctcactctcctcactcaggacacgagggtcctgggcccagtctcggccctgactcagcctcgcctcgtgtcgtggtctccgtacggacagtcgactaccacctacgttcctcctgacctaacgtaaccgaaaccctagacgtaggtaggtagttagggtttaacggttaaattttaaccgttttaacccttttcgtaccgttacggtaaaaccccaaaacccgtaacccgaacccgacggaaaccccaaaaccccgtacccccctaaactcctaacgttaccttaagtttacggacgggtaaccggacctagtaccgaccggtacccgggtcccgtacgggtacgggttcctagtacgtaccgttccgtcttacgtccgttccggccttaccgtcgtcggacgtcgaccgtacccgtacccggttccctacggtacaacttacgtcgtaccgggcgtcgtcccggagggaccgggtcgggacgtgtacgttattacgtttagttcgttctacgtcgttanagttccggtgaacgttgaacggtgggtacgggtcggtacggggttcgacgggggtacgtagggaacgtaccgggccgttaacggtcgacggaccgacgtccgtaccgtcgtaccccgcgtcctaccg

SEQ ID NO: 129854 - DNA, 754 bp, Homo sapiens
  misc_feature: GYAE6OF01CKUI0.49.52.E08.1.454.CMB.1.raw
  modified_base (218)..(218): a, c, t, g, unknown or other
  misc_feature (218)..(218): n is a, c, g, or t
  modified_base (420)..(420): a, c, t, g, unknown or other
  misc_feature (420)..(420): n is a, c, g, or t
  modified_base (446)..(446): a, c, t, g, unknown or other
  misc_feature (446)..(446): n is a, c, g, or t
tcagagtcgagagacacgaccggtgctcgatttagtcgagctctctcggcggggggggtcacaagaggcagcgctctcgggacgtctccaccagtggcctggctctgctgcctcctcactcctcctcactcgacggacacgtacgggtcccgtcggcccagttctcgccccgtgacctcacgtcctcgcctccgtgtcgtcggttcctaccgtggacncgtcgactccacctcgtcctccgtagaccaacgtaaccgaaacctacggactaggtagtagttcggttaaggttaaacttttaccgttttaccttttccgtaccgttaaccggtaaaaccaaaccgtaaacccgaaccgtaacggaaccccgaaaaccccgtacccctaaactctacgtacttaagttacgaggaccgtacncgtacgccgtccgccgtgggtacgtntacgtcgtaccgtcttcctacgtcgtccgtcccgtcgcgtacgtcgacgccgtaccctccgtcctacgtacacgttactccgtccggtgccgtcggtacgggtacggacgggcgtacgtagtttaagttacttagtttcgttcgactttagtacgtaaggtccgttacgggtacgttggaacgtttcggaacgggttggtaacgggttcggacgggtacgggaaggtccggtacgtcccgggtaagtccccggagttacccggacgtaccccggttacgtcccctaccggggtcccgtcgttaccccg

SEQ ID NO: 129855 - DNA, 607 bp, Homo sapiens
  misc_feature: GYAE6OF01ET6FN.49.52.E08.1.454.CMB.1.raw
  modified_base (255)..(255): a, c, t, g, unknown or other
  misc_feature (255)..(255): n is a, c, g, or t
  modified_base (300)..(300): a, c, t, g, unknown or other
  misc_feature (300)..(300): n is a, c, g, or t
  modified_base (489)..(489): a, c, t, g, unknown or other
  misc_feature (489)..(489): n is a, c, g, or t
tcagagtcgagagacacgaccggtgctcgatttagtcgagctctcagagagaaagggggtgggtccaggaggcagaactctgggtgtctcaccatggcctggatcccctctacttcctcccccctcctcactctctgcacaggctctgaggcctcctatgagctgacacagcccaccctcggtgtcagtcgtccccagggacctaggaccggccaggactcacctgcctcgtggagatgcattcgacccaaacgntatgcttatggtaccagctagaagccggcacggccctgtgttggngatgtaagtaaagacagtgagcgccctgacgggtactccctagacgtcgactttcgagtcggcttccgaaggttccgaagggtaaccgaaaccgggttcaacgtaacgttcgggaccctagtccgtaagtcggaacgttccgaaggtaccgaaggtagggaccgaggtcacgtaacgttatttacgttntaccaattccaaacgtagaccaacgttagttgtactatcgtatcgaactgaccgtacgaacgtccgtaccgtcgtacggtcacgtaccccgtaagacccccaaccgtcctgtaccccg

SEQ ID NO: 129856 - DNA, 734 bp, Homo sapiens
  misc_feature: GYAE6OF01DWRXV.49.52.E08.1.454.CMB.1.raw
  modified_base (491)..(491): a, c, t, g, unknown or other
  misc_feature (491)..(491): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacgacgggtcctcggcccagtctcgccctgactcgacgcctcgccttccgtgtcgttgggttcctccgtggacagtcgactccacctactcctctggctacgtaacgaaaaccgagcgagttgtagttggtttaggtaactttaacttacccttttctaccgtacgtaaccaaacaaccgaccgaacgaccaaaccaccccaactcatcttattacgagacggacctagcgacggccgtaccgtcggtacggtctgtacgtctaccgtcttcgtcgcgtccgtaccgtcgtcgtcgacgaccgtccgaccgtccctaccgacgaccttacgtccgtcgggtacggttccgtaccggnggggtaccggtagggaacgtacggttacgttaagtttaacgtttagtttcgtggttattccgttataggttacggtcgggtagttaggtaccggttacgggtacgggtacggggtaaggggtaccgggtcggggtaacgggtaagggtaaccggtacggggttaccgtaaccgggttccgtaacgggtaaccaccccgggttaccgtaaccggccccgttccccggtccccgttcgttacccg

SEQ ID NO: 129857 - DNA, 680 bp, Homo sapiens
  misc_feature: GYAE6OF01BA6RQ.49.52.E08.1.454.CMB.1.raw
  modified_base (232)..(232): a, c, t, g, unknown or other
  misc_feature (232)..(232): n is a, c, g, or t
tcagagtcgagagacacgaccggtgctcgattttagtcgagctctctcggcggggggggtcacaagaggcagcgctctcgggacgtctccaccatggcctggctctgctgctcctcactctcctcactcaggacacagggtcctcgggcccagtctcgccctgactcagcctcgcctccgtgtcgtggtctccgtgacagtcgatcaccatcctctgactactacgaaaccnacgatgagttggtaggtaattacgttaacctttcgtacgtacggtaaccaactaaccaccgaagaaccaaaccgacccccaaactcaactatacgtttaagcgacggccaactcgacgaccgtaccgtcggacgtctctgtactcgtcttctctcggtcctaccgtacgtacgtcgacgtacgccgacgtccctacgtacaacctacgtcttcgaggtacccgtcgaggtacgacgggtcgtagtcgttaatagtttacgttagtcgtatcggttacaagttctacggtcgggtaatacgttaccgggtaggtacccgggtaggggttcccggtaacggggaccgggttaagggaaccgtaaaggggttcccggtaaccttagggtaccgggtacccaaaccgggttcaaccgggtcccttaccccggggtccccgtttgaacccccg

SEQ ID NO: 129858 - DNA, 751 bp, Homo sapiens
  misc_feature: GYAE6OF01AWSJH.49.52.E08.1.454.CMB.1.raw
  modified_base (182)..(182): a, c, t, g, unknown or other
  misc_feature (182)..(182): n is a, c, g, or t
tcagagtcgagagacacgaccggtgctcgatttagtcgagctctcagagaggaaagggggtgggtccaggaggcagaactctgggtgtctcaccatggcctggactccctctacttcctcccctcctcactctctgcacaggctctgacgcctctatgagctagacacagtccaccgtggtntctgtcgtcctcgacggacacggaccggccaggactccacctcgcctgtggactatcgactagtaccgaaacctaaaatactgtcgtaccttacgtaccggtacacggacgacggaccggtaccgacggtcccgtaccggttccccgttggtttaccggttaggttattaacgtttaaacgtaacggttacgtttaggaccgtacccggtacctacgggacccggtaccgtagacgtcgtaccttcgtacgcggtacctacgacgtacgtacggaaccggaactaacggtcgtaccctacgtacgactacgtacgtacggtcggtaccggccgtaacgaacgggacggtacgggtacgtacgtacgttaaccgttacgttacggtcgtaccgaccggtaccgaagtacgtaacgtcggacgttacgggtcgttaacggttaagtttccgtacgggtttacggacgggttcggggaaaccgggtaccggtactacccggtacggtaccgtacccgttacggtaccggtccgtaacccggacccgttacggttccccgtccccgtacccgg

SEQ ID NO: 129859 - DNA, 771 bp, Homo sapiens
  misc_feature: GYAE6OF01CM8OG.49.52.E08.1.454.CMB.1.raw
  modified_base (200)..(200): a, c, t, g, unknown or other
  misc_feature (200)..(200): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacagggtcctgggcccagtctcgccctgactcagcctcgcctccgtgtcgtgggtctccgtggacngtcgactcacctatcctcctgacctacgtacgaaaccagactagtgagttggttaggtaatttacgttaacctttcgtaccgtacgtaaccaaccaaccaccgacggaaccaaaccgaccccctaaactctactactatttacgacggacgaccgtacgtacgtacggtccgtcccgtacggtacgggttctacgtacgtcgtaccgttccttcgttcgtccgtacctccgtacgtcgtcgacgtaccggaccgtacccggtcccgtacccgtaacggtaacctacgtttccgtaccgggtaccggcccgtaccgggtacgggtccgggttaacgggggaccgtacggtacgtttaacgttacgtttaacgtttagttccgtttcgttaacgttactacggttacggttccgggtacgggttagtacgggttaacgtacgggggtacgggttacggggttccgggtaacgggggacggtaacgggaacggtacgggtaccgttaccggtacggtaccggaccggtaccggaccggtaccggtccctacccgggtcccgtaccggttacccg

SEQ ID NO: 129860 - DNA, 727 bp, Homo sapiens
  misc_feature: GYAE6OF01AG8I2.49.52.E08.1.454.CMB.1.raw
  modified_base (235)..(235): a, c, t, g, unknown or other
  misc_feature (235)..(235): n is a, c, g, or t
  modified_base (250)..(250): a, c, t, g, unknown or other
  misc_feature (250)..(250): n is a, c, g, or t
  modified_base (505)..(505): a, c, t, g, unknown or other
  misc_feature (505)..(505): n is a, c, g, or t
  modified_base (539)..(539): a, c, t, g, unknown or other
  misc_feature (539)..(539): n is a, c, g, or t
tcagagtcgagagacacgaccggtgctcgatttagtcgagctctctcggcgggggggtcacaagaggcagcgctcgtcgggacgtctccaccatggcctgggctctgctgcctcctcactctcctcactcaggacacgcggtcctggcccagtctcgccctagactccaggcctcgcccgttccgtgttccgtgggtcctccgtaggacacggtcactccacctatcctcctacncgtatacggaaaccnggactcgtggtattggggtacgttaacttacttaaccctttcgtacctacggtaacccaacaaccaccgaacggtaccaaaccgtaccccctaaaactactactacttactttaacgcggtacgaccgtactcggacggccgtacccgtcgtacggtctcgtacgtactccgttactcgtccgtacgtctcccgtacctagtcggctacgcgtacctccgacctcgacgtctctcgtccgtactacggcgtcggnggtacgaggtcttagtacgtttattcgtgtcctntttactacgggtatacgggtcgtacggttgtacgggtacggggaacgggttcgggtacgggtggggtaaacccgggtagggaaacggtttacccgggttccgggttacggtaccccgggttaggaaacccggttccggaaccggaacgggttcccccgtacccgggttcccgttcccgggtaaacccg

SEQ ID NO: 129861 - DNA, 791 bp, Homo sapiens
  misc_feature: GYAE6OF01C6PY1.49.52.E08.1.454.CMB.1.raw
  modified_base (83)..(83): a, c, t, g, unknown or other
  misc_feature (83)..(83): n is a, c, g, or t
  modified_base (187)..(187): a, c, t, g, unknown or other
  misc_feature (187)..(187): n is a, c, g, or t
  modified_base (257)..(257): a, c, t, g, unknown or other
  misc_feature (257)..(257): n is a, c, g, or t
  modified_base (496)..(496): a, c, t, g, unknown or other
  misc_feature (496)..(496): n is a, c, g, or t
  modified_base (761)..(761): a, c, t, g, unknown or other
  misc_feature (761)..(761): n is a, c, g, or t
tcagagtcgagagacacgaccggtgctcgatttagtcgagctctcagagaggaaggggtggccaggaggcagactcgtgggtntctcaccatggcctggactccctctacttcctccccctcctcactctctgcacagctctgacggcctacctagtgagtctagaccacacgccccaccgttggtntccttggttcgtcccgtgaagggaccaacggaccggcctagttatcccacgttcgccttgtagggaagtntcgactagttacgaaaccaaagataaatgtcggttaccttacgtacggtaacagcgaaaggaaccaccggtaacggccgaccggttccccttaggttcgtagtaaccttagttaaaagttttaacgaaaacggttgtttaacggaacgggtaaccgggtcccgtaaccggggtaacccgggaccgtacggggtacggttacctaccgttttcggcggttacccggtcctaacccggganaccccggtataccggaacccgaaaccttaaacggaccgttccggttaaccgtacccgtacgtaacgtacgggtaacgggtcgggtaaccgggtaaccggggaacgacggggaacgtaccggtacgtacgtacttaacccgttagttggtactcggtaactacgttacgaagggtcgtaaaggttcgttacggtcgttacttgttaccgtggtttaaccgggtcggacgggacgggacgtaaccgtcgttagtcccggttaaacgnggttaccgaacccggagtccccgtacccgg

SEQ ID NO: 129862 - DNA, 681 bp, Homo sapiens
  misc_feature: GYAE6OF01A27VM.49.52.E08.1.454.CMB.1.raw
  modified_base (234)..(234): a, c, t, g, unknown or other
  misc_feature (234)..(234): n is a, c, g, or t
  modified_base (388)..(388): a, c, t, g, unknown or other
  misc_feature (388)..(388): n is a, c, g, or t
tcagagtcgagagacacgaccggtgctcgatttagtcgagctctcagagaggaaagggggtgggtccaggaggcagaactctgggtgtctcaccatcggcctggatccctctacttcctccccctcctcactctctgcacaggctctgacggcctcctatgagctgacacagcccacccgtggtgtcagtccgtccccaggacacggacggccaggactcacctgctcgtgganatgctattcgaccaaaccgatatgtacttagttcggtaaccagcaacggaacggccgggaccgacgggtccccttaggttcggttggtagtagttagtaaagtaaacgactacgtagacggacgccgtaggacggactccgagacgcgtattcncgtcggtcctcggtacggtacggacggaccgtacggtacctacgtacgtcggctacgtacgtaggtcgggacgtcgaacggcgtaagggaacgggtacggacggtacgtacggtaagtttacttacggttagtacccgtaaattaaccgaacgtaaccgtaccgtaaccgttaggttaacggtttacttacggtacgttaccggtacgggtactacggtaccgacgtaccggtcctacccggtccgtaggtaccgaccgaacccgacgggaacccctcccgtagtccgtaccc

SEQ ID NO: 129863 - DNA, 791 bp, Homo sapiens
  misc_feature: GYAE6OF01EQUFW.49.52.E08.1.454.CMB.1.raw
  modified_base (241)..(241): a, c, t, g, unknown or other
  misc_feature (241)..(241): n is a, c, g, or t
  modified_base (285)..(285): a, c, t, g, unknown or other
  misc_feature (285)..(285): n is a, c, g, or t
tcagagtcgagagacacgaccggtgctcgatttagtcgagctctcagagagaaagggggtgggtccaggaggcagaactctgggtgtctcaccatggcctggactccctctacttcctccccctctcactctctgcacaggctctgacgcctctatgacgctgaacacacgccctacccgtcggtctcagttcgtccccgaaggacacggaccggtccgaaggactccactgctcgtgganatcgctattcgaacctaaacgatactgtacttagttcggtacanacgagacggccggcaccggtccctggttgttcggtagtacttagtaacgtaaacacgtacgtagaacggtcgtacccgtacggtacggtacctccgtagtcgtacgtagttccgtcgtcggtacctaccggtaggtaccggaacggtaaccgtaacggtacctaacgttacgttcggacctaacgtcggtacgtagggtaccgtaccggtaacgggaacgtaacgggacgggaacccgggtaggtaccttaagggttaactttaacgtttacggtttaacgaaccgttaacaaccgtaaaccgtaacgtaaccccgtaaagtttaaaccggtttacgtttaactttacgttaccggttaacccgttaacgggttaaccgttaccggaaacccgtaaccgggttaaacggtccccggttaacccgggtttccggaccgggtaaccgaacccccgggtacccaaaccccgggaacccccctaaaccgtacccgttaccggttaacccc

SEQ ID NO: 129864 - DNA, 833 bp, Homo sapiens
  misc_feature: GYAE6OF01DEMHA.49.52.E08.1.454.CMB.1.raw
tcagagtcgagagacacgaccggtgctcgatttagtcgagctctcagagagaaagggggtggtccaggaggcagaactctgggtgtctcaccatggcctggatccctctacttcctccccctcctcactctctgcacaggctctgacggcctcctatgagctgacacacgcccacccgtcggtgtcagtcgtccccgaggacacggaccggccaggactccacctgctcgtggctatcgctagttacgaaccaaaactatagtcgtacctttacgtacgggtaaccacggacgacggaaccgggccgtaaccgggaccccgtaccgggtccccccgttgggtttaccgtttagggttagttaaacgtttttaaacgtaaaaggtttaccgttttacgggaacggtacccggggtaccccttaccgggaacccggggtacccccgtaggtaccggtaccgttactttccgtcgtccgggtacccttccgacgtccgtaacgggtaacggaacctaaaccgtacgtacccgtacccgttaccggtaacctacgttacgggtaacgggtaccgggtaaccgggtccccgggaaccggaacgggtaaccggggaacgggtacgggtcggttaaccgtaagtttaaccgttaccgtacgggttaccgtaaacggttcccccgaagaaccggtaaccgacgaaccggttagggtacgggtacttaaggtttagtcggttacgggttcgtacgggggccgggtaggtacccgtggtacccgtcggtacccgttacgtagtccgacccgtaccggacggccctccccggtcccgtacccgg

SEQ ID NO: 129865 - DNA, 885 bp, Homo sapiens
  misc_feature: GYAE6OF01BLAA4.49.52.E08.1.454.CMB.1.raw
  modified_base (209)..(209): a, c, t, g, unknown or other
  misc_feature (209)..(209): n is a, c, g, or t
  modified_base (222)..(222): a, c, t, g, unknown or other
  misc_feature (222)..(222): n is a, c, g, or t
  modified_base (247)..(247): a, c, t, g, unknown or other
  misc_feature (247)..(247): n is a, c, g, or t
  modified_base (355)..(355): a, c, t, g, unknown or other
  misc_feature (355)..(355): n is a, c, g, or t
tcagagtcgagagacacgaccggtgctcgatttagtcgagctctctcggcggggggggtcacaagaggcagcgctcgtcgggacgtctccaccatggcctggctctgctgctcctcactctcctcactcaggaccacgacgggtccgtcgggcctagtctcgcccgttgactcgacgcctcgccctccgtgtcgtcggtctcgtggacngtcactccacctntccgtactgcctacgtaacgaaccncgtatacgtgtagtttacggtaagttaacgtttacttaaccttttcgtaaccgtaaccgtaaccgaaaccaaccgtaaccgtacgaaacccgtaacccacccctaacncgttaactacttacgttacggacgtaacggtcctacgtaccggccgtaccggtccgttacggtaccggttctacgtacgtaccgttctcccgtttacggtccgttcccggtaccgtaccggttccggttcggaccggtaccgtaccggtaccccgtacccgttcccggtaacctaaccggttaactacccgttcccggtaacgggttccggaacccgttacgggtacgggtaccgggtaacgggttacgggtctttacggtttaacgtttaacgttttacgtaggttttaccgttaccgtttagtttaacccgttacggttacgttaaccgggtaccggtttaagggttaccgggttaacggtcgggggttaaacgggttcggggttaccggggaacggggtaccggtaacccgggttaacgggttacgggtaccccgttaaggggttccccggtaacggttaaccccgaccgggttaacccggttaacccgttccccggtaccccggttccggttacccgttaccccgg

SEQ ID NO: 129866 - DNA, 797 bp, Homo sapiens
  misc_feature: GYAE6OF01BRXX0.49.52.E08.1.454.CMB.1.raw
  modified_base (140)..(140): a, c, t, g, unknown or other
  misc_feature (140)..(140): n is a, c, g, or t
  modified_base (145)..(145): a, c, t, g, unknown or other
  misc_feature (145)..(145): n is a, c, g, or t
  modified_base (160)..(160): a, c, t, g, unknown or other
  misc_feature (160)..(160): n is a, c, g, or t
  modified_base (190)..(190): a, c, t, g, unknown or other
  misc_feature (190)..(190): n is a, c, g, or t
  modified_base (270)..(270): a, c, t, g, unknown or other
  misc_feature (270)..(270): n is a, c, g, or t
  modified_base (276)..(276): a, c, t, g, unknown or other
  misc_feature (276)..(276): n is a, c, g, or t
tcagagtcgagagacacgaccggtgctcgatttagtcgagctctcagagaggaaagggggtggtccaggaggcagaactcgtgggtgtctcacagtggcctggactccctctaccttcctccccctctcactctctgcancgctntgacgcctactatgngtctacgacacaccgcccgtccgttcggtntcgacgtacccgccgaagcacggtccgacgagtctccgtcgtgtactgtagatcgtcgactacgtaccgaaacgtacgtntacgtnttacgttacgtacgtacgaacgacggacggaccggccggtaccgtcgtcgttggttgttaggtagtacgaaggtaacgtaacgacgtacgacggtaccggtacgtaccggtacggacggttaccgtcgtacggtcgttcgtacgttccggtacccggtcgtaccggtaacggacggtaacggaaaccggtcgaccgttacgtaccgtacgtacgtaccgtaccgtacgggtaccggtacggtacggacgggtaacggaacggtaacgggcgggtacggtaccggtacgttaacggtttacgttacgttacgttaactaactaacgtaacgtaaccgtaacctaccgttacggttaccgtttaacgtttacgttacgttacgttacgttaccggtaccgtaaccgggtaaccggttaaccggtcccggttacccggttaccggtcccggtaccgggtaaccccgtaaacccgggtaccccggtaaaccccgtaccccgttaaccgtacccgtccccgtaacg

SEQ ID NO: 129867 - DNA, 772 bp, Homo sapiens
  misc_feature: GYAE6OF01CAM7H.49.52.E08.1.454.CMB.1.raw
  modified_base (118)..(118): a, c, t, g, unknown or other
  misc_feature (118)..(118): n is a, c, g, or t
  modified_base (350)..(350): a, c, t, g, unknown or other
  misc_feature (350)..(350): n is a, c, g, or t
tcagagtcgagagacacgaccggtgctcgatttagtcgagctctctcggcggggggggtcacaagaggcagcgctctcgggacgtctccacagtggccgtggctctgctgcctcctcnctctcctcactcgagacacgtgggtccgcggccctagtcgccgtcctagctcacgcctcgcctcgtgtcgtcggtctcgtgacagtcgactacacctgttcctcgtacgtaccaacgtaacgaaccgagtacgtagtagtaaggttaggttaagttaacttttaacctttaccttttcgaccgtaacgaaaccaaaccaccgaaaccgacgaaccaaccgaccaatcaactnttaacgttagacggacctacacgcgtaccggccgttaccggtggtacggtctaccggtatcggttaccttcgttccgtaccgttcggacccttacggtacgtccggaacgcccgacggtaccgtacccctccggtacctaacgtacgtacgtcccgtacggtccggtacacgggtcgggaccgggtaaggtccgggtaagtcgttaagtttcgtttagtcgttacttgttacttaagtcgttagggttccgtaagtaacgggttgacggggttagggtaacgggtggttaaccggggcgggaacgggtaacgggaaaccgttacgggacccggttttaacgcccgggtaacgtacccggttaaaccggaccccgggtttacgttaaccccccgggtccgtttcccccgggagttttaccccg

SEQ ID NO: 129868 - DNA, 867 bp, Homo sapiens
  misc_feature: GYAE6OF01EAN81.49.52.E08.1.454.CMB.1.raw
tcagagtcgagagacacgaccggtgctcgatttagtcgagctctctcggcggggggggtcacaagaggcagcgctctcgggacgtctccaccgatggcctgggctctgctgctcctcactctcctcactcaggacacagggtcctgggcccagtctgccctgactcagcctgcctcgtgtcgtggtctccgtggacagtcgatcaccatcctctgtcactacgaaaccagcagtgtattggtaggtaattacttaaccttttctccttacggtaaccaacaaccaccgaggacaaaccgacccccaaactcactactattttacgtacggacggtaccgtatccgaacggtcccggtaccccgttaccggtaaccgggggttccttccgttacgtaaccgttcccgttccgtttcccgttccggttccgggtaccctttacccccggtaaccggtttccggttacggggtaacccggacccggtaacccccggtaaaccccgggttccccccgtttaacccccggtaacgtaaacccttaaccgtttccccgttacgggttaccgggtcccctacgggtaccgggtaccgggttacgggggaaccgtacggggttaacgtttaggttaactttttaagtttcgtttcggttccgtttacgtttaccgttaaagtttccggtacggttaccgggttaggttaacggttaccggggtacgggtaccggggttaaggggttcggtacgggggtacgggaaacggggtaacggtaaacgggtaccggtaccccgggttaacggtaccgggttaccgaaacccggtcccggaaacggtccccgttccccggtcccccggttcggttaccccg

SEQ ID NO: 129869 - DNA, 842 bp, Homo sapiens
  misc_feature: GYAE6OF01DE813.49.52.E08.1.454.CMB.1.raw
  modified_base (135)..(135): a, c, t, g, unknown or other
  misc_feature (135)..(135): n is a, c, g, or t
  modified_base (288)..(288): a, c, t, g, unknown or other
  misc_feature (288)..(288): n is a, c, g, or t
tcagagtcgagagacacgaccggtgctcgatttagtcgagctctcagaggagaaagggggtgggtccaggaggcagaactctgggtgtctcaccatggcctggatccctctacttcctccccctcctcactctcngcacgaggctctgaggcctcctatgatctagacacacgcccacccgttcggtgtctacggtccgtaccccgaggaacgaggacccggaccgaacggtactcccgtacctggtcctcggtagggaagtagtcgtctacttacgaaccaaacgtntagtgtaccttagtcgacagacgaacggacggccggaccgcggtacccttggtaggttggtacgtagttacgaagtaacgactacgtaggtacggacggtacccgtaacggaacgggtaccttaccggtacggtacgtacgttaacgtttccgttaccggtcggtacccgtaacggtacgggtaccgggaaccgggaaccggttaacccgcggttaaactaccggttaccggaccgtaacggtaccggtagggttaaccggggaccgttaaccggggaggtaaccggtaacgggtacggggaccggttacgtacggttagttaaacttacgtttacgtactaacctaaacgttaacgaaaccgtaccgtaaaccgttaaccgtaggttttaaccgttacgttagttaccgggtttaaccgtaaccggtaacgtaccggtacccgttaacccgggtaacccgaccgggtttaacccggttacccggtaacgggttaccccgaacggttaacccccgtaaccgaaccccccgttaaccccgtcgtaccgtaccccg

SEQ ID NO: 129870 - DNA, 764 bp, Homo sapiens
  misc_feature: GYAE6OF01C5EBR.49.52.E08.1.454.CMB.1.raw
  modified_base (125)..(125): a, c, t, g, unknown or other
  misc_feature (125)..(125): n is a, c, g, or t
  modified_base (459)..(459): a, c, t, g, unknown or other
  misc_feature (459)..(459): n is a, c, g, or t
  modified_base (475)..(475): a, c, t, g, unknown or other
  misc_feature (475)..(475): n is a, c, g, or t
tcagagtcgagagacacgaccggtgctcgatttagtcgagctctctcggcggggggggtcacaagaggcagcgctctcgggacgtctccaccatggcctgggctctgctgctcctcactctctcnctcaggacacgaggtcctggcccagttctcgcctgactcacgcctgcctcgtcgtcgttcgggtctaccgtggactacgtcgataccacctactccttccgtgacctaacgtaccgaaaccgtacgcgtaggttacggtagttagggtttaaccggtaaattttaaccgttttaccctttacttaccggtaacgtaaacccaaaaccaaccgaaccgaacggaaaccctaaacccgacccctaatacgtaaccttaacttaggttacgcggtacggaactcgtacgacgtccgtccgtaggcggtacttcagtacctcgtcttacctcggtacnctccgtacgtcggtcnccgatccccgtacgtccccttaggacacttctccggtcgtcggcgtacggcggtacggtcgggacgttcgtgtacttagttcgttacgttcgtcgtacgttaagcgttaccggtcggtacgttagtcgggttaacggtcgggtacggggttacgggttacgggttaccgggacggggttaaccggtacggttaccggggttacgtaaccggttaccggtaaccgggtacccgaacggttacccggtaacccgggtcgtttaaccccggtcccggtttcgtaacccccgg

SEQ ID NO: 129871 - DNA, 894 bp, Homo sapiens
  misc_feature: GYAE6OF01DO5SY.49.52.E08.1.454.CMB.1.raw
tcagagtcgagagacacgaccggtgctcgatttagtcgagctctctcggcggggggggtcaacaagaggcagcgctctcgggacgtctccaccatggcctgggctctgctgctcctcactctcctcactcaggacacgaggtcctgggccagtctcgccctgactcacgcctcgcctcgtgtcgttgggtcctccgtggactagtcgactcacctatcctcctgaccactacgaaaccagtcaggttgagttaggttaggtaatttacctttaccttttcctaccgtaacgtaacccaaacctaacccaacccgtaacggaaccctaaaacccgacccccctaaactaccaacttaccttaagtttacgtacggacggaccgtactaccgacggtccccgtacccgtacggaccgggttcctcgtacgtacgttctccgtttccgtcgtccgtccctaccgtccggtcgtacggacgaccgccggaccccggttccctaccgtacgtaactaccgtccgttaccgggtccggcccgttacgggtacgggtacggggtaccggggtacggtaccgggttacgttacgtttaaacgttttacgtttaacgtttcggttaccgtttaacgttcgttaaacggtttccggttaccggggttaccgggtttaacgggttaaggtttacccgggggtacggggttacccgggggtttaacggggggtttacccgggtaccgggggggtaaacccggggtaacccgggggtaaaccgggttaaccggggtacccgggtttaacccggtacccggggttaccggtaccccggaacccgggttacccgtacccggggtacccccggttacccccggtcccccggttacccggtttacccccgg

SEQ ID NO: 129872 - DNA, 1119 bp, Homo sapiens
  misc_feature: GYAE6OF01EO38X.49.52.E08.1.454.CMB.1.raw
tcagagtcgagagacacgaccggtgctcgatttagtcgagctctctcggcggggggggtcacaagaggcagcgctctcgggacgtctccaccatggcctgggctctgctgctcctcactctctcactcagacacgacggtcctcggccacggtctcgcccgttgacctcgacgtcccgtcgtcccgttccggttcggtccggtttcggggtccttacccggtcgggtaacctacgggttaccggtaacttacccgaaacctactttcccgttacccgttactaccgaaccgttaaaaccggaaaaccccgaacggtaccgtaacggttagggttaacggttttaggggttttaaacggggtttaaaaaccttttttaacctttttaaaccccgtttttttcccggttaaccccggtttaaaccggaaaaacccctaaaaacccgtaaaccccgaaaccccgggtaaaaccggtaaccccgtaaaaacccccgtaaacccccctaaaaaccgttaccgtacttttaaaccgtttaaacgtttaacgggaaccggtaccgggtacccggtaaccgttaccgggtacccgggtaccccgggttacccggttaacccggggtttaccgggttaccgtttacgttaaaccgggtccgtttaccccgtttccgttttaccggtcccggttttacccgcccggtttacccggttaaacccggttccggtaaccggtaacccggacccggtaccccggttaaccccggttacccctttaaccgtaaccgtaaaccgttaaccctttcccggtacccgggttaccgggtacccgttaccgggggtaccgggaacggggttaccgggggtaaccgagggttaccgtttaactttaaggttttacgtttaccggttcgttaacgttccgtttcgtaaagtttcccggtacggtacggttaacgttacggttacgggggtaaccggtcggggttaaaccgggtcgggtaacgggggacgggaaacgggttaaccgggtaacggttacccgggtacccggtacggttaacccggacggaaccccggttaccggaacgggtcccggttccccgtaaccggtccggttaccccg

SEQ ID NO: 129873 - DNA, 778 bp, Homo sapiens
  misc_feature: GYAE6OF01BF24C.49.52.E08.1.454.CMB.1.raw
  modified_base (219)..(219): a, c, t, g, unknown or other
  misc_feature (219)..(219): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacgagggtcctcgggcccagtctcgccctgacctcacgtcctgccctccgtgtcgtcgggtctccgtggactggtcgatccaccntcctcctgctactagaaaccgtgctagtgtagttggttaggtaactttaattacccttttcgtacctacggtaaccaaaccgaaccacccgaaggaacccaaaccgtaccccctaaactcctaacttacttagtttacgacggacgtacccgtataccgacggtcccgtacccgtagtacgggtcctcgtacgtacttccgtccttcgtccgtcggtacccttccggacgttcggcgaccgacggtccccgccggtacccgtccgacgtactactcggtccgtccggacgtccggaggtccgggtacggggtacgacgggttcgtaacgttacgtttagtacgttggttacttagtacgtacgtggttccggtacgttaggtaccgggttagggtacccgggtacggggttacgggttcgggtaccggggtaccggggaaccggttagggtacccggttaccgggtacccgggtttaaccgacgggttaacccggaaccgttacccggggtacccggtaccccggtttccccggtacccccgggttcgttaacccccgg

SEQ ID NO: 129874 - DNA, 997 bp, Homo sapiens
  misc_feature: GYAE6OF01DDLGO.49.52.E08.1.454.CMB.1.raw
tcagagtcgagagacacgaccggtgctcgatttagtcgagctctctcggcggggggggtcacaagaggcagcgctctcgggacgtctccaccatggcctgggctctgctgctcctcactctcctcactcaggacacgagggtcctggccagtctcgccctgactcgacgcctacgccctccgtcggtccttacggggtcctccgtcgggtaccacggtacgtagtccacccattcctacccttgaccgtaacctaacgaaaaccgacggactaacgggttacgagttaggtttagggggtaaacttttaactttaacccgtttttacccgttcccggtttacggtaacccctaaacccaaaccgaccccgtaaacgggtacccaaaacggtacccccctaaaacctaccgtaacttaccgtaactttaacggttacgaacgggtaaccgggagttaccgaacggaccccggggtaccccggttaacggaccgggggttaccgtaccgttacggtacgtttaccggtacgtttaccctttccgtaccgggttacccgttaccccgtacccggtttccgttaccggggaccgtacggtacccggtaacccggggttccccgtaacccccttacggggtaaccctaaaccgtcccggttccggttacggggtacccgtttacccggtaccgggtccgggtttaacgggggtacccgggacggggttaaccggttgttaagttttaaccggtttaattttaggggtaccgtttacggttttcggaacgtttacgtttacgggtcccggttaagggttaaccgttaagggttaaccggggcccggtttaaaccggggggttggttaccggggttaccgggaaaccgggggtaaacggggttaccgggttaaggaaacccgggtttacccgacccggggttacgaaccgggtaccctaaccggggtacccgtccggtacccccccggttacccgggtacccgg

SEQ ID NO: 129875 - DNA, 802 bp, Homo sapiens
  misc_feature: GYAE6OF01CD6LZ.49.52.E08.1.454.CMB.1.raw
  modified_base (265)..(265): a, c, t, g, unknown or other
  misc_feature (265)..(265): n is a, c, g, or t
tcagagtcgagagacacgaccggtgctcgatttagtcgagctctctcggcgggggggggtcacaagaggcagcgctctcggggacgtctccaccatggccgtgggctctgctgctcctcactctcctcactcaggacacgagggtcctgggcccagtcgtcgccctgactcacgccgtcgtccctccgtgttccgttcgggtcctccgtacgggactacgttcgactccaacctacttcctccgtcgacctacgtaacgaaaccngcgagtcggtaagttggttaacggttaaacttttactttaacccgtttttcgtacccgttacggtaaacccaaaaccgtaacccgaaccgaaccggtaaaccaaaaccccgtaaccccctaaaacgtacttaaccgtaacttaacgttttaacgacggaccggtaccgactacggaccggtccgtacccggtcggtacgggttcctacgtacgggtactcccgttcgttaccgtcgttaccggtcccttaccgtacgtcggtacggaccaccggtaccgcccgtacctaccgtacaacctactccgttccgtcggaccgtacggtacgggtacgggtacggggacgtacggttacgttagttacgtttagttacggttcgtctttacgttacgtacgtcggtacggtcggtacgtaagggtcggtacgggtacgggtaggttcgggtacggggacggtagggtaaccggcggttacgtacccggtgtaccggtacgacccgaccggaccgttaccggcccgtacccggtctacccgg

SEQ ID NO: 129876 - DNA, 705 bp, Homo sapiens
  misc_feature: GYAE6OF01DZHWU.49.52.E08.1.454.CMB.1.raw
  modified_base (231)..(231): a, c, t, g, unknown or other
  misc_feature (231)..(231): n is a, c, g, or t
  modified_base (600)..(600): a, c, t, g, unknown or other
  misc_feature (600)..(600): n is a, c, g, or t
tcagagtcgagagacacgaccggtgctcgatttagtcgagctctctcggcgggggggggtcacaagaggcagcgctctcgggacgtctccaccatggcctgggctctgctgctcctcactctcctcactcaggacacagggtcctgggcccagtctgccctgactcagcctgcctcgtgtctgggtctccgtggactagtcgatccacatcctactgacactacgaaaccngtcaagtgtagttaggttaggtaaatttaactttaaccctttttcgaccgttaggttaaacccaaaacctaaccaaccgaagggaacctaaaaaccgacccccaaaactcctaattacgtaacttttatacggaacgccgaaactcgaacggcccggtaccctaggtaaccgggttcctacgtacgtacttcggctttacgcgtacggtcctccgtaacgtccgtaggaccgcgaccgtaccgggacccttaccgtaacgtaacgtacgttaccctccggggtacggtacctaaccgggtcggtaaccgggtcgggggaactacgggtcttaacgtagttttaacttagtctaacgtgtacagttacgnggtaccgtagaacgtgaccgacggtagggttcgcggagggtacgaagtacgggtctacggtccgagtaccgacgtacccggatcctacccggtctacggtaaccc

SEQ ID NO: 129877 - DNA, 752 bp, Homo sapiens
  misc_feature: GYAE6OF01DBS0L.49.52.E08.1.454.CMB.1.raw
  modified_base (239)..(239): a, c, t, g, unknown or other
  misc_feature (239)..(239): n is a, c, g, or t
  modified_base (488)..(488): a, c, t, g, unknown or other
  misc_feature (488)..(488): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacagggtcctcgggcccagtctcgccctgactcagcctgcctcgtgtccgtggtctccgtggacagcgatccaccgatcctccctgacctaacgtacgaaaaccngtcgtagtgaagttggggttacggtaaaattttaacttttaaccccgttttcctaccggttacgaaccctaaaccaaacctaacccgaccgaacgaaacccaacccctacccctaaactactacttattacttaggcgtaacggctacgtaccgcgtcccggtacggtccggtacgtcgtagtctgtcctttcgtcgtacgtcctcgtaccgttcgcgtacggactccggtccgtccctacccggtacncgtaactcgtcgtacggcttcggacggtggtacgggacgtacggtacttggttaactttaagtttgggtttactcgttacgtttaacgattacggttccggtagggttaacgtacgggtaggtttccgggaaccggggtggggttaccgggtacgggacgggggaacggtaaggtaaaccgggtcccgggtacgttacccggtaccggtagtaccccggaccgtaaccggtccacccccgggttccccggttccgtaacccggg

SEQ ID NO: 129878 - DNA, 722 bp, Homo sapiens
  misc_feature: GYAE6OF01AS70Y.49.52.E08.1.454.CMB.1.raw
  modified_base (212)..(212): a, c, t, g, unknown or other
  misc_feature (212)..(212): n is a, c, g, or t
  modified_base (233)..(233): a, c, t, g, unknown or other
  misc_feature (233)..(233): n is a, c, g, or t
  modified_base (330)..(330): a, c, t, g, unknown or other
  misc_feature (330)..(330): n is a, c, g, or t
tcagagtcgagagacacgaccggtgctcgatttagtcgagctctctcggcgggggggggtcacaagaggcagcgctctcgggacgtctccaccatggcctgggctctgctgctcctcactctctcactcaggacacagggtcctgggcccagtctgccctgactcacgcctgccctcgtgtctgggtcctccgtggactgtcgatccacctntcctcctgcactacgaaaccngcagtgagttggttaggtaatttacttaccttttctccgtacggtaaccaacaaccaccacggacaaaccgacccccaaatcctaatctatttacgnggtacggcctacgtaccgtacggcccggtcccgtacggtacggggttcctacgtcggtaacttcccggttctttccgttcggtcggtccgtaccgtacggtcgtacggacgtacgaccgtacccggtccctacccgtactaactacgttccggttccgtcgggtccgtaccggcgggtacgggtacggggacggtacggtcttaagttatttagtttgttctcgttagttcgtaacgttggtcggtccggttaggtagttcgggacgggtcgggtaaggggttccgggtacgggacgggaaccgggtacggtaacgggttccggaaccggttacgccgggtacgaccggacccggtaacgtccccggtcccgtacccgggttcgttccccgg

SEQ ID NO: 129879 - DNA, 824 bp, Homo sapiens
  misc_feature: GYAE6OF01APH6G.49.52.E08.1.454.CMB.1.raw
  modified_base (116)..(116): a, c, t, g, unknown or other
  misc_feature (116)..(116): n is a, c, g, or t
tcagagtcgagagacacgaccggtgctcgatttagtcgagctctctcggcggggggggtcacaagaggcagcgctctcgggacgtctccaccatggccgtggctctgctgctcctnactctctcactcaggacacgagggtcctgggccctagtcctcgcctgacttcgacgtcctgcctcgtgttcgtcgggttctccgtggactagtcgactaccacctatcgtcgtacgactacgttaacgaaccgtagaccgtagtcggtagtttaggttaacgggttaaattttacccgttaaaccctttttccgtaacccggtaacgtaacccaaaccgtaacccaccggaaagtaaccctaaaccccgtaaccccaaaattccgaattacctaagttacgtacggaccggttctaacgccggaacgccccggtacccgtagggtaacggttcctaggttaacggcctttccgtctttaacgggttcggttaccccgacccgttacgtacggttcggacgtaccgtacggtcccggtaacccgtcccgttaccgtacgaaccgtttacggttccccgtcggttaccgggtaaccgtttacccgggaacggtttacgggacggggttaacgggtaccgtagtttaacgttacgtttaacggtttcgtaacttccgtaattacggtaactcgggtacccgttaaggtacggtacggtaacgggtacggtacgggttacggtccgggtacggtacgggtaaccggtaccgtaccgggtacgccgttaacgccgtaacgaccgtaccggctacccggcctccgttcctaccg

SEQ ID NO: 129880 - DNA, 808 bp, Homo sapiens
  misc_feature: GYAE6OF01AU48M.49.52.E08.1.454.CMB.1.raw
  modified_base (229)..(229): a, c, t, g, unknown or other
  misc_feature (229)..(229): n is a, c, g, or t
  modified_base (247)..(247): a, c, t, g, unknown or other
  misc_feature (247)..(247): n is a, c, g, or t
tcagagtcgagagacacgaccggtgctcgatttagtcgagctctcagagagaaagggggtgggtccaggaggcagaactctgggtgtctcaccatggcctggatccctctacttcctccccctcctcactctctgcacaggctctgaggccttcctatgagctgacacagcccaccctcggtgtcagtcgtccccgaggacaggacggccaggatccactgctgtgganatgcattcgaccaaacgntatgtacttattcggtaccagacgaagaacggcccgggaccgacggtcccccgtgttacgggttcgggtagtagttagtaaataaaggacctacgtagaacggaccggtcccctacgaacgggtacctacccgtaggacgacgtattccgtcgtcggtcctaccggtacggtcgacgggaaccgtaacggtacaccgtacgttacggacctagtaccggaggttcgggtaacggttaccggaaacggacggtaaacggggaacgggaaccggaacgggtaccgttgtaaacgttttaaccgttttaagttaccgggttaactaaacgttaaccaaccgtaaccgtaacccgttaaccgttaacggttttacgggtttaacctttaacggttaccgttttaccgggttaacccggttaaccgttaccgggtaaacccggtaaacccgtaccggggttacccttaaccccggggttcccgttacggggtacccgtaaccccggttaccccgaaacccgggtacccccctaaacccccggaccgtttacccggttaaacccccg

SEQ ID NO: 129881 - DNA, 991 bp, Homo sapiens
  misc_feature: GYAE6OF01DV6D8.49.52.E08.1.454.CMB.1.raw
  modified_base (126)..(126): a, c, t, g, unknown or other
  misc_feature (126)..(126): n is a, c, g, or t
  modified_base (253)..(253): a, c, t, g, unknown or other
  misc_feature (253)..(253): n is a, c, g, or t
tcagagtcgagagacacgaccggtgctcgatttagtcgagctctctcggcggggggggtcacaagaggcagcgtctcgtcgggacgtctccaccatggcctgggctctgctgctcctcactctccncactcaggacacgagggtcctcgggcccagtctcgcccttgacctcacgcctcgccgttccgtgtcgtcgggtcctccgtcggacacgtcgactaccaccattccgtcctgccaacgtacgaaaccngtacaggttgagttggttagggttaatttaacctttaaccgttttcctaccgttacgtaaccaaaccaaccaccgacggaacctaaacgaccccctaaactcacgttacttagttacgtacggacggacctagtacgaccgggcccggtcccggtacgggtacggggttccttacgacgtacggttccgttccgttaccgttccgtccgggttacccgtacccggtaccgttccggttacggaccgtaccgggtaccccgtaacccggtccccgttacccgtacggtaaccctaaccgtttcccggtaccggtccggggtacccgttaccccgggtacgggggtacccggggtacgggggtacccggttacgggtaccgtttaaaggttaccgtttttaacggttttacggttccggtttaacgttttccggtttaaacgttaacggtttaccgggttaccggggttaacggggttaacggtttaacggggtttacccggggtttaccggggggtaacggggtttacgggggtttaacccggggttacccgggggggaaaccggggttaaaccgggggttaaaccgggttaacccgggggttaaccgggttacccccgggggtttaaccgggttaaaccgggtaaacccggacccgggttaccccccggggttaacccgggttacccccgggtttcccccgggttaacccccgggttaccccgggtttaaacccccgg

SEQ ID NO: 129882 - DNA, 747 bp, Homo sapiens
  misc_feature: GYAE6OF01CZAH9.49.52.E08.1.454.CMB.1.raw
  modified_base (119)..(119): a, c, t, g, unknown or other
  misc_feature (119)..(119): n is a, c, g, or t
  modified_base (136)..(136): a, c, t, g, unknown or other
  misc_feature (136)..(136): n is a, c, g, or t
  modified_base (190)..(190): a, c, t, g, unknown or other
  misc_feature (190)..(190): n is a, c, g, or t
  modified_base (193)..(193): a, c, t, g, unknown or other
  misc_feature (193)..(193): n is a, c, g, or t
  modified_base (198)..(198): a, c, t, g, unknown or other
  misc_feature (198)..(198): n is a, c, g, or t
  modified_base (202)..(202): a, c, t, g, unknown or other
  misc_feature (202)..(202): n is a, c, g, or t
  modified_base (207)..(207): a, c, t, g, unknown or other
  misc_feature (207)..(207): n is a, c, g, or t
  modified_base (213)..(213): a, c, t, g, unknown or other
  misc_feature (213)..(213): n is a, c, g, or t
  modified_base (217)..(217): a, c, t, g, unknown or other
  misc_feature (217)..(217): n is a, c, g, or t
  modified_base (219)..(219): a, c, t, g, unknown or other
  misc_feature (219)..(219): n is a, c, g, or t
  modified_base (223)..(223): a, c, t, g, unknown or other
  misc_feature (223)..(223): n is a, c, g, or t
  modified_base (343)..(343): a, c, t, g, unknown or other
  misc_feature (343)..(343): n is a, c, g, or t
tcagagtcgagagacacgaccggtgctcgatttagtcgagctctctcggcggggggggtcacaagaggcagcgctctcgggacgtctccaccatggcctgggctctgctgcctcctacnctctcctcatcaggacncgaggtcctgggccagtcgtcgcctgactcagcctgcctcgtgtcgtggtctcngangtgancacntctcngcacanacgntnagtntagtggttagtaattcttacctttcgccgtagtaaccaaccaccaccgaagaccgaaccaccctaactcgattctagttacgaggacgcacgccgacgtcccgtccgtagggtacgttcncgttagtcgttcctacttcgtcgtacgtccgttcgtacggtccgttaagccgggacctccgacccggttacctttcccggaaagtaccgtacgttccgttacggtaccggtccggtacgggtaccggtacgggtaacggcggttagtacgttagtttacgtttaagttcgttggttacttacgttaacgtaagttaccgggtcggttacggtaaggtttaccggtcggggttaacgggtacgggggttaccggttagggggtcccgggaaacgggtaacccggggtaggttaacccgggggttaaccctccccggggggtttaaacctacggggccgtaaacccggggttacccggtaccccgggaacccgtttcccgggtaccccggttccccggttaccccg

SEQ ID NO: 129883 - DNA, 821 bp, Homo sapiens
  misc_feature: GYAE6OF01AYHW9.49.52.E08.1.454.CMB.1.raw
tcagagtcgagagacacgaccggtgctcgatttagtcgagctctcagagagaaagggggtggtccaggaggcagaactctgggtgtctcaccatggcctggatccctctacttcctccccctcctcactctctgcacgagctctgacggcctcctatgagctgacacagcccacccgtcggtcgtcagtcgtaccccgaggacacggacggccaggactcaccgtgctcgtggagtatgctagtcgacctaaaccgtattacgtcggtacttttaaggtttacggaaccctacgacgaacgggaaccgggccccggaccccggtaccggtcccccgttggttagggtttacgggtagtagtttacggtaaaacgtaaaacgtacctacggtacggaacgggaccccggttacccgtaacggtaccggggtaaccttcccggttaggaccggttacgtaccgttttacccgttcggtccggtaccgtacccggtaacggtaccggaacggggtaacccgtaaacggtaccaacgttccgtacggactacgtaccggtaggtacggacgttacccggaaggacgtaacgggacgggaacggtcggtacgtaggtaacgtttacgttaagttccgtaaccgttaactaacgaacctaacgaaccttaccgtagtttacggtttacttaagtttccctaacggttacgtaacggtaccgtaccggtaaacccgtcgggtacccgttacggttccccgggtacggtaccccgaaccccgtaccccgggaaacctaccccccgtaaccccgtccgttacgtaccccg

SEQ ID NO: 129884 - DNA, 885 bp, Homo sapiens
  misc_feature: GYAE6OF01C951N.49.52.E08.1.454.CMB.1.raw
  modified_base (113)..(113): a, c, t, g, unknown or other
  misc_feature (113)..(113): n is a, c, g, or t
  modified_base (251)..(251): a, c, t, g, unknown or other
  misc_feature (251)..(251): n is a, c, g, or t
  modified_base (539)..(539): a, c, t, g, unknown or other
  misc_feature (539)..(539): n is a, c, g, or t
  modified_base (643)..(643): a, c, t, g, unknown or other
  misc_feature (643)..(643): n is a, c, g, or t
tcagagtcgagagacacgaccggtgctcgatttagtcgagctctctcggcggggggggtcacaagaggcagcgctcgtcgggacgtcctccaccatggccgtgggctctgctncctcctcactctcctcactcgaggacacgacgggtcctcgggcccaggttctcgtcccttagacctacacgtccctcgcccgtccgtgttacgtcgggtcctcgtaggacacggtcactaccaccgtactccgttccnggtaccaacttaacgaaaccgagtaccgtaggtagtaggttcggtaaggtaaaactttaacctttaaccgtttaccctccgttaaacggaaccaaaaacaacccgaaccgtaaacgaaacccgaaaacccttaaccccaaaactcaactttaacgtaatttaacgacggacgaccgactcgaccggtaccggtccgtaacggtggtaccttacgtagacttccggttacttcgtccgtggtaccctacggtacgtccgcgtacgacgcctaaccgtcccgtaccgtanaaccgttaacttccggtaccggtaccgtaccgtacggtacggtaggggtaacgggaccgttaacgtacggttatttaacggttttacgttaagtttacgggttntttacccgtaaaggttcgtaaccggttacgtaaccggggttagttaacccgggtaaggggttacccggggggtaagttaaccgggggggttgttaaccgggggaccgggttaaaacgggggaaaaccggttaaaccgggttaccgggtaccccgggttaaacgttaccccgggaaggtaacccccggtaacggtaacccggtaccccggttaccccggtacccgttccgggttaaacccccc

SEQ ID NO: 129885 - DNA, 710 bp, Homo sapiens
  misc_feature: GYAE6OF01C4R5G.49.52.E08.1.454.CMB.1.raw
  modified_base (163)..(163): a, c, t, g, unknown or other
  misc_feature (163)..(163): n is a, c, g, or t
  modified_base (178)..(178): a, c, t, g, unknown or other
  misc_feature (178)..(178): n is a, c, g, or t
  modified_base (233)..(233): a, c, t, g, unknown or other
  misc_feature (233)..(233): n is a, c, g, or t
  modified_base (365)..(365): a, c, t, g, unknown or other
  misc_feature (365)..(365): n is a, c, g, or t
  modified_base (425)..(425): a, c, t, g, unknown or other
  misc_feature (425)..(425): n is a, c, g, or t
  modified_base (453)..(453): a, c, t, g, unknown or other
  misc_feature (453)..(453): n is a, c, g, or t
  modified_base (491)..(491): a, c, t, g, unknown or other
  misc_feature (491)..(491): n is a, c, g, or t
  modified_base (519)..(519): a, c, t, g, unknown or other
  misc_feature (519)..(519): n is a, c, g, or t
  modified_base (540)..(540): a, c, t, g, unknown or other
  misc_feature (540)..(540): n is a, c, g, or t
  modified_base (567)..(567): a, c, t, g, unknown or other
  misc_feature (567)..(567): n is a, c, g, or t
  modified_base (624)..(624): a, c, t, g, unknown or other
  misc_feature (624)..(624): n is a, c, g, or t
tcagagtcgagagacacgaccggtgctcgatttagtcgagctctctcggcggggggggtcacaagaggcagcgctcgtacgggacgtctccaccatggcctggcgtctgctgccttcctcactcctcctcacgtacagacacgtacgggtcctaggccagtcncgccctagacctacnctccgtcgtccttccgtgtcgtcgggtcctctggacgtagtccgaactccaaccncttccgtaccgtctccgaaacacgaaaccgcgtaccgtaggtacgtagttgggttacggtaatttacctttacctttcgtccgtaacgtaaacccaacaaaccgaccgacgaaacccaacctacccctaaancctaaactagttattacgagaccgtacggactcgaccgccgccgtacgggtcggtctcgngtaccttcgtacttccgtacgccttccnccgttaggccgcgaacgccgccgtccgtccacgtaacnctaactcgtacggtcgtcgacgtccggnggtaacgggcgtagtacgttnaatttacgttgtaccttggtatacgtntaaccggttggccgtttagacggttcgggacgggttaggcggggtacccgttagggngtaaagggaccgggtaacggtccggtaacgtacggggttcacgaccgggacctaccggttacccaccccgggtccgtacggttccc

SEQ ID NO: 129886 - DNA, 698 bp, Homo sapiens
  misc_feature: GYAE6OF01CCYAW.49.52.E08.1.454.CMB.1.raw
  modified_base (197)..(197): a, c, t, g, unknown or other
  misc_feature (197)..(197): n is a, c, g, or t
  modified_base (313)..(313): a, c, t, g, unknown or other
  misc_feature (313)..(313): n is a, c, g, or t
  modified_base (322)..(322): a, c, t, g, unknown or other
  misc_feature (322)..(322): n is a, c, g, or t
  modified_base (330)..(330): a, c, t, g, unknown or other
  misc_feature (330)..(330): n is a, c, g, or t
  modified_base (341)..(341): a, c, t, g, unknown or other
  misc_feature (341)..(341): n is a, c, g, or t
  modified_base (458)..(458): a, c, t, g, unknown or other
  misc_feature (458)..(458): n is a, c, g, or t
tcagagtcgagagacacgaccggtgctcgatttagtcgagctctctcggcggggggggccacaagaggcagcgctctcgggacgtctccaccatggcctgggctctgctgctcctcactctcctcactcaggacacagggtcctgggcccagtctgccctgactcagcctgcctccgtgtcgtgggtctcctggacngtcgtatccaccatcctcctgcactacgaaaccagacagtgtagttggttaggtaatttacttaaccttttctaccgtacgtaaccaacaaccaccgagaccaaccaccccaaacncatctattncgacgcancacgccgtccnggtaggtctcgtgactcgtcttctcgtcggcctaccgtcgtacgtcggacacgtccgtacccggtccctaccgtacgtaacctacgtccggttccggtaccggtacccgttaccggnggggtaccgggtaggggggtaacctacggggtaccgtttaagttaaccgttttaatttcgtttaacggttctttaccggttacgttacggtaccggttgggtaccgggttgttaacgggttacgggtaccggggtacggggttaaggggttccggtacggggacgggtaacggtacgggtaaggtccggtacccgtgtacggacctacggccgacggtccctccggtccccgtcctaccg

SEQ ID NO: 129887 - DNA, 686 bp, Homo sapiens
  misc_feature: GYAE6OF01BIEXK.49.52.E08.1.454.CMB.1.raw
  modified_base (306)..(306): a, c, t, g, unknown or other
  misc_feature (306)..(306): n is a, c, g, or t
  modified_base (490)..(490): a, c, t, g, unknown or other
  misc_feature (490)..(490): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacagggtcctgggcccagtctgccctgactcagcctgcctccgtgtctgggtctctggacagtcgatcaccatctcctgcactgaaaccagcagtgattggttaggaattataaccttttctcctgtaccaacaacacccaggacaaacgcccccaaactcaatcatttacngaggccgatcgacgccggccctacgtaggggtctctgactcgcttctcgtcgctcctacgtcgtggccagcacccgggtccctcccgtacgacctaactcgtccgtagggcctacccgacgggtcggtacggggacggtaagggtcttacggtatttatttacgttcggttcttagtttacgtnttaagttcgggtacccggggttagtaacggttaggtcggggtaccgggtaacggggggttcggttaccggggtacgggtaccgggggtaacccggtaacgggttacggtaccccggttacccgggtaggtacccggaacggtaccccggtaacggggccccgttaccgggtcccccccgttaagggttaacccccg

SEQ ID NO: 129888 - DNA, 718 bp, Homo sapiens
  misc_feature: GYAE6OF01D4BZQ.49.52.E08.1.454.CMB.1.raw
  modified_base (219)..(219): a, c, t, g, unknown or other
  misc_feature (219)..(219): n is a, c, g, or t
  modified_base (229)..(229): a, c, t, g, unknown or other
  misc_feature (229)..(229): n is a, c, g, or t
  modified_base (233)..(233): a, c, t, g, unknown or other
  misc_feature (233)..(233): n is a, c, g, or t
  modified_base (239)..(239): a, c, t, g, unknown or other
  misc_feature (239)..(239): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacgagggtcctgggcccagtctcgccctgactcagccttcgcccgttcgttgttcgtcgggtcctccgtggacagtcatccactntcctctgacnctanaaaccngctagtgacgttggtagtaatttacttacctttcctcgtacgtaaccaacctacaccgagaccaaaccgaccccctaatcatacttacttagacggaggacctactcgacggtaccgtccctaggtcggtctcgcgtacgtcctctttcgtcgtaccgtcctaccggtacgttcgacggtccgacgccctacccggtcccttaccgtacgtacctaccgtttcgtaccggtcggtcccgttaccggagggttaccgggacggggaccgtaccgtggtttaacttcgttttagtttcgtacgttgttaccttagttcgttacggttcgggtaccggttaggtagggtacggttaaccggggcggttaaggggttccgggtaacggggacgggtaaaggacgggttaaccgggtaccgtcccggtaacggcgtaccggcccgtaaacggtccgtacccgtccccgtccggttcgtaccccg

SEQ ID NO: 129889 - DNA, 843 bp, Homo sapiens
  misc_feature: GYAE6OF01EBWPD.49.52.E08.1.454.CMB.1.raw
  modified_base (252)..(252): a, c, t, g, unknown or other
  misc_feature (252)..(252): n is a, c, g, or t
tcagagtcgagagacacgaccggtgctcgatttagtcgagctctctcggcgggggggggtcacaagaggcagcgctctcgggacgtctccaccatggcctgggctctgctgcctcctcactctcctcactcgaggacacgagggtcctcgggcccagtctcgccctgactcacgcctcgcccttccggtgttcgtcgggtctccgtggaccagtcactccacctactcctcctgacctacgtacgaaaaccngacgaggtcgtagtttacgggttaaggttaaacttttaacttttaaccctttttccgtacccgttaaccggtaaacccaaaacccaaacccaacccggaagggaaccccaaaaccccgtacccccctaaacttctaacgttacctttaagttttacgacgggtaccgggtaccgtaactcccggtaaccggccccgggtccccgttacggggtaaccggggttccttcggtacgtacgttccgttaccgtttcgttacggtccgtacccttacccggtacggttccgtacgggtcacggtccgtacggttcccggtacccgttaccgtataacccttacgttccggtacgtcggggtaccctacgggacgggtccgggaggggaaccgtgttcgttaagtttatttacgtttcgttcggtccgtttagttaccgtacgttacggtcggggttacgtaggttacggtacgggtacgggagggttacggggtcggttacgggggacgggtaaacggtacggttacggtaccggtcccggtacggtacggtcccgaccgtacccggacggttcccccgtccgtccccggtacgg

SEQ ID NO: 129890 - DNA, 167 bp, Homo sapiens
  misc_feature: GYAE6OF02INZ5L.49.52.E08.1.454.CMB.1.raw
  modified_base (162)..(167): a, c, t, g, unknown or other
  misc_feature (162)..(167): n is a, c, g, or t
tcagagtcgagagacacgaccggtgctcgatttagtcgagctctctcggcggcacgaccggtgctcgatttagtcacgcgagaaaggaaggggctggccctgacgtgtttctgttcccgccctcctctctctcgactctgagcggctggcaaggcgcatagnnnnnn

SEQ ID NO: 129891 - DNA, 164 bp, Homo sapiens
  misc_feature: GYAE6OF02GZ02M.49.52.E08.1.454.CMB.1.raw
  modified_base (163)..(164): a, c, t, g, unknown or other
  misc_feature (163)..(164): n is a, c, g, or t
tcagagtcgagagacacgaccggtgctcgatttagtcgagctctctctcgcggcacgaccggtgctcgatttagtcacgcgagaaagggaagggctggccctgacgtgttctgttcccgccctcctctctctcgactctgagcgggctggcaaggcgcatagnn

SEQ ID NO: 129892 - DNA, 497 bp, Homo sapiens
  misc_feature: GYAE6OF02H2HZH.49.52.E08.1.454.CMB.1.raw
  modified_base (314)..(314): a, c, t, g, unknown or other
  misc_feature (314)..(314): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtcccaggacagacggccaggatcacctgctctggagatgcattgccaaaaccgatatgcttattggtaccagcagaagccgggccaggcccctgtgttggtgatgtataaagacactgagaggccctnagggatccctgagcgattctctggctcaggtcagggacaacggtcacattggccatcagtggagtccaggcagaggacgaggctgactattattgtcaatcaaacagacaccattggtacttatgtcttcgaactgcgaccaaggtcaccgtctggcaggcccaaggcccaaccccactgtcc

SEQ ID NO: 129893 - DNA, 168 bp, Homo sapiens
  misc_feature: GYAE6OF02GZ4RN.49.52.E08.1.454.CMB.1.raw
  modified_base (167)..(168): a, c, t, g, unknown or other
  misc_feature (167)..(168): n is a, c, g, or t
tcagagtcgagagacacgaccggtgctcgatttagtcgagctctctctcgcgggcacgaccggtgctcgatttagtcacgcgagaaagggaaaggggctggccctgacgtgtttctgttcccactctcctctctctcgactctgagcgggctggcaaggcgcatagnn

SEQ ID NO: 129894 - DNA, 326 bp, Homo sapiens
  misc_feature: GYAE6OF02GB27E.49.52.E08.1.454.CMB.1.raw
  modified_base (308)..(326): a, c, t, g, unknown or other
  misc_feature (308)..(326): n is a, c, g, or t
tcagagtcgagagacacgaccggtgctcgatttagtcgagctctcttcggcgggcacgaccggtgctcgactttaggacagtatatatccggcgggcacgaccggtcgcgtcgactttagacagtagtatattccgtcgggcacgaccggtgcgtcgacgttagcgtagtacgtgcgttgggtttcgggggaagtaggaagacctgacggtcccccaggagttcaggtgctgggcacagcggccctgggctgcctggtcaaggactacttcctctctccgactctgagcggctggcaaggcgcatagnnnnnnnnnnnnnnnnnnn

SEQ ID NO: 129895 - DNA, 231 bp, Homo sapiens
  misc_feature: GYAE6OF02HW0J1.49.52.E08.1.454.CMB.1.raw
  modified_base (212)..(231): a, c, t, g, unknown or other
  misc_feature (212)..(231): n is a, c, g, or t
tcagagtcgagagacacgaccggtgctcgatttagtcgagctctctcggcgggcacgaccggtgctcgatttagagagagtgtgttgggtttggggaagacggaagactgacggtcccccaggagttcaggtgctgggcacagcggccctgggctgcctggtcaaggactacttcctctctcgactctgagcgggctggcaaggcgcatagnnnnnnnnnnnnnnnnnnnn

SEQ ID NO: 129896 - DNA, 166 bp, Homo sapiens
  misc_feature: GYAE6OF02HP8XN.49.52.E08.1.454.CMB.1.raw
  modified_base (165)..(166): a, c, t, g, unknown or other
  misc_feature (165)..(166): n is a, c, g, or t
tcagagtcgagagacacgaccggtgctcgatttagtcgagctctctcggcgggcacgaccggtgctcgatttagtcacgcgagaaagggaaaggggctggccctgacgtgtttctgttccaccctcctctctctcgactctgagcgggctggcaaggcgcatagnn

SEQ ID NO: 129897 - DNA, 143 bp, Homo sapiens
  misc_feature: GYAE6OF02GO2KJ.49.52.E08.1.454.CMB.1.raw
  modified_base (133)..(143): a, c, t, g, unknown or other
  misc_feature (133)..(143): n is a, c, g, or t
tcagagtcgagagacacgaccggtgctcgatttagtcgagctctccgcgagaaagggaaggggctggccctgacgtgtttctgttcccaccctcctctctctcgactctgagcgggctggcaaggcgcatagnnnnnnnnnnn

SEQ ID NO: 129898 - DNA, 167 bp, Homo sapiens
  misc_feature: GYAE6OF02F2XBI.49.52.E08.1.454.CMB.1.raw
  modified_base (166)..(167): a, c, t, g, unknown or other
  misc_feature (166)..(167): n is a, c, g, or t
tcagagtcgagagacacgaccggtgctcgatttagtcgagctctctcggcgggcacgaccggtgctcgatttagtcacgcgagaaagggaaaggggctggccctgacgtgtttctgttcccaccctcctctctctcgactctgagcgggctggcaaggcgcatagnn

SEQ ID NO: 129899 - DNA, 203 bp, Homo sapiens
  misc_feature: GYAE6OF02IE330.49.52.E08.1.454.CMB.1.raw
  modified_base (199)..(203): a, c, t, g, unknown or other
  misc_feature (199)..(203): n is a, c, g, or t
tcagagtcgagagacacgaccggtgctcgatttagtcgagctctctcggcgggcacgaccggtgctcgatttagctctacgctcagggcacgaccggtgctcgatttagtcacgcgagaaagggaaggggctggccctgacgtgtttctgttcccaccctcctctcttcgactctgagcgggctggcaaggcgcatagnnnnn

SEQ ID NO: 129900 - DNA, 498 bp, Homo sapiens
  misc_feature: GYAE6OF02GRHJY.49.52.E08.1.454.CMB.1.raw
  modified_base (313)..(313): a, c, t, g, unknown or other
  misc_feature (313)..(313): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgtggtgatgtataaagacactgagaggccctnagggatccctgagcgattctctggctcaggtcagggacaacggtcacattggccatcagtggagtccaggcagaggacgaggctgacttattattgtcaatcaacagacaccattggtacttatgttcttcggaactgcgaccgaaggtcaccgtctggtcagcccaggcccaacccatcgtacc

SEQ ID NO: 129901 - DNA, 492 bp, Homo sapiens
  misc_feature: GYAE6OF02FUWV9.49.52.E08.1.454.CMB.1.raw
  modified_base (487)..(487): a, c, t, g, unknown or other
  misc_feature (487)..(487): n is a, c, g, or t
tcagagtcgagagacacgaccggtgctcgatttagtcgagctctcagagagaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcgactgcgacaaggtcaccgtctggtcagcccaaggcccaacccntgtcc

SEQ ID NO: 129902 - DNA, 498 bp, Homo sapiens
  misc_feature: GYAE6OF02GIELY.49.52.E08.1.454.CMB.1.raw
  modified_base (421)..(421): a, c, t, g, unknown or other
  misc_feature (421)..(421): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaaanagacacctattggtacttatgtcttcggactgcgacaaggtcaccgtctggtcagcccaaggcccaacccactgtcc

SEQ ID NO: 129903 - DNA, 500 bp, Homo sapiens
  misc_feature: GYAE6OF02GXTRR.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcacgcccaaggcccaacccactgtacc

SEQ ID NO: 129904 - DNA, 652 bp, Homo sapiens
  misc_feature: GYAE6OF02HY4EN.49.52.E08.1.454.CMB.1.raw
  modified_base (235)..(235): a, c, t, g, unknown or other
  misc_feature (235)..(235): n is a, c, g, or t
  modified_base (264)..(264): a, c, t, g, unknown or other
  misc_feature (264)..(264): n is a, c, g, or t
  modified_base (313)..(313): a, c, t, g, unknown or other
  misc_feature (313)..(313): n is a, c, g, or t
tcagagtcgagagacacgaccggtgctcgatttagtcgagctctctcgggcgggggggtcacgaaggaggcagcgctcgtcgggacgtctccaccatggccgtgggctctgcttgctcctcactctcctcgactcagggacacgacgggtcctgggcccagtctgccctgactcagcctgcctccggtgtctgggtctcgtggacagtcgatcaccatctcctgcactgaaaccngcagtgatgttaggaattataaccttttntcctaggtaccaacaacaccaggacaaacgccccaaactcatcatttangagcgatcacgcggcctgagggtctctgatcgcttctcgtcggctccgacgtctcggcagccacggctccctgactacgtcgtcgtgggctcgaggcgtaggggacgtaggtcttggtaactttagtttagttcgtcttcgttacgagttaagtcgggtaccgggttgtaaggtttacgggttcggggaccggttaaaggggggtttcggttaccggggacggggtaacggggtaaccggtaaaggggttccggtaacccggttacccggtaagggtacccgtaccggaccccggtaaaccgggcccgttacccggtcccccccggttaggttaccccg

SEQ ID NO: 129905 - DNA, 236 bp, Homo sapiens
  misc_feature: GYAE6OF02FNSNN.49.52.E08.1.454.CMB.1.raw
  modified_base (215)..(236): a, c, t, g, unknown or other
  misc_feature (215)..(236): n is a, c, g, or t
tcagagtcgagagacacgaccggtgctcgatttagtcgagctctctcggtcggggcacgaccggtgctcgatttagagagagtgtgttgggtttgggggaagaggaagactgacggtcccccaggagttcaggtgctgggcacagcggccctgggctgcctggtcaaggactacttcctctctcgactctgagcgggcttggcaaggcgcatagnnnnnnnnnnnnnnnnnnnnnn

SEQ ID NO: 129906 - DNA, 502 bp, Homo sapiens
  misc_feature: GYAE6OF02GD2GW.49.52.E08.1.454.CMB.1.raw
  modified_base (240)..(240): a, c, t, g, unknown or other
  misc_feature (240)..(240): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggccaggcccctgtgttggtgatgtataaagacactgagaggccctcagggatccctgagcgattctctggctcaggtcagggacaacggtcacattggccatcagtggagtccaggcagaggacgaggctgacttattactgtcagtcatcagacagtagtggctacgttcgtgttcgtagttcgggcggagggaccaaggctgaccgtccgtaggtccagcccaggctcccgg

SEQ ID NO: 129907 - DNA, 168 bp, Homo sapiens
  misc_feature: GYAE6OF02G6BXO.49.52.E08.1.454.CMB.1.raw
  modified_base (167)..(168): a, c, t, g, unknown or other
  misc_feature (167)..(168): n is a, c, g, or t
tcagagtcgagagacacgaccggtgctcgatttagtcgagctctctctcgcgggcacgaccggtgctcgatttagtcacgcgagaaagggaaaggggctggccctgacgtgtttctgttcccaccctcctctctctcgactctgagcgggctggcaaggcgcatagnn

SEQ ID NO: 129908 - DNA, 512 bp, Homo sapiens
  misc_feature: GYAE6OF02J0NZ1.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggcaggcccctgtgttggtgatgtataaagacactgagaggccctcgagggatccctgagcgattctctggctcgaggtcagggacaacggtcacattggccatcagtgagtccaggcagagacgaggctgactattatgtcaatcaactagacaaccgatttacggtaacttatgtacgttacgaactgacgtacctaaggtccaccgtccgtggtcacggcccaaggcccaacccgtctgtacc

SEQ ID NO: 129909 - DNA, 516 bp, Homo sapiens
  misc_feature: GYAE6OF02GQ1TV.49.52.E08.1.454.CMB.1.raw
  modified_base (240)..(240): a, c, t, g, unknown or other
  misc_feature (240)..(240): n is a, c, g, or t
  modified_base (314)..(314): a, c, t, g, unknown or other
  misc_feature (314)..(314): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggccaggcccctgtgttggtgatgtataaagacactgagaggccctnagggatccctgagcgattctctggctcaggtcagggacaacggtcacattggccatcagtggacgtccaggcagaggacgaggctgactattatgtcaatcaacagacacctagttgtacttatgttacttcggacttgacgaccgtaaggtccaaccgtccgtgggtcacgcccgaaggacccaaccccgtatcgtacccg

SEQ ID NO: 129910 - DNA, 532 bp, Homo sapiens
  misc_feature: GYAE6OF02IW9PJ.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggactccctgagcgattctctggctccaggtcagggacaacggtcacattggccatcagtggagtccaggcagaggacgaggctaggactattattgtcaatacaactagacaccattacggtacttatgtcttacggtaactggacgaccgtaacggtccaaccggtccttcgggtaccacggtccccaacggccccaacccctaccgtgtaccc

SEQ ID NO: 129911 - DNA, 765 bp, Homo sapiens
  misc_feature: GYAE6OF02GHUKX.49.52.E08.1.454.CMB.1.raw
  modified_base (136)..(136): a, c, t, g, unknown or other
  misc_feature (136)..(136): n is a, c, g, or t
  modified_base (344)..(344): a, c, t, g, unknown or other
  misc_feature (344)..(344): n is a, c, g, or t
  modified_base (356)..(356): a, c, t, g, unknown or other
  misc_feature (356)..(356): n is a, c, g, or t
tcagagtcgagagacacgaccggtgctcgatttagtcgagctctcggagagagaaaggggggtgggtccaggaggcagaactctgggtgtctcaccatggcccgatcctcctacttctcccctccctcactctctncacagcgtctcgaggcctcctactgcgctcgacacacgccacccctccggtggtcagtgtcccacggacacgacggccacggaatcacctcgctcctggaggaatgcattgccgaaaccgaatataggtcttatttcggtaccgaagcaacgaaacggccccgggggtcccaacggtccccccgtgttggttgggttggattagttanaaaacggtaacnccttagaggaccggtccctcgaggggactccctcggagtccgtatttcttccgagggtcctcccgtaagggtacgaacggggaaccggtaaccgttccgtacaatttcggggcctaaactcgtacggtagggacggtccgaacgggacgaccggtaaggggaccggtaacgggtcgttacggtaacgttatttaacgttcggttcaaacttataaaccgaacgtaacgaccctaaagtttagggtttacctttaaagtttacggttcggttaccgggtaaaccgttagtaccgggtaaaccctaacggggtacccgttaaccccggttccggtacggggttacccgtaccggaaccccggtaaccggtacccccggtaaaccccccctacgttaccggtccctaacccc

SEQ ID NO: 129912 - DNA, 561 bp, Homo sapiens
  misc_feature: GYAE6OF02IQLY2.49.52.E08.1.454.CMB.1.raw
  modified_base (430)..(430): a, c, t, g, unknown or other
  misc_feature (430)..(430): n is a, c, g, or t
  modified_base (455)..(455): a, c, t, g, unknown or other
  misc_feature (455)..(455): n is a, c, g, or t
tcagagtcgagagacacgaccggtgctcgatttagtcgagctctcaggagagaaagggggtgggtcccaggaggcagaacctctgggtgtctcaccatggcctggatccctctacttctccccctcctcactctctgcacaggctctgaggccctcctatggagctgacacagccaccctcgggtgtcagttgtaccccaggaccaggaccggccaaggatcgtaccctgcctcgtggagagtgccatttcgacccaaaccgatatgtcttattggtaccagcagaagcccggccaggcccctgtgttggtgatggtataaaggacactgagaggccctagacgggatcccgtgacgcgattctacgtggcttcgaggtcagggacaacggtcactattcggccatcaggtgatccaggcaggaggacgnggctgactattattgacaatcaacngaccactattcggtactttagcgttacttacggactagccggtaaccaaggttccacggttccctagggtccacggacccgaggacccaacccgtacgtcgtaccg

SEQ ID NO: 129913 - DNA, 178 bp, Homo sapiens
  misc_feature: GYAE6OF02F5FOC.49.52.E08.1.454.CMB.1.raw
  modified_base (116)..(116): a, c, t, g, unknown or other
  misc_feature (116)..(116): n is a, c, g, or t
  modified_base (167)..(178): a, c, t, g, unknown or other
  misc_feature (167)..(178): n is a, c, g, or t
tcagagtcgagagacacgaccggtgctcgatttagtcgagctctctcggcgggcacgaccggtgctcgatttagtcacgcgagaaagggaaagggggctggccctgacgtgtttcngttcccgccctcctctctctcgactctgagcgggctggcaaggcgcatagnnnnnnnnnnnn

SEQ ID NO: 129914 - DNA, 520 bp, Homo sapiens
  misc_feature: GYAE6OF02H1BBW.49.52.E08.1.454.CMB.1.raw
  modified_base (511)..(511): a, c, t, g, unknown or other
  misc_feature (511)..(511): n is a, c, g, or t
tcagagtcgagagacacgaccggtgctcgatttagtcgagctctcagagagaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcgagggatcccgtgagcgattctctggctcaggtcagggacaacggtcacattggccatcagtggagtccaggcagaggacgagctagactagtttatgtacaatcaacagacacctaattggtaacttatgtcgttacgactgaccgtaccgaaggtccaccggtccgtgggtccacgcccgaacggccccaaccccncgtgtaccc

SEQ ID NO: 129915 - DNA, 530 bp, Homo sapiens
  misc_feature: GYAE6OF02FXDS5.49.52.E08.1.454.CMB.1.raw
  modified_base (240)..(240): a, c, t, g, unknown or other
  misc_feature (240)..(240): n is a, c, g, or t
  modified_base (422)..(422): a, c, t, g, unknown or other
  misc_feature (422)..(422): n is a, c, g, or t
tcagagtcgagagacacgaccggtgctcgatttagtcgagctctcagagagaaagggggtgggtccaggaggcagaactctgggtgtctcaccatggcctggatccctctacttctacccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggccaggcccctgtgttggtgatgtataaagacactgagaggccctcgagggactccctgagcgattctctggctccaggtcagggacaacggtcacattggccatcagtggagtccaggcagaggacgaggctgactattattgtcaatcaaanagacacctattggtagtcttatgttcttacggactggaccgtaaccgaaggtccacccggttccgtggggtccacggtaccccgaacggccccaaccccgactaccgg

SEQ ID NO: 129916 - DNA, 592 bp, Homo sapiens
  misc_feature: GYAE6OF02GH2UY.49.52.E08.1.454.CMB.1.raw
  modified_base (369)..(369): a, c, t, g, unknown or other
  misc_feature (369)..(369): n is a, c, g, or t
  modified_base (399)..(399): a, c, t, g, unknown or other
  misc_feature (399)..(399): n is a, c, g, or t
  modified_base (443)..(443): a, c, t, g, unknown or other
  misc_feature (443)..(443): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgtggaattataacctttctctgtaccaacaacaccaggcaaagcccccaaactcatcatttatgaggccgatcagccggccctcgaggggtctctgactcgcttctctggctccacgtctggcagcacggcctccngacatctcgtggctcgaggcgtggggacgnggctgatttattagttgcttgttacattacgttcggtccggttntaagttggtcgggacggttaaagggggttcgttaccggggacgggaacggggtaacgaaaggggttccggaacccgggtttacccgtaaggggttacccaacggtaccccggaaagggtcccttaccggcccccccggtttggtacccg

SEQ ID NO: 129917 - DNA, 797 bp, Homo sapiens
  misc_feature: GYAE6OF02IJ6D0.49.52.E08.1.454.CMB.1.raw
  modified_base (248)..(248): a, c, t, g, unknown or other
  misc_feature (248)..(248): n is a, c, g, or t
  modified_base (274)..(274): a, c, t, g, unknown or other
  misc_feature (274)..(274): n is a, c, g, or t
tcagagtcgagagacacgaccggtgctcgatttagtcgagctctcgtcgcgggggggggtcacgaagacggcagcggcttcctacgggacgttctccaccatggcctgggctctgctgctcctcactcctcctcgacttcgaggacacagggtcctgggtcccagtctgccctagtactcagcctgcctccggtgtctgggtctccgtggacaggtcggatcaccatccggtcctgccactgaaaccngcagtgatgtggaattataactttcnctgtaccaacaacacccaggacaaacgcccccaaaacgtcgactacgagtttagtggaacggtacctaactacgaggccggtcccgtacggaacggggtctcgtacgtaacgttccggtaccttccgtacgtacggtaccgtcccgaacggttccgttcgggacctaacggtccctaacccgggtacccgttacccgttacggaaacctaaactttacccgtaaaccgtcggggtacccttaccgaagggtccgttacggggggaaccgtaacgggtaaccgttaggttaaaactttaacgtttacgttacggtacgtttaccggttaactaaacgttacggttaccgggtacccggggttagtaaacgtttacggggttcccggggaaaccggttaaggggtttaccgtttacccgggggacgggtaaaccgggtacccggtaaagggtacccgtaaccggttaccgttaacggtacgaccggtacccgaaggtcccgtaccgggtcccccgtaggtacccg

SEQ ID NO: 129918 - DNA, 440 bp, Homo sapiens
  misc_feature: GYAE6OF02GSAZK.49.52.E08.1.454.CMB.1.raw
  modified_base (257)..(257): a, c, t, g, unknown or other
  misc_feature (257)..(257): n is a, c, g, or t
  modified_base (405)..(440): a, c, t, g, unknown or other
  misc_feature (405)..(440): n is a, c, g, or t
tcagagtcgagagacacgaccggtgctcgatttagtcgagctctctcggcgggcacgaccggtgctcgatttagtcgagctctctcggcgggcacgaccggtgctcgatttagtcgagctctcgtcggcgggcacggaccggtgctcgatttagctctacgctcgagggcacgaccggtgctcgagtttacgctctacgctcgaggggcacgaccggtgctcgatttacgctctacgctcgaggggcacgaccggtnctcgattacgcacacggatagttgggttcgggggaacgaggaagacgtgacggtcccccgaggagttcgaggtgctgggcacagcggcctgggctgcctggtcaaggctactctctctcgactctgagcggctggcaaggcgcatagnnnnnnnnnnnnnnnnnnnnnnnnnnnnnnnnnnnn

SEQ ID NO: 129919 - DNA, 499 bp, Homo sapiens
  misc_feature: GYAE6OF02F2616.49.52.E08.1.454.CMB.1.raw
  modified_base (493)..(493): a, c, t, g, unknown or other
  misc_feature (493)..(493): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggccccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcgaactgcgaccaaggtcaccgtcctgggtcagcccaaggccaaccccntgtacc

SEQ ID NO: 129920 - DNA, 553 bp, Homo sapiens
  misc_feature: GYAE6OF02IVAP7.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagcccgggccaggcccctgtgttggtgatgtataaagacactgagacggccctgagggactcccgtgagcgtattctcgtggctccaggtcagggacaacggtcactagttcggccagtcagtggagtcaggcaggaggacgaggctgacttattattgtacaatcaacacgacactagttaggttaaccttagtcgtacttacggtaacctgaccgtaacccgaggtacccaccggttccgtacggggtacaaccggcccaacggaccccaacccctacgtccgtacccg

SEQ ID NO: 129921 - DNA, 501 bp, Homo sapiens
  misc_feature: GYAE6OF02HQNCE.49.52.E08.1.454.CMB.1.raw
  modified_base (434)..(434): a, c, t, g, unknown or other
  misc_feature (434)..(434): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaaagcaatatgcttactggtaccagcagaagccaggccaggcccctgtcttgatcatttataaagacttttgagagggcctcgagggacccctgagcgattctctggctcagctcagcgacaacagtcacgttgacccatcagtggagtccgggcaggaggacgaaggctgactattactgtcagtcatcagacagtagnggctacttctgtcgtagttcggcggtagggaccaaggctggacccgtcgtaggtcacggcccaacgg

SEQ ID NO: 129922 - DNA, 761 bp, Homo sapiens
  misc_feature: GYAE6OF02GMUWE.49.52.E08.1.454.CMB.1.raw
  modified_base (248)..(248): a, c, t, g, unknown or other
  misc_feature (248)..(248): n is a, c, g, or t
tcagagtcgagagacacgaccggtgctcgatttagtcgagctctcaggagagaaagggggtgggtccaggaggcagaactctgggtgttctcaccatggcctggatccctctacttctccccctcctcactctctgcacaggctctgaggccttcctatgagcttgacacagccaccctcggtgtcagtgtccccaggacagacgggccaggatcacctgcgtcctggagatgcattgaccaaaccgntatgcttattggtaccagctagaagccggaccaggcccctgtgttggtgagtagtactaaagactacgtgagacggccctacgagggactcccgtggaacgtcgaacttacctcttacggtctccggaaagggttccaacgggggtaaccaaaccgggggttccaaaccgtacgtttcgggaaccctagttaccgaagttacgggaacgttacccgagggaccgaaggaacgggaccggtaaggttctaaggaacgtttaacgttagtttacgtacgtaaacttacgaaaacgacggtaacccgaaccgtaagttttacgggttaaccttttaacgttacggtttaaccgtttaaccgggtaaccgtttagggacccggtaaacccggtaaaacggggttaccccgtaaaccccgggtttcccgtttaacggggggttacctaaccgggtaacccccgttaaaaccggggtacccccctaaaacccccggttaccggttcggttaacccccgg

SEQ ID NO: 129923 - DNA, 546 bp, Homo sapiens
  misc_feature: GYAE6OF02HA9KV.49.52.E08.1.454.CMB.1.raw
  modified_base (241)..(241): a, c, t, g, unknown or other
  misc_feature (241)..(241): n is a, c, g, or t
  modified_base (287)..(287): a, c, t, g, unknown or other
  misc_feature (287)..(287): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgntatgcttattggtaccagcagaagccggccaggcccctgtgttggngatgtataaagacactgagaggccctcgagggatccctgagcgtattctctggctccaggtcagggacaacggtcacattcggccatcagtggagtccaggcagaggacgaggctgacttatattgtacaatcaacagacacctagttcggtacttagtcgtcttacggaactgacgtaaccgaacggtccaaccggttccgtacgggttaccacggtaccccgaaacggtccccaaacccccgtacttaccgtacccg

SEQ ID NO: 129924 - DNA, 493 bp, Homo sapiens
  misc_feature: GYAE6OF02GQEXC.49.52.E08.1.454.CMB.1.raw
  modified_base (309)..(309): a, c, t, g, unknown or other
  misc_feature (309)..(309): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttatgtacagcagaagcggccaggcccctgtgtggtgatgtataaagacactgagacggccctnagggatccctgagcgattctctgctcaggtcagggacaacggtcactatggcatcagtggacgtcaggcaggaggacgaggctgactattattgtcaatcaacagaccactattgtacttatgttctcgaactgacgaccaaggtcaccgtctgggtcacggccaaggcccacccgtatgtacc

SEQ ID NO: 129925 - DNA, 167 bp, Homo sapiens
  misc_feature: GYAE6OF02GDB6V.49.52.E08.1.454.CMB.1.raw
  modified_base (167)..(167): a, c, t, g, unknown or other
  misc_feature (167)..(167): n is a, c, g, or t
tcagagtcgagagacacgaccggtgctcgatttagtcgagctctctctcgcgggcacgaccggtgctcgatttagtcacgcgagaaagggaaaggggctggccctgacgtgtttctgttcccaccctcctctctctcgactctgagcgggctggcaaggcgcatagn

SEQ ID NO: 129926 - DNA, 616 bp, Homo sapiens
  misc_feature: GYAE6OF02JNK3T.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttatggtaccagcagaacgccgggccaggccctgtgttggtgatgtataaagcactgagacggccctcgagggactcccgtgagcgtattctcgtggcctcgaggtcgaggaccaacggtcactagttgccatcaggtggacgtccgaggcgaaggaggaccgaggctagacttacgttagttgtactaactcgaaacacgaacctaacctagtttacggttaaccttagttacgtaccgtttacggtaaccgttcggaccgtaacccggtaacgggttacccgtaacccgggttcccgtacggggttaccaacccgggtaccccgaacccgggtacccctaaaccccccgtaccgttccgttaacccccg

SEQ ID NO: 129927 - DNA, 558 bp, Homo sapiens
  misc_feature: GYAE6OF02FXD8V.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgatatgcttattggtaccagcagaagccgggccaggcccctgtgttggtgatgtataaagacactgagacggccctcgagggactcccgtgacgcgattctctggctccgaggtcagggacaacggtcacgattcggccatcagtggagtccgaggcaggaggacgaggctagacttagttagttgtactaatcaacagacctacctagtttacggtaacttagtacgttacgttacggaacttcggaccgaaccgtaacggtcctaccgtcccgtagggtaccacggaccccgaaggaccccaaccccgtactcgtaccc

SEQ ID NO: 129928 - DNA, 642 bp, Homo sapiens
  misc_feature: GYAE6OF02HYBFC.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtcgtcccaggacagacggccaggatcacctgctctggagatgcattgaccaaaccgatatgcttattggtacagcagaagccgggccaggccctgtgttggtgatgtataaagacactgagaggccctacgagggactcccgtgagcgtattctcgtggctccgaggtcgagggacaacggtcacattcggccatcgagtggagtccgaggcaggaggacgaggcgtcgacttatttagttgtacaactacaaacgtaagaacctaaccgtaagttttacgggttaactttacgttaggttaccgtttaccgggtaaaccttacgggaccggtaaacccgtaaacgggttacccgtaaccccgggtttccccggttacgggggttaccctaacccgggtacccccgtaaaacccggggacccccctaaaacccccggtaccgttaccgggttaacccc

SEQ ID NO: 129929 - DNA, 535 bp, Homo sapiens
  misc_feature: GYAE6OF02I5S8L.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcgagggatcccgtgacgcgtattctctggctccaggtcagggaccaacggtcactattggccatcagtggagtcaggcaggaggacgaggctagactattagttgtacaatcaacagacacctattagtaccttaagtcgttacgttcgactgacgaccgaaggtccaaccggtccgtacgggtcacgacccgaacggacccaaccccgtacgtccgtaccg

SEQ ID NO: 129930 - DNA, 542 bp, Homo sapiens
  misc_feature: GYAE6OF02I4MDO.49.52.E08.1.454.CMB.1.raw
  modified_base (285)..(285): a, c, t, g, unknown or other
  misc_feature (285)..(285): n is a, c, g, or t
  modified_base (536)..(536): a, c, t, g, unknown or other
  misc_feature (536)..(536): n is a, c, g, or t
tcagagtcgagagacacgaccggtgctcgatttagtcgagctctcagagagaaagggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctctggagatgcattcgaccaaacgatatgcttattggtaccagcagagccggcacggccctgtgttggngatgtaataaagacactgagacgccctagacgggactcctagagcgtattctcgtgcctcgaggtcgagggacaacggtcactagttcggacctagtcgagtacggtacgtccgaggccgaggaggacggaggtctagtacttaagttattgtacgaatacaaagtacgacacctagttacgttacttagtgtcgttacgatcgacgaccgtaacggtcaccgttcgcggtcacgcccagacccacctacncgtacc

SEQ ID NO: 129931 - DNA, 506 bp, Homo sapiens
  misc_feature: GYAE6OF02GBJGC.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccgaggtcagggacaacggtcacattggccatcagtggagtccaggcagaggacgaggctgactattatgtacaatcaacagacaaccattaggtacttatgtcttcggaactgacgaccgaaggtccaccgtctggtcacgcccaaggcccaaccccactgtacc

SEQ ID NO: 129932 - DNA, 227 bp, Homo sapiens
  misc_feature: GYAE6OF02FFGO8.49.52.E08.1.454.CMB.1.raw
  modified_base (208)..(208): a, c, t, g, unknown or other
  misc_feature (208)..(208): n is a, c, g, or t
  modified_base (214)..(227): a, c, t, g, unknown or other
  misc_feature (214)..(227): n is a, c, g, or t
tcagagtcgagagacacgaccggtgctcgatttagtcgagctctcgtcgcgggcacgaccggtgctcgatttagagagagtgtggttgggtttgggggaagaggaagactgaccggtcccccaggagttcaggtgctgggcacagcggccctgggctgcctggtcaaggactacttcctctctcgactctgagcgggctggcaaggcncatagnnnnnnnnnnnnnn

SEQ ID NO: 129933 - DNA, 623 bp, Homo sapiens
  misc_feature: GYAE6OF02I1TKS.49.52.E08.1.454.CMB.1.raw
  modified_base (223)..(223): a, c, t, g, unknown or other
  misc_feature (223)..(223): n is a, c, g, or t
  modified_base (241)..(241): a, c, t, g, unknown or other
  misc_feature (241)..(241): n is a, c, g, or t
  modified_base (291)..(291): a, c, t, g, unknown or other
  misc_feature (291)..(291): n is a, c, g, or t
tcagagtcgagagacacgaccggtgctcgatttagtcgagctctcagagagaaagggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctctgganatgcattgccaaaaccgntatgcttatggtaccagcagaagccgggccaggcccctggtcgttgggtnatgtaataaagcactcgagacggccctcgaggactcccgtggagccgtattcctctcggcctcccgaggtcgaacggggaccaaaccgggttcaacgtacgttggaccctagtaccgaggtcgggacgtccgaaggcgacggaagggacggagccgtagacttagttaagttcgtactaactacgaacgagaacctaacctagtttacgttaacctttaagttcgttacgtttaccgtaacgttcgaccggtaaccgtaacggtacccaccggttcccgtaggttaccgaccgtacccgtaaccggccctaacccccgagttccgtaacccg

SEQ ID NO: 129934 - DNA, 511 bp, Homo sapiens
  misc_feature: GYAE6OF02F06M0.49.52.E08.1.454.CMB.1.raw
  modified_base (241)..(241): a, c, t, g, unknown or other
  misc_feature (241)..(241): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccgntatgcttactggtaccagcagaggccaggccaggcccctgtcttggtgatttataaagactttgagaggccctcacgggacccctgagcgattctctggctccagctcagggacaacagtccacttgaccatcagtggagtccggcagaggacgaggctgactattactgtcacgtccgcagacagcgagtggctagttatgtcgtagttcggcggagggtacgtacggctcgaccgtctaggtcacgcccgaggcctcgcccccgtcgg

SEQ ID NO: 129935 - DNA, 561 bp, Homo sapiens
  misc_feature: GYAE6OF02F6R6O.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctggagatgcattgaccaaaaccgatatgcttattggtaccagcagaagccgggccaggcccctgtgttggtgatgtataaagacactgagacggccctacgagggactcccgtagagcgtattctcgtggcctccgaggtcgagggacaacggtcactagttcggccatcgaggtggacgtccgaggcagaggacgaggctagacttattagttgtactaatacaacgagacctactagttagttacttatcgtcttacggaactgaccgtaaccgtaacggtcctaccggttccgtacgggtaccacggacccgaacggacccccaaccctctacgtaccc

SEQ ID NO: 129936 - DNA, 530 bp, Homo sapiens
  misc_feature: GYAE6OF02G4161.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccgatatgcttattggtaccagcagaagccgggccaggcccctgtgttggtgatgtataaagacactgagaggccctcgagggatccctgacgcgattctctggctccgaggtcagggacaacggtcacattggccatcagtggagtccgaggcaggaggacgaggctgactattattgtacaatcaacagaccacctagttggtaacttagtgttcttacggactgacgaccgtaaggtcctaccggtccgtgggtacacggacccgaacggcccctaacccacgtgtaccc

SEQ ID NO: 129937 - DNA, 134 bp, Homo sapiens
  misc_feature: GYAE6OF02GZWJ4.49.52.E08.1.454.CMB.1.raw
  modified_base (134)..(134): a, c, t, g, unknown or other
  misc_feature (134)..(134): n is a, c, g, or t
tcagagtcgagagacacgaccggtgctcgatttagtcgagctctcccgcgagaaagggaaggggctggccctgacgtgtttctgttcccaccctcctctctctcgactctgagcgggctggcaaggcgcatagn

SEQ ID NO: 129938 - DNA, 634 bp, Homo sapiens
  misc_feature: GYAE6OF02GB8YI.49.52.E08.1.454.CMB.1.raw
  modified_base (186)..(186): a, c, t, g, unknown or other
  misc_feature (186)..(186): n is a, c, g, or t
  modified_base (189)..(189): a, c, t, g, unknown or other
  misc_feature (189)..(189): n is a, c, g, or t
  modified_base (191)..(191): a, c, t, g, unknown or other
  misc_feature (191)..(191): n is a, c, g, or t
  modified_base (198)..(198): a, c, t, g, unknown or other
  misc_feature (198)..(198): n is a, c, g, or t
  modified_base (209)..(209): a, c, t, g, unknown or other
  misc_feature (209)..(209): n is a, c, g, or t
  modified_base (254)..(254): a, c, t, g, unknown or other
  misc_feature (254)..(254): n is a, c, g, or t
  modified_base (293)..(293): a, c, t, g, unknown or other
  misc_feature (293)..(293): n is a, c, g, or t
  modified_base (297)..(297): a, c, t, g, unknown or other
  misc_feature (297)..(297): n is a, c, g, or t
tcagagtcgagagacacgaccggtgctcgatttagtcgagctctctcgtcggcggcacgaccggtgcgtcgactttagtccacgcgtacgaaaagggaaaggggcttcggcccttggacgtgtttcctgttcccgccctcctactctctcgactctgagcgggctgggctaaggcgctagttacgntgntnttgagtncatgtgagtcnagctgcgatcgtgggatgttggtacagccgtggggcctgagctcnccttgcgacacgcctatggtacttacctcgagttcttancggngactacgtacgtcggtccgtcgacgtcgtacgacggacggacgtagtcgtcgttcgtacgtacgacgtacgtagtacgtagtacgtacgtactacgtactactacgacgtacgtcgtacgtacgtacgtacgtacgtactaccgtacgtacgacgacgacgacgtacgtaacgtacgtacgtacgtacgtcgtacgtacgtacgtacgtacgtaacgtacgtacgtacgtacgtacgtacgtaacgtacgtacgtacgtacgtacgttacgttacgtcggtacgtacgtacgtacggtacggtacggtacggtaccggtacgtacgtacgtagtacg

SEQ ID NO: 129939 - DNA, 682 bp, Homo sapiens
  misc_feature: GYAE6OF02HTA2J.49.52.E08.1.454.CMB.1.raw
  modified_base (191)..(191): a, c, t, g, unknown or other
  misc_feature (191)..(191): n is a, c, g, or t
  modified_base (239)..(239): a, c, t, g, unknown or other
  misc_feature (239)..(239): n is a, c, g, or t
  modified_base (247)..(247): a, c, t, g, unknown or other
  misc_feature (247)..(247): n is a, c, g, or t
tcagagtcgagagacacgaccggtgctcgatttagtcgagctctctacgcggcaacgggaccggtgctccgatttacgtcacgcgtacgaaagggaaggggtcctggtccgtgacgtgttctgttcccaccctcctctctcgtccgacctactgaggcgggtcgtggactaacggtcgacttacttaggtnttttagagtctcagtgcgaggtcatgcgaggtcggggcgtgcgcagcncggcggtntctcgagcgtctcgtgtgtcgtctcgtacgtacgtctacgtcgttagtgtattacgtcgtacgtcgtcgtcggtcgtacgtcgtcgtcgtacggtacggtacgtcgtagtgtacgtcgttacgtcgtacgtacgtacgtacgtaacgtacgtacggtaggtaaggtaagtacgtacgtacgtacgtacgtaggtaggtaacggtaagtacgtacgtacgtacgtacgtacggtacgtacgtacgtacgtacgtacgttacggtacggtacgtaacgtaacgttaacgtacgtacgtaccgtacgtacgaccgacgtaacgtacgtacgtacgtacgtacgtacgtcgtcgtaccgtacgacgtacgtacgtacgtacgtacgtacgtcgtacgtacgtacgttacgtacgtacggtacggtacggtacggtacgg

SEQ ID NO: 129940 - DNA, 543 bp, Homo sapiens
  misc_feature: GYAE6OF02G4VNQ.49.52.E08.1.454.CMB.1.raw
  modified_base (536)..(536): a, c, t, g, unknown or other
  misc_feature (536)..(536): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccgatatgcttattggtaccagcagaagccgggcaggcccctgtgttggtgatgtataaagacactgagacggccctacgagggatcccgtggacgcgtattcctcgtcggctccgaggtcgaggggaaccaacgggtcaacgagtttcggaccatcgaggtgggagtccgaggcagaggacgaggctggacttattattgtacaatcaacagaccactattcggtaactttatcgtacttcgaactgacgaccgtaaggtccaccgtcgtcggtcacgtcccaacggcccaaccccgntcgtacc

SEQ ID NO: 129941 - DNA, 601 bp, Homo sapiens
  misc_feature: GYAE6OF02J2P7M.49.52.E08.1.454.CMB.1.raw
  modified_base (253)..(253): a, c, t, g, unknown or other
  misc_feature (253)..(253): n is a, c, g, or t
  modified_base (315)..(315): a, c, t, g, unknown or other
  misc_feature (315)..(315): n is a, c, g, or t
tcagagtcgagagacacgaccggtgctcgatttagtcgagctctcagagagaaaggggtgggtccgaggaggcagaactctgggtgtctcaccatggcctggatccctctacttctcccctcctcactctctgcacaggctctgaggcctcctatgagctgacacagcccaccctcggtgtccagtcgtcccccaggaccagacggccaggatccacctgctacctggagactgctattcgacccaaaaccgnttatgtccttaattcggtaccaggcaagaacggccccgggaccaggcccctggtcgttgggngtatagtataaagacacgtggacgaggcccctgacgggctcccgtgacgcgtattctctggcctcgaggtcacgggacaaccgtcacgagtttcggcatcgagtggacgtccgaggcaggaagggccgaggctaggactaattagttgtactaactacaacgacgaactaccgagttggttaacttgtacgttccgtttacggaactcggaccgacctaacgggtcctaccggtccgttagggtaccacgtacccggaaccgaccccgtacccacgtccgtacccg

SEQ ID NO: 129942 - DNA, 525 bp, Homo sapiens
  misc_feature: GYAE6OF02HXGUK.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccgatatgcttattggtaccagcagaagccgggccaggcccctgtgttggtgatgtaataaagacactgagacggccctcgagggatcccgtgagcgtattctctggctccaggtcagggacaacggtcacattcggaccatcagtggagtccaggcaggaggacgaggctagactattattgtacaatacaacagacactattggtacttatgtcttcgaactgacgaccgaaggtaccaccggtccgtgggtcacggcccaaaggacccaacccctactcgtaccc

SEQ ID NO: 129943 - DNA, 583 bp, Homo sapiens
  misc_feature: GYAE6OF02JU75R.49.52.E08.1.454.CMB.1.raw
  modified_base (454)..(454): a, c, t, g, unknown or other
  misc_feature (454)..(454): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaaaccgatactgtcttattcggtaccagccagaacgccgggaccacggcccctgtgttcggtgatgtaataaagacactgagacggcctcgagggtactcccgtgacgcgtattctcgtcggctccgaggtcgaggactaacggtcacgtattcggaccagtcagtggactcgaggcgagaggacgagcgtacgtactagttattcgtacaacgttanaaccgtacgtacaccgtagttacgggttaacttagtcgtttacgttacggtaactcgacgtaaccgtaacggtccgacgtcccgtggttaccacggacccgaaccggtcccaaccctcgtacgtacccg

SEQ ID NO: 129944 - DNA, 526 bp, Homo sapiens
  misc_feature: GYAE6OF02I8URF.49.52.E08.1.454.CMB.1.raw
  modified_base (240)..(240): a, c, t, g, unknown or other
  misc_feature (240)..(240): n is a, c, g, or t
  modified_base (397)..(397): a, c, t, g, unknown or other
  misc_feature (397)..(397): n is a, c, g, or t
  modified_base (444)..(444): a, c, t, g, unknown or other
  misc_feature (444)..(444): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccggccaggcccctgtgttggtgatgtataaagacactgagaggccctcagggatcccgtgacgcgtattctctggctccaggtcagggacaacggtcacgattggccatcagtgagtcgaggcagaggacgnggctgactatactgtcagtccgcgacgacagcaggtgacgtagttanggttcgtagtttcgggcgggtaagggtacctacggtcgtacgtacccggtctacgggtccaggtacccgagggccctcccgg

SEQ ID NO: 129945 - DNA, 519 bp, Homo sapiens
  misc_feature: GYAE6OF02FTU0E.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccgggccaggcccctgtgttggtgatgtataagacactgagaggccctcgagggatccctgagcgattctctggctccgaggtcgagggacaacggtcacattggccatcagtggagtccgaggcagaggacgaggctgacttattattgtcaatcaacagacacattcgtacttatgtcttcgacttgacgtaccgtaaggtctaccgtccgttgggtacacggcccaacggcccaaccccgactgtaccccg

SEQ ID NO: 129946 - DNA, 523 bp, Homo sapiens
  misc_feature: GYAE6OF02HWA6Y.49.52.E08.1.454.CMB.1.raw
  modified_base (427)..(427): a, c, t, g, unknown or other
  misc_feature (427)..(427): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccacctcggtgtcagtgtccccaggacagacggccaggatcacctgctctggagatgcattgccaaaccgatatgcttattggtaccagcagaacgccgggccaggcccctgtgttggtgatgtaataaagacactggagcggccctagagggactcccgtagagcgtattctcgtcggcctcgaggtcgagggacaacggtcacgagttcggccatcaggtggacgtcgaggcagaggacgagctgactattattganaactcaacagacacctattacgttacttatcgtcttacgatgacgacgaaggtccaccgtcgtggtcacgacccgaagaccccaaccgactgtacc

SEQ ID NO: 129947 - DNA, 761 bp, Homo sapiens
  misc_feature: GYAE6OF02H7PHI.49.52.E08.1.454.CMB.1.raw
  modified_base (401)..(401): a, c, t, g, unknown or other
  misc_feature (401)..(401): n is a, c, g, or t
tcagagtcgagagacacgaccggtgctcgatttagtcgagctctcagagagaaagggggtgggtccgaggaggcagaactctgggtgtctcaccatggcctggatccctctacttctcccctcctcactctctgcacaggctctgaggcctcctatgagctgacacagccaccctcggtgtcagtcgtcccaggacagacggccaggatcacctgcctcgtggagatgcattcggaccaaaaccggattactgacctttaagtttcgggaaccaggcaaggaacgcccggggcctacgggcccctggttgtttgggttcgaattggtaaataaaacggctacgtggaaggtaacggccccttacggagggtactcccggtagacggaccgtagttttaccncgtacgggccccttacgggtaggtaaccgggaccggaaaaccggttacgtaccgtacggttaacggtcgacctaagacggtagggtacggttaccgaccggacggacaacggggaacggtcggaacggtcgtaacgtaatttaagtttacggttaacgtaacaaacgtacccgtaaacgtaaccgtaacccaaacgttttaggttaaccgtttaaacgtttcgtacgttaaccggtttaacggtaccgtacggtaacccggtaaaacggtcccggttaaacccgttcccgggtcgggtttaaccggtaccggacccgtaaaccggtacccgaaaccccccggtaacttcggtacccgtac

SEQ ID NO: 129948 - DNA, 548 bp, Homo sapiens
  misc_feature: GYAE6OF02F63KX.49.52.E08.1.454.CMB.1.raw
  modified_base (239)..(239): a, c, t, g, unknown or other
  misc_feature (239)..(239): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgctatgtaccagcagaagcggccaggcccctgtgttggtgatgtataaagacactgagagcctcgaggatccctgagcgatctctgctcgaggtcagggacaacggtcactatcggcatcagtggagtcgaggcagaggacgaggctagactattattgtacaagtacaaacagaacctaaccatttacggtacttaattgtaccgttacggaacttgaccgaacccgtaagggtaccaacccggttcccgtacgggtaccaccggtaccccgaaacggcccctaacccccgacgttccggtaccc

SEQ ID NO: 129949 - DNA, 558 bp, Homo sapiens
  misc_feature: GYAE6OF02IWE4U.49.52.E08.1.454.CMB.1.raw
  modified_base (242)..(242): a, c, t, g, unknown or other
  misc_feature (242)..(242): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaaccgntatgcttattgtaccagcagaagccgggccaggcccctgtgttggtgatgtataaagacactgagaggccctcagggatccctgagcgattctctggctcgaggtcagggacaacggtcacattggccatcagtggagtccaggcaggaggacgaggctgaacttattattgtactaatcaacagaccactattaggtactttagtcgttcttacggaacttcgacgtaaccgtaagggtcccaaccgggttccttcggggttaccaaccggtccccgaaaccgggaccccaaacccccgtactaccggttacccc

SEQ ID NO: 129950 - DNA, 579 bp, Homo sapiens
  misc_feature: GYAE6OF02F05FY.49.52.E08.1.454.CMB.1.raw
  modified_base (240)..(240): a, c, t, g, unknown or other
  misc_feature (240)..(240): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttattggtaccagcagaagccgggccacggcccctgtgttggtgatgtataaagacactgagaggccctgagggactccctgagcgtattctctggctcgaggtcagggacaacggtcactagttggccatcgagtggacgtcaggcaggaggacgaggctagacttattagttgtactaatacaaacagacaccgtatttacggttaacttagttcgttacgttacggtaacttcggaccgtaaccgtaacggttacccgaacccgttccgtacggggtaccacggtaccccgaaaccgggaccccctaaacccccgtacgtaccgtaacccg

SEQ ID NO: 129951 - DNA, 511 bp, Homo sapiens
  misc_feature: GYAE6OF02G0W2G.49.52.E08.1.454.CMB.1.raw
  modified_base (336)..(336): a, c, t, g, unknown or other
  misc_feature (336)..(336): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctggagatgcattgccaaaccgatatgcttattggtaccagcagaagccgggccaggccccctgtgttggtgatgtataaagacactgagaggccctcagggatccctgagcgattcnctggctcaggtcagggacaacggtcacattgccatcagtggagtccaggcagaggacgaggctgacttattattgtacaatcaacagaccaccattgttacttatgtacttcggaactgacgaccgaaggtaccaccgtcctgggtcacgcccaaggcccaacccgtactgtacc

SEQ ID NO: 129952 - DNA, 607 bp, Homo sapiens
  misc_feature: GYAE6OF02GGA7Y.49.52.E08.1.454.CMB.1.raw
  modified_base (240)..(240): a, c, t, g, unknown or other
  misc_feature (240)..(240): n is a, c, g, or t
tcagagtcgagagacacgaccggtgctcgatttagtcgagctctcagagagaaaggggtagggtccgaggaggcagaactctgggtgtctcaccatggcctggatccctctacttctcccctcctcactctctgcacagctctgaggcctcctatgagctgacacagccaccctcggtgtcagtgtccccaggacagacggccaggatcacctgctctggacgatgcattgccaaaccgntatgcttattggtaccagctagaagccgggaccacggcccctggtgttggtgatgtaataaagacacgtgacgacggcctcgagggtactccctagacgcgtattctcgtggcctcgaggttcagggtacgaacggtcacgatttggaccgtatcgagttaggacgtacccaggctaaggaggacgaggctaggacttaattagttagtacaatcgaaacagtaccaccgtaagttgttaacttagtacgttccgttaacggaccgttagaccggtaaccgtaaacggttcgtaaccccggttaccgttagggtacccgtacgtacccctaacgggaacccctaacccccgtagttacccgtacccg

SEQ ID NO: 129953 - DNA, 1016 bp, Homo sapiens
  misc_feature: GYAE6OF02JHO6W.49.52.E08.1.454.CMB.1.raw
  modified_base (936)..(936): a, c, t, g, unknown or other
  misc_feature (936)..(936): n is a, c, g, or t
  modified_base (940)..(941): a, c, t, g, unknown or other
  misc_feature (940)..(941): n is a, c, g, or t
tcagagtcgagagacacgaccggtgctcgatttagtcgagctctctcggcgggggggtcacaagaggcagcgctctcgggacgtctccaccatggcctgggctctgctgctccctctctctcctactactacgacgacacggtacggtcggtcggaccgtacgtcgtcgtccgtcgtactacacgtcgtcgtccgtcgtcgtcggtcggtccgtcgtacgtacgtacgtacgtactacctacctactacctcgtcaccgtaccgtaaaccgtaaccggtaaaccacgtacgtacgtacggttacgggttgttaaaacggtttaaacgtttaaaacccgttttttaacccgtttttaccccgtttaaccgggttttaacccggttaaacccctaaaaccggtaaaacccccgtaaaacccgggtaaccggtaaaaacccggtaaaaccccccggtaaaaaccccccgttaaaacccgttaaacccgttaaaaccgttaaacccgttttaaaaccgttttaacggtaaacggggtaaaccccgggtaaacccggttaaaccggtaaaccgggtaacccggggtacccccgggttaaccccggttaaccggggggttaacccgggtttaccgttaccggttaacggttaaccggttaccgtttaccgtttaccgtttaccgggttacccggttacccgttaacccggttaccggttaccgggtaccggtaaccggtaaccggtaacccgggtacccggttaccccgttacccggtaaccgtaaaccgttaaccgttaccgttaccgggtaccggttaccgtaccggtaccgggtacggggtaacgggtaacgggtacggtacggtaacggttaacgtttaacgtttacgttacggttacgtttacgttaacgttaacgttacgtacggtacggttaacntatnngtcgggtaaccgggtaacgggttacggttacgggtacgggtaacgggtaacggtaacggtacggtaccggtaccg

SEQ ID NO: 129954 - DNA, 661 bp, Homo sapiens
  misc_feature: GYAE6OF02GH75B.49.52.E08.1.454.CMB.1.raw
  modified_base (314)..(314): a, c, t, g, unknown or other
  misc_feature (314)..(314): n is a, c, g, or t
  modified_base (388)..(388): a, c, t, g, unknown or other
  misc_feature (388)..(388): n is a, c, g, or t
tcagagtcgagagacacgaccggtgctcgatttagtcgagctctcttcggtcggggggggtcacaagaggcagcgctctccgggacgtctccgaccatcggcctgggctactgctgctccgtccactctccgtcacgtccagggacaccagggtccctgggcccagtctgccctgactcagcctgcctccgtgtctgggtctcctgggacaggtcgatcaccatcgtccgtgcactgaaacctgcagtgatgttaggaattataacctttctctggtaccaacacaccagacaaacgccccaaatcatcattangaggccatcagccgcctcgagggtcctcgtagatcgcttctctcggcctcacgtctggcagtcacggcctccgngacaatctctcggctcgaggtcgtgggacgtaggtctgacttattattgcgttcgttactacgttacgtcgaccgggttagtacgttagggtaccgggtaccggtaaacggggttcggttaccggggtacgggtaacggggtaaaccggtaaaacgggggttcccggtaaacccgggtttcccggttaaaccggggttcccctaaccggggacccccggtaaaaccgggtccccgttaccccgggtaccccccggttaccgggttaaccccgg

SEQ ID NO: 129955 - DNA, 665 bp, Homo sapiens
  misc_feature: GYAE6OF02J1883.49.52.E08.1.454.CMB.1.raw
tcagagtcgagagacacgaccggtgctcgatttagtcgagctctctcggcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttggaattataacctttctctgtacaacaacaccaggacaaacgccccaaactcactcattatgagccgatcagccggccctcgacgggttctctgtactcgtcttctctcggcctccgtacgtcgtggaccacgccgaccggccctccgtagaacctaactcgtccgtcgggccttaccgacggtcggtacgggggaccgacgggtcttacggttaatttaacgtttacgttgtcctttcggttactacgttaagttcggtaccgggttaggttacgttagggtaccgggtaccggggttaaaggggttcgggtttaccggggacgggtaacgggtaacccggtaaaggggttcggtaacccggttaccggtacgggtaccgtacggtaccccggaagggtcccgtcccgggtacccgttcccggtacccg

SEQ ID NO: 129956 - DNA, 540 bp, Homo sapiens
  misc_feature: GYAE6OF02G1CN3.49.52.E08.1.454.CMB.1.raw
  modified_base (287)..(287): a, c, t, g, unknown or other
  misc_feature (287)..(287): n is a, c, g, or t
  modified_base (429)..(429): a, c, t, g, unknown or other
  misc_feature (429)..(429): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccggccaggcccctgtgttggnatgtataaagacactgagacgccctgagggactcccgtgagcgtattctctggctcgaggtcagggacaacggtcacgtagttaggccatcgagtggacgtccgaggcagacggacggaggtcttaggaacttagttagttntacagtcatcagacagtgtgctacgttctagtcgttagtcgggacgggacgggtaccaaggtccgtacggtaccgttaccgttaggtaccacggacccgaggccttcccgg

SEQ ID NO: 129957 - DNA, 232 bp, Homo sapiens
  misc_feature: GYAE6OF02GLJJJ.49.52.E08.1.454.CMB.1.raw
  modified_base (213)..(232): a, c, t, g, unknown or other
  misc_feature (213)..(232): n is a, c, g, or t
tcagagtcgagagacacgaccggtgctcgatttagtcgagctctctcggcgggcaacgaccggtgctcgatttagagagagtgtgttgggtttgggggaagaggaagactgaccggtcccccaggagttcaggtgctgggcacagcggccctgggctgcctggtcaaggctacttcctctctcgactctgagcgggctggcaaggcgcatagnnnnnnnnnnnnnnnnnnnn

SEQ ID NO: 129958 - DNA, 558 bp, Homo sapiens
  misc_feature: GYAE6OF02HEXOK.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaaccgatatgcttattggtaccagcagaacgccgggccacggcccctggtgttggtgatgtataaagacactgagacggccctacgacgggactcccgtgacgcgtattctcgtggctccgaggtcagggacaacggtcactagttgaccatcgaggtggacgtccgaggcaaggaggacgaggctagacttagttattgtacaatacaaacgacgtaccaacttagttacgttaactttagtcgttcttacgactcgacgtaaccgaaggtccaccggtccgtggtccacggtacccgaagccccaaccgtcgtactaccg

SEQ ID NO: 129959 - DNA, 550 bp, Homo sapiens
  misc_feature: GYAE6OF02GZEZ1.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccgggccaggcccctgtgtggtgatgtataaagacactgagaggccctcgagggactcccgtgacgcgattctctggctcgaggtcgagggacaacggtcacagttggaccagtcagtggagtaccgaggcaggaggacgaggctgacttattagttgtctacggtccgcgtagacgagcgagtgactagttagttgtcgttagttcgggacgggtaagggaccttacggccgttacggaccgttcccgttaggtaccgacggaccccgaagggtcctaccccgg

SEQ ID NO: 129960 - DNA, 857 bp, Homo sapiens
  misc_feature: GYAE6OF02HVO9T.49.52.E08.1.454.CMB.1.raw
  modified_base (160)..(160): a, c, t, g, unknown or other
  misc_feature (160)..(160): n is a, c, g, or t
tcagagtcgagagacacgaccggtgctcgatttagtcgagctctcagagagaaagggggtgggtccaggaggcagaactctgggtgtctcaccatggcctggatccctctacttctccccctctcactctctgcacaggctctgaggccccctacttagngacgtcgtacgaaccacgaccgaccccctacccggttcgggttctacgtacggttccccgacccggaacggaacgaaccgggaccggacggaacggtactaccctaccgtcgtccttcgggtaggaagtagtcgacttacgtaccgaaaccccgaaacgtattagtcgtttaactttaggttacccgaacgacgaacgaaacgggaacccggggccccggaccggtacccccgtccccgtttgggtttacgggtttaggtaacgttaggtttaagttaaaaacggtaaaccgaccgttacggtacggaaacggggtccccgttaaccccgtaaggggtaaccggtaccccttaccgggtaggaccgtaaccgtttcctttccgtcggtacgtcccgtacggtacggtacgggaacggtaacgtaccgtactaacgttacgtccgactacgtacggtagggtacggtccgacggagaacgaagggacggtaacgggactcgtaacgttaacttagtttacgttacgaactaacaaacgaaccgaacgtaccctaacgtttaaggttaaccgtttacttaggttaccgttacgttaacgaacgttcgaacccgtaacggttaacgcccggttacggttcgtaccggaaccaccggtaacccggaacccgtaccccctaaaccgtcggtaccttaacccg

SEQ ID NO: 129961 - DNA, 500 bp, Homo sapiens
  misc_feature: GYAE6OF02GBNDD.49.52.E08.1.454.CMB.1.raw
  modified_base (314)..(314): a, c, t, g, unknown or other
  misc_feature (314)..(314): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctnagggatccctgagcgattctctgctccaggtcagggacaacggtcacatgccatcagtggagtccaggcagaggacgaggctgacttattattgtcaatcaacagacactatgtacttatgtcttcgaactgacgaccgaaggtccaccgtcctggtcacgcccaaggcccaaccccgactgtacc

SEQ ID NO: 129962 - DNA, 545 bp, Homo sapiens
  misc_feature: GYAE6OF02I11RD.49.52.E08.1.454.CMB.1.raw
  modified_base (399)..(399): a, c, t, g, unknown or other
  misc_feature (399)..(399): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgacccaaaccgatatgtcttattggtaccagcaggaagcccgggccaggcccctgtcgttggtgatgtaataagacacgtgagaggccctgagggactcccgtgacgcgtattctcgtggctccgaggtcagggacaacggtcacagttgccatcagtggagtcaggngagacggacgaggctgacttattatcgtacaatcaacacgaacacctagttagttacttagtcgttcttacggatcggacgtaccgaaggttccaccggtccgtacgggtcacggccctaacggaccccaaccctacgtcgtaccc

SEQ ID NO: 129963 - DNA, 518 bp, Homo sapiens
  misc_feature: GYAE6OF02GJ13R.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtaataaagacactgagaggccctgagggatccctgacgcgattctctggctcgaggtcgagggacaacggtcacattcggcatcagtggagtccaggcaggaggacgaggctgacttattattgtacaatcaacagacactattgtacttatgtcttacgactgacgaccgtaaggtccaccgtccgtggtaccacgacccgaaggaccccaaccctacgtgtaccc

SEQ ID NO: 129964 - DNA, 763 bp, Homo sapiens
  misc_feature: GYAE6OF02I2SQ6.49.52.E08.1.454.CMB.1.raw
tcagagtcgagagacacgaccggtgctcgatttagtcgagctctcagagagaaagggggtgggtccaggaggcagaactctgggtgtctctaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccgggccaggcccctgtgtggtgatgtataaagacactgagaggccctgagggatcccgtgacgacgtattaccgtcgtcggcttccgagggttaccgaacggggaaccaaacgggtaccaacgtacgtttcgggacccaattccgaagggttacggggacggttacccgaagggccgaaagggaacgggaaccgggacgggtacgtaacggtaacgtttaagtttaacgtttacgggttaacctaaaacgttacctaaaaccgaacgtaaaccccgtaaccgtaaacgttttacggggtttaaaccttttaacgtttacggtttaccgttttaaaccgggtaaccttaccgggtaaccggtaaaccccggtaaacggggtttaccccgtaacccgggtttaaccccgttcggggggttaacccctaaccgggtacccccggtaaaaccgggaacccccccgtaaaccccccgttacccgttaccggttaacccccc

SEQ ID NO: 129965 - DNA, 829 bp, Homo sapiens
  misc_feature: GYAE6OF02G9T7H.49.52.E08.1.454.CMB.1.raw
  modified_base (286)..(286): a, c, t, g, unknown or other
  misc_feature (286)..(286): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacgagctctggacgcctctagtgacgtctgacacacgcccaccgttcggtgtcaggtccgtaccccgaggacacggaccggccgaaggtactccgacctcgtccttcgtaggaacgagttcgacttacgttaccgaacccgtaaaaacgtnttaacgtcgttactttacggtttacggtaaccacggacgaacggaaccggaccccgggaccgaacccgggtccccgttggttcgggtttacggtagtacgttaacgttaaagtaaaacgaactacgtaggaacggaccggtacccgttacggacgggtacctacccgtaggtaccggtacgttacgttccgttcgtccggtaccttaccggacggtacggaaacgggtaaccgtaacggtacctaacgtacgtttcggacctagtaccgtagggtcggtaaccggtaccgaacgggtacgaaggggtacggacggacggtaccgttaacgtaactttagtttacgtacgtaacgtaactaaccaaacggtaacctaccgttaacgttaagtttacgggttaaccttttacggttacgttacccgttaacggaccgttacggaacccgttaaccggtaacggttcccgtaccggttccggtaccgggtaccgacccggttacccgaacccgggtaccccaacccggttcgtacccgttaccccg

SEQ ID NO: 129966 - DNA, 606 bp, Homo sapiens
  misc_feature: GYAE6OF02JMDDI.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaaccgatatgcttattggtaccagcagaagccggccaggcccctgtgttggtgatgtaataaagacactgagacggccctgagggatcccgtgagcgattctctggctcaggtcagggacaacggtcacagttcggccatcgtagtggacgtaccgaggcgagaggacgaggcctagactattattgacaagtacaagacgaccacctaagtttacggtaactttagttcggttaaccgtttacggtaaccttggaaccgtaacccgtaagggtacccgttaacccggttcccggtcggggttaacccgaaccggtacccccgtaaaaccgggtccccccaaaacccccgtacgtttacccgtaaccccg

SEQ ID NO: 129967 - DNA, 511 bp, Homo sapiens
  misc_feature: GYAE6OF02GCAX5.49.52.E08.1.454.CMB.1.raw
  modified_base (441)..(441): a, c, t, g, unknown or other
  misc_feature (441)..(441): n is a, c, g, or t
  modified_base (486)..(486): a, c, t, g, unknown or other
  misc_feature (486)..(486): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccgatatgcttattggtaccagcagaagccgggccaggcccctgtgttggtgatgtaataaagacactgagacggccctcgagggactcccgtgacgcgtattctctggctccgaggtcgagggacaacggtcactagttcgcctatcgagtggagtccgaggcaggaggacgaggctagacttagttatgtacaatacaacanacactattgtacttatgttcgtacgactgcgacgagtcacgtcgngtcacgccacgccacccactgtacc

SEQ ID NO: 129968 - DNA, 495 bp, Homo sapiens
  misc_feature: GYAE6OF02F6L8W.49.52.E08.1.454.CMB.1.raw
  modified_base (488)..(488): a, c, t, g, unknown or other
  misc_feature (488)..(488): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccgggccaggcccctgtgttggtgatgtataaagacactgagaggccctcagggatcctgagcgattctctggctccaggtcagggacaacggtcacattggccatcagtggagtccaggcagaggacgaggctgacttattattgtacaatcaacagacaccattggtacttatgtcttcgactgcgacgaaggtcacgtctggtcagccaagcccaacccnctgtacc

SEQ ID NO: 129969 - DNA, 658 bp, Homo sapiens
  misc_feature: GYAE6OF02HLTGW.49.52.E08.1.454.CMB.1.raw
  modified_base (311)..(311): a, c, t, g, unknown or other
  misc_feature (311)..(311): n is a, c, g, or t
tcagagtcgagagacacgaccggtgctcgatttagtcgagctctcagagagaaagggggtgggtccaggaggcagaactctgggtgtctcaccatggcctggatccctctacttcctccccctcctcactctctgcacaggctctgaggcctcctatgagctgacacagcccaccctcggtgtcagtcgtccccaggacagacggccaggatcacctgctctggagatgcattcgaccaaaccgatatgtacttattcggtaaccagcaggaacgcccgggccacggccccgtgtggttggtgtatgtaanaaagacactggagacgccctgacgggactcccgtagagcgtattcgtcgtcggtcctccgaggtcgacgggacctaacggtcacgtagttcggaccagtaccgaggtacgggacgtccgaagggtccgaagggaagggaccggaggaccgttagtaacttagtttaattcggtactaaactcgaaactacgtaacccaaccgttaagtttcggttaactttagttacgttaccgttacggtaacgttcgaccggtaacccgtaagggttcccgacccggttaccggttccggaccgtacccggaacccgtaaccggacccccgtaaccccctacgtccgtaaccccg

SEQ ID NO: 129970 - DNA, 736 bp, Homo sapiens
  misc_feature: GYAE6OF02FHYZ6.49.52.E08.1.454.CMB.1.raw
  modified_base (84)..(84): a, c, t, g, unknown or other
  misc_feature (84)..(84): n is a, c, g, or t
tcagagtcgagagacacgaccggtgctcgatttagtcgagctctcagagagaaaggggtggtccaggaggcagaactctgggtntctcaccatggcctggactcccctctacttcctcccctcctcactctctgccacaggctctgacggtccctcctatgacgctacgaccaccgacgcccacccgtcggtgtaccacgtccgaccccgaggaccacggaccggccaaggtactccgcccgtgcctcgtaggactactcgactacgtccgaacccgtaacgtattacgtcgtacttacgtccgaccgagaccgacggaccggccggtaccgcggtccgttattacggttacggtataacgtaacgtaaacgtacgacgtacggtacggaccggaccgtacgtaccggtaccgtaccgtcgtacggtaccgtccttccgtaccgtcggtaccgtacggacgtacggacgaccgtaaccgctaccgtaggttaccacgtcgtacgacggcgtacgacgacggacgacgacggtacgactacgttacgttaactacggtttacaccgtaacacgtaccgtaacgtacaccggtttaactacggtttacgtaacgtttccgacttacccggtaataccggcccgtaatacccggtaccgttaacccggccgtacccgtaccgtaccgaaccccgtacccggtaccctaccccggtactcccttccgttacccgtccccg

SEQ ID NO: 129971 - DNA, 612 bp, Homo sapiens
  misc_feature: GYAE6OF02GBXT4.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgatatgcttattggtaccagcagaagccgggcacggcccctgtgttggtgatgtataaagacactgagacggccctgagggactcccgtgacgcgtattctctggactccgaggtcgagggacgaacggtcacgtagttcggcctatcgaggtcggacgtccgaggaccgaggaacgggacggacggtcgtagtaacgttagtttaagttcggtactaactactaaacacggtaccaaccgtaagtttacggttaactttatacggttacgttacggtaactcgaccgtaaccgtaacggtcctaacccggttcccgtacgggttacaccggtaccccgaacgggacccctaacccccgtacgttacgtacccg

SEQ ID NO: 129972 - DNA, 554 bp, Homo sapiens
  misc_feature: GYAE6OF02IINM0.49.52.E08.1.454.CMB.1.raw
tcagagtcgagagacacgaccggtgctcgatttagtcgagctctctcggcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaacgcccccaaactcatcatttatgaggccgatcagcgccctcaggggtctcgtgatcgcttctctggctccacgtctggcagcgaccgccctccctgacaatcctcgtggcctccaggcgtacggggacgaggctgtattattagttgtcttgttcattagtgccggtgtagtagttggaccgtaagggttgtcgggcggagggtaccgaaggttcggaaccggtccgtacggtaccgaggccccgaggtcccgtcggcccccgtcggtacccg

SEQ ID NO: 129973 - DNA, 165 bp, Homo sapiens
  misc_feature: GYAE6OF02F5TVR.49.52.E08.1.454.CMB.1.raw
  modified_base (164)..(165): a, c, t, g, unknown or other
  misc_feature (164)..(165): n is a, c, g, or t
tcagagtcgagagacacgaccggtgctcgatttagtcgagctctcccgcgggcacgaccggtgctcgatttagtcacgcgagaaagggaaaggggctggccctgacgtgtttctgttcccgcctcctctctctcgactctgagcgggctggcaaggcgcatagnn

SEQ ID NO: 129974 - DNA, 719 bp, Homo sapiens
  misc_feature: GYAE6OF02HXPUI.49.52.E08.1.454.CMB.1.raw
  modified_base (296)..(296): a, c, t, g, unknown or other
  misc_feature (296)..(296): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagcccaccctcggtgtcagtgtcccaggacagacgccaggatcacctgctctggagatgcattcgaccaaaaccgatatgtcttattggtaccagacagaacgccgggccacggcccctggttgttggtnagtagtaataaagacactggagacggccctcgagggactcccgtaggacgcgtattccgtcgtcggtctcccgagggtcgaacggggtaacaaaccggtcaacgtagtttcggacctaattccgaaggttcgggtaacgtacccggaagggaccaaggggaacggaccgggaaggtccgttaggtaacttaagttttacgtttagtaccgtaaaacttaccgaaaaccgtaacggtaaaccctaacccgttagtttacgggttaaacccttttaaggtcggttttacccgtttacgggtaaccttcgggtaaccggtaacccgtaacgggttccccgaacccggtttcccggttaaccggggtccaacccgggtaccccggtaaaccggaccccccgtaaccccgtacgttaccgtaaccccg

SEQ ID NO: 129975 - DNA, 609 bp, Homo sapiens
  misc_feature: GYAE6OF02HVLBG.49.52.E08.1.454.CMB.1.raw
  modified_base (343)..(343): a, c, t, g, unknown or other
  misc_feature (343)..(343): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctggagatgcattgaccaaaccgatatgcttattggtaccagcagaagccgggccacggccctgtgtggtgatgtaataaagacactggagacggccctgagggtactcccgtgacgcgtattcncgtggctccgaggtcgagggacaacggtcactagttcggaccagtcgaggtggtacgtccgaaggcgaggaacgggacgaggcttaggtaacttagttagttgtaacaatcctaaacgagaccaaccttaagttcgttaacttagtcgttacgttacgtaactcggaccgtaaccgtaacgggttccgtacccgttacccggttcgggtaccaacccggtacccggtaaacccgtaccccgtaaacccccgtgtaccgttaacccg

SEQ ID NO: 129976 - DNA, 585 bp, Homo sapiens
  misc_feature: GYAE6OF02G49R6.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaacgccgggccaggcccctgtgttggtgatgtataaagacactgagacggccctgagggactcccgtgagcgtattctcgtggctcgaggtcgacgggacaaacgggtcacgtagttcggaccagtcgtaggtcgggacgtccgagggcaaggagggacgaggctaggaacttattaagttgtacaacttacaaacgaacgaccaacctagtttacggttaacctttagttcgttacttacgaactggacgtaaccgtaacggtacctaccggtccgtagggtaccacggaccccgaacgggccccaaccccgtatcgtaccc

SEQ ID NO: 129977 - DNA, 675 bp, Homo sapiens
  misc_feature: GYAE6OF02HLJ0M.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttcctccccctcctcactctctgcacaggctctgaggcctcctatgagctgacacagccaccctcggtgtcagtcgtccccaggacagacggccaggatcacctgctcgtggagatgcattcgaccaaaccgatatgtcttattcggtaccagcagaacgccgggccacggcccctggtgttggtgatgtaataaagactacgtggagacggccctagacgggtactcccgtagagcgtattcctcgttcggcctaccgagggtccgaacggggaccgtaaacgggtccacgtagtttcgggaccctagttaccgaggtacgggacggttcccggaagggcaagggaacgggaacggagggcgttagtaacttaagttacgttagtactaaactacgaaacgtacgaaccctaaccgtaaggtttacggttaactttaacgttcggttacgttacgggtaacttcggaaccgtaaccgtaaacgggttccctaacccgggttccgtaacgggtaccaaccggacccgaaaccggtaaccccctaaccccgtacgtccgtaccc

SEQ ID NO: 129978 - DNA, 611 bp, Homo sapiens
  misc_feature: GYAE6OF02HDDTC.49.52.E08.1.454.CMB.1.raw
  modified_base (242)..(242): a, c, t, g, unknown or other
  misc_feature (242)..(242): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgcattgaccaaacgntatgcttatggtaccagcagaagccggcacggcccctgtgttggtgatgtaataaagacactgaggacggccctagagggactcccgtgacgcgattctcgtcggtctccgaggtcgaggggacaaccggtcaacgtagtttcggccagtcaggtggacgtccgaggcaggaggacgaggcttagacttatagttcgtacaatcaacacgacaccgtagtttcggtaactttagtcgttaccgttacgggtaaccttcgtaccggtaacccgtaacgggttacccaacccggttccggttacgggtaccgaaccgggtaacccccgaaacgggtacccccaaacccccgtaccgttaccggtaaccccc

SEQ ID NO: 129979 - DNA, 605 bp, Homo sapiens
  misc_feature: GYAE6OF02ISYJK.49.52.E08.1.454.CMB.1.raw
  modified_base (479)..(479): a, c, t, g, unknown or other
  misc_feature (479)..(479): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaacgccgggccaggcccctgtgttggtgatgtataaagacactgagaggccctcgagggactcccgtgacggcgattctcgtggcctcgaggtcgaacggggtaccaaacgggtcaacgtagtttcgggccctaagtccaaggttgggaacgtcccgaagggcaaggacgggaacggaagggctacgacgttaatttatttgtaccgaaattccaaanaacgaccaacctaatttagggtaacttaagtcgtactttacgggaactcgacgaccgtaaggttccacccggttccgtcgggtaccacggtacccgaaacggccccaaaccccgtactcggtaccc

SEQ ID NO: 129980 - DNA, 588 bp, Homo sapiens
  misc_feature: GYAE6OF02IKXPO.49.52.E08.1.454.CMB.1.raw
  modified_base (246)..(246): a, c, t, g, unknown or other
  misc_feature (246)..(246): n is a, c, g, or t
tcagagtcgagagacacgaccggtgctcgatttagtcgagctctcagagagaaagggggtgggtccaggaggcagaactctgggtgtctcaccatggcctggatccctctacttcctccccctcctcactctctgcacaggctctgaggcctcctatgagctgacacagccaccctcggtgtcagtcgtcccccaggacagacggccaggatcacctgctctggagatgcattcgaccaaaaccgntatgcttattggtaccagcagaacgcccggccacggcccctgtgttggtgtatgtaataaagacacgtgagacggccctcgacgggtactcccgtgacgcgtattcgtctcggctccgaggtcgacgggaacaacggtcactagttcggcctagtcgaggtcggagtccgaggcaggaggacgaggtcgtgacttagttattcgtacaatacaacgacgtacaacgtagttacgtactttagtcgttacgttacggacctcggaccgtaaccgtaacggtaccacccggttccgtacgggtaccacggaccccgaacggaccccaacccgtcgtcgtacccg

SEQ ID NO: 129981 - DNA, 532 bp, Homo sapiens
  misc_feature: GYAE6OF02HNWN3.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctgagggactcccgtgagcgattctctggctccgaggtcagggacaacggtcacattcggcatcagtggagtccaggcaggaggacgaggctgactattatgtcaatcaacagacactagttgtacttagtcgtacgttacgactgacgtaccgtaaggtcccaccggtccgtcgggtaccacggaccccgaacggaccccaaccccgtacgtcgtacccg

SEQ ID NO: 129982 - DNA, 706 bp, Homo sapiens
  misc_feature: GYAE6OF02JRNEE.49.52.E08.1.454.CMB.1.raw
  modified_base (226)..(226): a, c, t, g, unknown or other
  misc_feature (226)..(226): n is a, c, g, or t
tcagagtcgagagacacgaccggtgctcgatttagtcgagctctcagagagaaagggggtggggtccgaggaggcgagaactctgggtgtctcaccatggcctggatccctctacttctcccctcctcactctctgcacagctctgaggcctcctatgagctgacacagcccacctcggtgtcagtcgtccccaggacacgacggccaggatcacctgctctgganatgctattcgaccaaaccgatatgtcttattggtaccagtcagaagccggccacggcccctgtcgtggtgatgtataagacactaggagacggccgtgagggtactacccgtgacgcggtattccgtacgtcggtcctacgacggttccgaacggggtacctaaacccgggttcaaccgtaagtttcggaccctaagtccgtagggttcggaacgttcccgaagggacgtacggaagggaaccgggaggaccggttggtaacgttaacgtttagtttacgaccggtaaactaccggtaaacgaacgaaccgtaaacccttaggttaaccggttttaaattacggttaaccgttcgtttaacccgggaactttacggaccgtaaacccggttaacgggttacccgtacccggttaccggttacggggttaccaacggccccggtaaacggaacccctaacccccgtacgtaccgtaacccg

SEQ ID NO: 129983 - DNA, 720 bp, Homo sapiens
  misc_feature: GYAE6OF02JYLXX.49.52.E08.1.454.CMB.1.raw
tcagagtcgagagacacgaccggtgctcgatttagtcgagctctcagagagaaaggggtgggtccgaggaggcagaactctgggtgtctcaccatggcctggatccctctacttctcccctcctcactctctgcacaggctctgaggcctcctatgagctgacacagcccaccctggtgtcagtcgtccccaggacagacggccaggatcgacctgctcgtggagatgctattcgaccaaaccgatactgtcttagttggtaccagctaagaacggcccgggccacggcccccgtgtacggttcgggcgattgtaataaaggacctacgtggacgtacggcccgtcgagggtactcccgtaggacgacgtattctactggcctaccgtaggtcgacgggaacgtaacgggtaccacgtaagtttccggactacgtccgagtgggtacgtcgtacgggacgtaagacgggtacgagggccgttagtacgttaacttagtacgtagtaacgttaccgaaacgtacgaaccgtaaccgttaagttaccgggtttaactttaacgttaccgttaacggtttaccggaaaccgtttcgggacccgttaaacccggtaacggtttacccgtaacccgggtttcccggttaacggggtacctaaccgggtaaccccggtaaaccggtaacccccgaaacccccgttacggttaccggttaaaccccg

SEQ ID NO: 129984 - DNA, 665 bp, Homo sapiens
  misc_feature: GYAE6OF02J0UCZ.49.52.E08.1.454.CMB.1.raw
  modified_base (288)..(288): a, c, t, g, unknown or other
  misc_feature (288)..(288): n is a, c, g, or t
tcagagtcgagagacacgaccggtgctcgatttagtcgagctctcagagagaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgatatgcttattggtaccagcaggaagccgggccagggcccctgtgttggngatgtataaagacactgagacgccctgacgggactcccgtgacgcggtattccgtcgtaggcctaccgacgggttcgaacgggggtaaccaaccggggttaccaccgtaacgtttcgggaccctagtaccgtaaggttcgggaacggttacccgaagggacgaaacgggtacggggaaaccggacgggccttacgggtaacctttaagtttattacggttacaaacgttaccgaaacgaacgaaccgtaacctaggtttacggttacctttaagtgttaccgttacggaactcgacgtacccgtaaggtcctacccggtaccgttcgggtaccacggtccccgaaacggtaccccaacccccgtagttccgtacccg

SEQ ID NO: 129985 - DNA, 726 bp, Homo sapiens
  misc_feature: GYAE6OF02I089Y.49.52.E08.1.454.CMB.1.raw
  modified_base (247)..(247): a, c, t, g, unknown or other
  misc_feature (247)..(247): n is a, c, g, or t
tcagagtcgagagacacgaccggtgctcgatttagtcgagctctcttcggtcgggggggggtcacgaagacggcagcgctctcgggacgtctccaccagtggcctgggctctgctagctcctcactctcctcactcgaggtacacagggtcctgggcccgtagtctgcccttgtaactcgagcctgcctccgtgtctgggtctcctggacagtcggatcacgactcgtccgtgccacgtagaaaccngcagtgatggttaggaacttacgttaaccttttcttccgtcggttaccaacaactacccgaggtcaaaccgccccaaacgtcactcgtatttagtcgaggccgtagtcgacggccggcctacgaggggttctcgtgacgttcgtcttcttacgtgtcctaccacgttcgtacggctacggccgaaccggtccctaccgtcgtaacctaacctcgtacgtcgggaccttacccggacgggaccggttacggggaaccgtacggtcgttagtaacttttagtttacgttcggtcttagttaccgagttaacgtccggtacggttgtaagttacgggttacggaaccggttaaggggttccgggttacggggacgggtaaggggtaaccgtaaaaggggtccgtaacccggggttacccgtaacgggttaccgaaccggtaccgacgggtacccgtcccggtacccccggtaggtaaccccg

SEQ ID NO: 129986 - DNA, 543 bp, Homo sapiens
  misc_feature: GYAE6OF02IYWA6.49.52.E08.1.454.CMB.1.raw
  modified_base (419)..(419): a, c, t, g, unknown or other
  misc_feature (419)..(419): n is a, c, g, or t
  modified_base (446)..(446): a, c, t, g, unknown or other
  misc_feature (446)..(446): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaaaccgatatgtcttattggtaccagcagaagcccggcacggcccctgtgttggtgatgtaataaagacactagagacggccctagagggactcccgtgacgcgtattctctcggctacgaggtcgacgggacaacggtcactgttcggcctagtctaggtggactccgaggcaggaggacgngctagtacttattatgtacaatacaanacgacactagttgtacgttatcgtacgttcgaactgacgaaccgtaaggtccaccggtcgtcggacacgtacccaacggcccaaccctgtactaccg

SEQ ID NO: 129987 - DNA, 632 bp, Homo sapiens
  misc_feature: GYAE6OF02F4HKH.49.52.E08.1.454.CMB.1.raw
  modified_base (224)..(224): a, c, t, g, unknown or other
  misc_feature (224)..(224): n is a, c, g, or t
  modified_base (230)..(230): a, c, t, g, unknown or other
  misc_feature (230)..(230): n is a, c, g, or t
  modified_base (250)..(250): a, c, t, g, unknown or other
  misc_feature (250)..(250): n is a, c, g, or t
tcagagtcgagagacacgaccggtgctcgatttagtcgagctctctcggcgggggggtcacaagaggcagcgctctcgggacgtcgtccaccatggcctgggctctgctgctcctcactctcctcactcaggacacagggtcctgggcccagtctgccctgactcagcctgcctccgtgtctgggtctcctggacagtcgatcacatctcctgcactgaaaccngcagtnatgtggaattatacctttcnctgtaccaacaacaccaggcaaagcccccaaatcaatcatttatgacggccgatcgagccggtccctcgaggggttctcgtgactccgtcttctctcggcctccgacgttctaggctacgcacggccctccgtgaacctaatccgtctgggtccctccgaggccgttacggggaccgaggcctagtacgtttaattacgttcgtctttacggttctaacgttacgtacggtacccggttagtaacgttacgggtcggacccggtaaagggttccgggttacgggtaccgggtagggacccgtaagggtcgaacccggttccgtaacggttcccgaacgttccccggaaagggtccctaccggtccccccgttggttaccccg

SEQ ID NO: 129988 - DNA, 689 bp, Homo sapiens
  misc_feature: GYAE6OF02H1WYZ.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctctcactctctgcacaggctctgaggcctcctatgagctgacacacgcccacccgtggtcgtcagtccgtcccgaaggacaggaccggaccaaggacttaccaccgtgcctcgtagggatagtcgactagttccgaaccaaaaccgtattacgtcgtactttagttacggtaaccagacgaacggaacggcccgggaccgaccggtccccgttggttcggttcggtagtagttagttaaagtaaacggacctaacgtaggaacggaccggtccctacggacggtacctcccgtaggtacgaccgttacttccgtcgtcggtccgttaccgaggtacggacgggaacgtacggtacacgtagtcggactagtcgaggtgacgacgaggacgaggaacggcgaggtcgagttacttaagttcgttagtacaaactacgaacgacgtaccgacttagttacgttaacttgtacgttcgtacgactcggaaccctacggtaacgtacccgtacggtaccgttacgggtacccacggaccccgaacgccccgtaaacccgcgttacgtacccg

SEQ ID NO: 129989 - DNA, 566 bp, Homo sapiens
  misc_feature: GYAE6OF02IN853.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctggagatgcattcgaccaaaaccgatatgcttattggtaccagcagaagccgggccaggcccctgtgttggtgatgtataaagacactgagaggccctgagggatcccgtgagcgattctcgtggctcgaggtcgagggacaacggtcacagttcggcctagtcgagtggagtccgaggcgaggaggacggaggctagaacttattagttgtacaatcaaacagacaccagttgtactttagtcgtcgttacgaactggaccgaaccgtaacggttaccacccgttccggtacgggttaccacggccccgaaaccggaccccaaacccccgtacgtaccgtaccccg

SEQ ID NO: 129990 - DNA, 628 bp, Homo sapiens
  misc_feature: GYAE6OF02HV8D4.49.52.E08.1.454.CMB.1.raw
  modified_base (234)..(234): a, c, t, g, unknown or other
  misc_feature (234)..(234): n is a, c, g, or t
  modified_base (249)..(249): a, c, t, g, unknown or other
  misc_feature (249)..(249): n is a, c, g, or t
  modified_base (320)..(320): a, c, t, g, unknown or other
  misc_feature (320)..(320): n is a, c, g, or t
tcagagtcgagagacacgaccggtgctcgatttagtcgagctctctaggtaggagtaaagggggtgggtccaggaggcaggaactctggggtgtctcgaccatggcctgggatcccgtctacttctccccctctctactctctagcacgagggcctctgaggcctctatcgagctgacaccagaccacctcggtgtcagtgtcccaggacagacgcaggatcactgctctgtantgcagtagcaaacgntagtgacttatgttaccagtccagaacgccggccacggtcccttgtgttggtaggagtacgtagtaacgcnctagagacgccctgacggactccctagacgtctaccttcgtctcggtcctacgaggtcgaacgggacctaacgggtcgacgtaagttcgggaccgacgtcgaagtcgggacgtaccggaggacgaggaacggtaacggaggacgttagtaccgttaattacgttaggtaccaagtacgaaacgtaacggaccgtaaccttaagttacggtactttaagtcgttacgttcgaacttcggaccgaccgtaaggtccctacggtccgtaggtaccgacgaccccgaacgaccccaaacctccgtagtaccc

SEQ ID NO: 129991 - DNA, 554 bp, Homo sapiens
  misc_feature: GYAE6OF02IUW36.49.52.E08.1.454.CMB.1.raw
  modified_base (223)..(223): a, c, t, g, unknown or other
  misc_feature (223)..(223): n is a, c, g, or t
  modified_base (313)..(313): a, c, t, g, unknown or other
  misc_feature (313)..(313): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgccaaacgatatgcttattggtaccagcagaagccgggccaggcccctgtgttggtgatgtataaagacactgagaggccctnagggatccctgagcgattctctggctcaggtcaggggacaacggtcacgatttgcatcagtggacgtcgaggcagaggacgaggctgactattattgtcaatcaactagaccaactagttacgtactttatcgttacgttacggaacttgacccgtaacgtaacgggttccaacccggttccgttacggggttaccaccgggtacccaaacggaccccaaaccccctacgtcggtaacccg

SEQ ID NO: 129992 - DNA, 511 bp, Homo sapiens
  misc_feature: GYAE6OF02GKO5N.49.52.E08.1.454.CMB.1.raw
  modified_base (223)..(223): a, c, t, g, unknown or other
  misc_feature (223)..(223): n is a, c, g, or t
  modified_base (240)..(240): a, c, t, g, unknown or other
  misc_feature (240)..(240): n is a, c, g, or t
  modified_base (315)..(315): a, c, t, g, unknown or other
  misc_feature (315)..(315): n is a, c, g, or t
tcagagtcgagagacacgaccggtgctcgatttagtcgagctctcagagagaaagggggtgggtccaggaggcagaactctgggtgtctcaccatggcctggatccctctacttctcccctcctcactctctgcacaggctctgaggcctcctatgagctgacacagccaccctcggtgtcagtgtcccccaggacagacggccaggatcacctgctctgganatgcattgccaaaccgntatgcttattggtaccagcagaagccgggccaggccccctgtgttggtgatgtataaagacactgagaggccctnagggacccctgagcgattctctggctccagctcagggacaacagtcaccttgacctatcagtggacgtccggccagaggacgaggctgactattactgtcagtccgcagacagcaagtggcagttatgtcgtattcgggcggagggtactacggctcggaccgtcgtacggtcacgcccgaaggctcgtcccccgg

SEQ ID NO: 129993 - DNA, 535 bp, Homo sapiens
  misc_feature: GYAE6OF02IA5QL.49.52.E08.1.454.CMB.1.raw
  modified_base (295)..(295): a, c, t, g, unknown or other
  misc_feature (295)..(295): n is a, c, g, or t
tcagagtcgagagacacgaccggtgctcgatttagtcgagctctcagagagaaagggggtgggtccaggaggcagaactctgggtgtctcaccatggcctggatccctctacttctccccctctcactctctgcacaggctctgaggcctcctatgagctgacacagccaccctcggtgtcagtgtccccaggacagacggccaggatcacctgctctggagatgcattgaccaaaaacatatgcttactggtaccagcagaggccaggccaggcccctgtcttggtgtatttanaaagtactttgagaggccctcgacgggacccctgagcgtattctcgtggctccagctcagggacaacagtcaccttgaccatcagtcggagtccggcagaggacgaggctgacttattacgtgtcagtccacgagacaggcaggtgcgtagttagtgtcgttagttcgggacgggagggtacgtacgccgtcgacccgttccgtaggtccacgacccgaaggcctacccggcccctccgg

SEQ ID NO: 129994 - DNA, 658 bp, Homo sapiens
  misc_feature: GYAE6OF02IDOPZ.49.52.E08.1.454.CMB.1.raw
  modified_base (223)..(223): a, c, t, g, unknown or other
  misc_feature (223)..(223): n is a, c, g, or t
  modified_base (310)..(310): a, c, t, g, unknown or other
  misc_feature (310)..(310): n is a, c, g, or t
  modified_base (470)..(470): a, c, t, g, unknown or other
  misc_feature (470)..(470): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacagggtcctgggcccagtctgccctgactcagcctgcctccgtgtctggtctcgtggacagtcgatcaccatctctgcactgaaaccngcagtgattggttaggaatttacttaaccttttctcctagtaaccaacaaccacccaggaccaaacgaccccaactcatctattagngagccatcacgcgcctcgagggtctgtgactcgtcttctcgtgcctccgtacgtcgtcgcacgccaccgtcctcccgtagactactccgtcgtcggtcctcggacggcggtacggggacggacgtcgttagttaatttagttacgttcgtcttcgtttanagttacgtacgggtccgggttagtaacggttagggtaccggggtacgggtaacggggtttgggttccggggacggggtaacgggtaccgtaaacggggttccgtacccgggttaaccgttacgggtaccgtaaccggtaccccggaagggttcccccggtaacccggtccccccgttacggttacccg

SEQ ID NO: 129995 - DNA, 648 bp, Homo sapiens
  misc_feature: GYAE6OF02GYEMN.49.52.E08.1.454.CMB.1.raw
  modified_base (249)..(249): a, c, t, g, unknown or other
  misc_feature (249)..(249): n is a, c, g, or t
tcagagtcgagagacacgaccggtgctcgatttagtcgagctctcagagagaaagggggtgggtccaggaggcagaactctgggtgtctcaccatggcctggatccctctacttctcccctcctcactctctgcacaggctctgaggcctcctatgagctgacacagcccaccctcggtgtcagtcgtccccaggacagacggccaggactcacctgctcgtggagatgctattcgacccaaaaccgtntatgtcttagttggtaccagcgaagaacggccgggaccgacggcccctggttcgttgggtgagtgtaataaagactactggagacgcctcgagggactccgtgagcgtattctgtcggcctcgaggtacgacgggaaccaacggtccacgtattcggacctatacgaggtacggacgtccgaggtacgagggaacggacggagggctaggtactttaagttacgtttcgacgtacggtcccgacgtaacgaccgacggacgtaaggtcgggtaactaggtttaatcggttacggttacgttacggggaccgggtagggtaccctacggtcccgttaacgggacccgttaccggtacggttacccggaaccggtacccggtaacgggcccttaccccggg

SEQ ID NO: 129996 - DNA, 661 bp, Homo sapiens
  misc_feature: GYAE6OF02I80HM.49.52.E08.1.454.CMB.1.raw
  modified_base (480)..(480): a, c, t, g, unknown or other
  misc_feature (480)..(480): n is a, c, g, or t
tcagagtcgagagacacgaccggtgctcgatttagtcgagctctcagagagaaagggggtgggtccaggaggcagaactctgggtgtctcaccatggcctggatccctctacttcctcccctcctcactctctgcacaggctctgagcctcctatgagctgacacacgcccacccgtcggtgtacagtcgtccccaggacacggacggccaggactcacctgctcgtggagatgctatcgaaccaaaccgattactgtactttaagttcggaccagcaaggaacggcccggccacggtccctggttggttggtgatagtaataaacgacacgtggacgtacggccctagaggtactccgagacgtcgtattcctgtacggtcctaccgagggtacgaacgggaacgtaaccggtcaacgtagtttcggacctaagtacgtaaggtcgggaactccggaacggcgaagggacggaaccggnggtaccgtaggtaaactttagtttaacgttcggtacaaacgttaccaaagacgtaaccctaagtagttacggtacttagttcgttaacgtacgtaacgtcgaccgaacgtacggtcctaacccgggttcgtcgggtaaccacccggtaccgtaaccgaccccaccccgttactcgtacccg

SEQ ID NO: 129997 - DNA, 513 bp, Homo sapiens
  misc_feature: GYAE6OF02F18W1.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccggcaggcccctgtgttggtgatgtataaagacactgagaggccctcagggatccctgagcgattctctggctccgaggtcagggacacggtcacattggccatcagtggagtccaggcaggacggacgaggctagacttattatgtcaatcagcagacgacggtgtactagtcgggtgttcggacggaggacaagcgtacgaccgtcgtaggtacgacggccaaggcctccgtccccgtggtaccc

SEQ ID NO: 129998 - DNA, 501 bp, Homo sapiens
  misc_feature: GYAE6OF02FRV6U.49.52.E08.1.454.CMB.1.raw
  modified_base (241)..(241): a, c, t, g, unknown or other
  misc_feature (241)..(241): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccgntatgcttattggtaccagcagaagccgggccaggcccctgtgttggtgatgtataaagacactgagaggccctcagggatccctgagcgattctctggctcaggtcagggacaacggtcacattgccatcagtggagtccaggcagaggacgaggctgactattattgtcaatcaacagacaccattgtactatatcttacgaactgacgactaaggtcaccgtcctgggtacacgcccaaggcccaaccccgatgtacc

SEQ ID NO: 129999 - DNA, 542 bp, Homo sapiens
  misc_feature: GYAE6OF02GRIXC.49.52.E08.1.454.CMB.1.raw
  modified_base (239)..(239): a, c, t, g, unknown or other
  misc_feature (239)..(239): n is a, c, g, or t
tcagagtcgagagacacgaccggtgctcgatttagtcgagctctcagagagaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgntatgcttatggtaccagcagaagccgggccaggcccctgtgttggtgatgtataaagacactgagagccctcagggatccctgacgcgattctctggctccaggtcgagggacaacggtcacagttggccatcagtggagtcaggcagagggacgaggctagactagttattgtacaatcaaacacgaacactaagttcggttaacttagtcgttacttcggaactacgacgaaccgtaacggtcctaccggtccttcgggtacacggtcccgaaacggccccaaccccgacgtccgtacccg

SEQ ID NO: 130000 - DNA, 575 bp, Homo sapiens
  misc_feature: GYAE6OF02FOYGM.49.52.E08.1.454.CMB.1.raw
  modified_base (223)..(223): a, c, t, g, unknown or other
  misc_feature (223)..(223): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattcgaccaaaccgatatgcttattggtaccagcagaaggcccgggccaggcccctgtcgttggtgatgtaataaagacactgagacggccctcgagggactccctgagcgtattctcgtcggctcgaggtcgacgggacaacggtcacgtagtcggccatcaggtggagtccgaggcgaggaacggacggaggtcgtagacttagttattgtataactacaacagaacactagttacgttacttattacgttcgttacgaacgttcgacgaacgtaacggacctacccgtacgtcgggtacgtaccggtaccgaaaccgggaccccaacccgtaccgtagtaccccg

SEQ ID NO: 130001 - DNA, 554 bp, Homo sapiens
  misc_feature: GYAE6OF02GXBDC.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgtcttattggtaccagcagaagccgggcacggcccctgtgttggtgatgtataaagcaatgagacggccctagagggactcccgtgacgcgtattctcgtggctcgaggtcgagggactaacggtcactagttcggcctatcgagtcggactccgaggcaagaggacgaggtctagacttattatgtacaatcaacacgacactattagttacttagtcgttacttcggaactcggacaaccgtaaggtcctacccggtccgtgggttacacggtcccgaaacggccccgaaccccgtactacggtaccc

SEQ ID NO: 130002 - DNA, 779 bp, Homo sapiens
  misc_feature: GYAE6OF02GQK1I.49.52.E08.1.454.CMB.1.raw
  modified_base (243)..(243): a, c, t, g, unknown or other
  misc_feature (243)..(243): n is a, c, g, or t
tcagagtcgagagacacgaccggtgctcgatttagtcgagctctcagagagaaaggggtgggtccgaggaggcgagaactctgggtgtctcaccatggcctggatccctctacttcctcccctcctcactctctgcacagctctgaggcctcctatgagctgacacagccaccctcggtgtcagtcgtccccaggacagacggccaggatcacctgctctggagatgcattgacccaaaacgntatgcttattggtaccagtcagaagccgggaccacggtccccctggtcgttcggtacgatggtaataaaagtcaacgttggaagacggtaccctgacggggtaactcccgtaggacgtacgaacttccgtcgtcgggttacctccggtaacggttccgaacggggtaaccgtaaaccgggtaccaacgttacgtttcgggaccctaacgtaccggtaacggttagggtaaccgttaccggaacgggacgtaacgggaagggaaccggacggggtactacggtaaaccgtttaattaacggtttagtaccgtaaagttaaccgaaacctaacggtaaaccaacccgttaagtttaccgggttaaactttaacgtacggtttaccgtttaacggtaaaccgttcggaaccgtaaccccgggttaaacggttaacccgtaccccgggtttaacccgttacggggtttacccgaaccgggtacccccgttaaaaccggggaccccctaaaccccccggttaagttccccggttaaacccg

SEQ ID NO: 130003 - DNA, 669 bp, Homo sapiens
  misc_feature: GYAE6OF02HKJAE.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctactttctcccctcctcactctctgcacaggctctgaggcctctatgagctgacacagccacctcggtgtcagtgtcccaggacagacgcaggatcacctgctctggagatgcattcgacaaagcaaatatgcttacgtcgtaccagcaagagccaggccacggccctgtcttgactactatttaataaagtactttagagagggacctcgaacgggaccctggacgacgtacttctcgtcggtccttaccgacgtcttacgaacgtaccgaaaccgaaacgtacgtacgtacggtttacgaacctaaagtaccgtaaggtacgggtaccgggtaccggggacgaaacgggaacgggtaaccgggagggaaccgttacgggaaacttttaaccgttaagttacggtaccgtaacggttactaaccgttacgaaacgtaacgtaacggttaagtcgggtacctacgttcgtacggttagttacggttcgggaacgggtacggacgtaacggtccgtacggtcccgtacgttaacgggtacaaccggtaccgaagggtcccg

SEQ ID NO: 130004 - DNA, 581 bp, Homo sapiens
  misc_feature: GYAE6OF02HMBLT.49.52.E08.1.454.CMB.1.raw
  modified_base (225)..(225): a, c, t, g, unknown or other
  misc_feature (225)..(225): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgganatgcattgaccaaaccgatatgcttattggtaccagcagaacgcccggccaggcccctgtgttggtgatagtaataaagacactgagacggcccctagacgggactcccgtgacgcgtattcctctggcctccgaggtcgaagggaccaacggtacactagtttcgacctatcgagtggatccgaggcgaggaggacgaggcgtagtacttagtttattgtaacatacaaacgagaaccacctagttacggttactttaagttcgttacttacggaacttgaaccggtaccgtaacggtccaccggttaccgtcgggtaccacggtacccgaacgacccccaccctacgtctaccc

SEQ ID NO: 130005 - DNA, 561 bp, Homo sapiens
  misc_feature: GYAE6OF02IWL6H.49.52.E08.1.454.CMB.1.raw
  modified_base (242)..(242): a, c, t, g, unknown or other
  misc_feature (242)..(242): n is a, c, g, or t
  modified_base (460)..(460): a, c, t, g, unknown or other
  misc_feature (460)..(460): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcactgctctggagatgcattcgaccaaaaccgntatgtcttaattaggtaccagtcaagaagcccgggaccaggcccctgtgttggtgatagtataaagacactgagacggccctgagggactacccgtgacgcgtaattctcgtcggctccgaggtcgaagggacaacggtcaactagttcggacctatcgtaagtggacgtcgaggcaggaggacgaggtcttagacttattagttcgtacaatacaanacgacacctagttacgtacttagtctcgttacgacttagacgtaccgaacggtacaccggttcgtcggtacacgacccgaacggcccaacccactcgtacc

SEQ ID NO: 130006 - DNA, 779 bp, Homo sapiens
  misc_feature: GYAE6OF02IP1V6.49.52.E08.1.454.CMB.1.raw
  modified_base (214)..(214): a, c, t, g, unknown or other
  misc_feature (214)..(214): n is a, c, g, or t
  modified_base (260)..(260): a, c, t, g, unknown or other
  misc_feature (260)..(260): n is a, c, g, or t
tcagagtcgagagacacgaccggtgctcgatttagtcgagctctcagagagaagggggtgggtccaggaggcagaactctgggtgtctcaccatggcctggatccctctacttcctccccctctcactctctgcacaggctctgagcctctatgagctgacacacgcccaccgtcggtcgtcaggtctacccccgaggacaggaccggccaggntccgaccgtgctcgagggatatggactattcggacccaaaaccgtntagtcgtactttagtacggtaccagacgaaggaccggccggaccaccggtcccgtggttggttggtgtagtagtaacgtaagaccgtagtagtaacgaccggtaccgtacggacggtacctaccggtaggacgtcgtacttcgtacgtcggtccgtacggtacggtacggaaccggtaacgtaaccggccgtaacgttacgtaccgtacccgtacgtaccgtacgggtacgggaccgtaaccggaggaccgggtaacgggaacggggtacgtacggtaccgttaacggtacgtttaacgttaacgttaccgtaactaaacctacggtaacctaaccgaacccctaacggttaacgtttacggttaaccttacggttaccggttaccgttaaccggtacttaccgggtaacccggttaacggtaaacccggtcccgttaacccgggttcggtaaccgggttacccaacccgggtacccggtaacccggtaacccccgaccggtttaccgtaccgtacccg

SEQ ID NO: 130007 - DNA, 671 bp, Homo sapiens
  misc_feature: GYAE6OF02H6FQF.49.52.E08.1.454.CMB.1.raw
  modified_base (116)..(116): a, c, t, g, unknown or other
  misc_feature (116)..(116): n is a, c, g, or t
  modified_base (256)..(256): a, c, t, g, unknown or other
  misc_feature (256)..(256): n is a, c, g, or t
  modified_base (301)..(301): a, c, t, g, unknown or other
  misc_feature (301)..(301): n is a, c, g, or t
tcagagtcgagagacacgaccggtgctcgatttagtcgagctctctcggcggggggggtcacaagaggcagcgctctcgggacgtctccaccatggcctgggctctgctgctcctnactctcctcactcaggacacagggtcctgggcccagtctgccctgactcagcctgcctccggtgtctgggtctcctggacagtcgatcaccatctcctgcactgaaaccagcagtgactgttggaattataaccttttcncctggtaccaacaacaccagacaacgaccccaaatcatcatttangacgccatcagcggccctgagggtctctgatcgtccttctcgtaggcctccgacgtctcggtacagccaccggtccctcccgtagtacaacgtcctcgttcgggccttaccgacggtcggtacgggggacgtacggtccgttaggttaactttagtttacgttcgtacttacggtttctaacgttaacgttcgggtacccggttaggtaacgttacgggttcgggaccgggtaaggggttcgggtttaccggggaccggggtaaccgggaacccggtaagggttacccggtaccgggttacccgtacgggtaccgtaccggacccggaaaccgggtcccgttacccggtccccccggttacggtaccccg

SEQ ID NO: 130008 - DNA, 645 bp, Homo sapiens
  misc_feature: GYAE6OF02GZ7WG.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctggagatgctattcgaccaaaccgatatgtctttagttggtaccagcaggaacgcccgggccacggcccctgtgttggtgatagtaataaacgacacgtggagacggccctacgagggactcccgagacgcgtattctcgtcggctccgaggtcgagggacgaacggtcacgtacgttacggcactcgaggtggacgtcgaggtcgaggacggacggaggcgtagtacttaagttcttagtacaattaccaaacgaacgacctaacctagtttacggttaactttacgttacgtttaccgttaacggtaaccgtcggaaccgtaaccggtaacgggttcccctaacccgggttcccggtacggggttacccaaccggaccccgaaaccgggaccccctaaaccccggtaccgttaccggtaacccc

SEQ ID NO: 130009 - DNA, 511 bp, Homo sapiens
  misc_feature: GYAE6OF02JFW08.49.52.E08.1.454.CMB.1.raw
  modified_base (483)..(483): a, c, t, g, unknown or other
  misc_feature (483)..(483): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcgagggatccctgagcgtattctctggctcaggtcagggacacggtcactattggccatcagtggagtccaggcaggaggacgaggctgactattattgtacaatcaacagacacctagttcggtacttatgtcttacgactgacgacgaaggtcaccgtcctgggtccncgacccaaggacccaacccactcgtacc

SEQ ID NO: 130010 - DNA, 572 bp, Homo sapiens
  misc_feature: GYAE6OF02HSN1X.49.52.E08.1.454.CMB.1.raw
  modified_base (226)..(226): a, c, t, g, unknown or other
  misc_feature (226)..(226): n is a, c, g, or t
tcagagtcgagagacacgaccggtgctcgatttagtcgagctctcagagagaaagggggtgggtccaggaggcagaactctgggtgtctcaccatggcctggatccctctacttcctccccctcctcactctctgcacaggctctgaggcctcctatgagctgacacagcccaccctcggtgtcagtcgtccccaggacagacggccaggatcacctgctctgganatgcattgaccaaaaccgatatgtctttagttcggtaccagcaaggaacgcccggccacggcccctgtgttggtgatgtaataaagacacgtgagacggccctagagggctcccgtagacgcgtattcgtctggcctacgacggtcgaagggacaacggtcacgtacgttcgaccatcgtagtcggacgtcgaggacgaaggaggacggaggctacgtacttagttatgtactaatacaacagtaacaccttattcgtaattgtagttcgtacgactgaccgaacgtaacgtccgtccggtacgttcggaccaacggacccgaacggaccctacccgtatcgtacc

SEQ ID NO: 130011 - DNA, 568 bp, Homo sapiens
  misc_feature: GYAE6OF02FZS8X.49.52.E08.1.454.CMB.1.raw
  modified_base (224)..(224): a, c, t, g, unknown or other
  misc_feature (224)..(224): n is a, c, g, or t
  modified_base (366)..(366): a, c, t, g, unknown or other
  misc_feature (366)..(366): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgcctctgganatgcattgaccaaaaccgatatgcttattgtacagcagaagccggccaggcccctgtgttggtgatgtataaagacactgagaggccctgagggactcctgagcgattctctggctccgaggtcagggacaacggtcacgtnttggccaatcaggttaggagtccgaggcaggaggaacgaggctagacttagttattgtctaaatcaaacagaacaccgtaatttaggtacttagttgttacttaccggaattcgacgtaccgtaaaggtaccgtacccggtccgttggggtacccaacggtaccccgaaacgggacccctaaaccccgtacgttcgtaaccc

SEQ ID NO: 130012 - DNA, 605 bp, Homo sapiens
  misc_feature: GYAE6OF02JYQ9E.49.52.E08.1.454.CMB.1.raw
  modified_base (252)..(252): a, c, t, g, unknown or other
  misc_feature (252)..(252): n is a, c, g, or t
  modified_base (499)..(499): a, c, t, g, unknown or other
  misc_feature (499)..(499): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggactcgacctgctcgtggagactgctagttcgaccaaaaaccgnttactgtctttaatggtaccagcaagaacggccggaccaggcccctgtgttggtgattgtaataaagcactgagacggtccctcgagggtaacttcccaggacgcggtaacttctacgtcggccctacggacggttcgaacgggaccgaaacggtccaacgtcgtttacgacctagtacgagtacggacgtccgaggcgaggaacggacggaggtctcggacttattacgttgacagttacaacganaacgactagttacgttaacttgtacttcgttacgactgacgaccgaaggttccaccgtcgtcgggtaccacggacccgtaaccgaccctacccgtcgtcgtacccg

SEQ ID NO: 130013 - DNA, 902 bp, Homo sapiens
  misc_feature: GYAE6OF02HD5BU.49.52.E08.1.454.CMB.1.raw
  modified_base (244)..(244): a, c, t, g, unknown or other
  misc_feature (244)..(244): n is a, c, g, or t
tcagagtcgagagacacgaccggtgctcgatttagtcgagctctctcggcggggggggtcacaacgaggcagcgctcgtcgggacgttctccaccatggcctgggctctgctgctcctcactctcctcacttcgaggacaactaggggttcctgggcccagtcttagccctgactcagcctgcctccgtgtcgtgggtctccgtgggacagtcgactcaccagtctcctgacactacgaaaccncgcgagtcgatcggtttagggtaactttacttaaccctttttcgtaccgttacggtaacccaaaaccgtaaaccaaccccgtacgggaacccaaaaacccggtaccccccccgtaaaacctaccaaacgttaccgtaaacgtttttaacgacggggtaaccgggtcccggtaagttaccggaacgggcccgggttaccccgtttacgggtaacgggggttccttaccggttacgggtaacggttccgttacgttttccgttccgttacgggtccttaccgtaccggttccggttacgggaccgtacggcccgggaacccggtccccgtttaccccgtaggtaaccctaacgttccgttaccggtccgggtacccttacccggaacgggtccgggtacgggggaaccggtacggtcgttacggttaattttacgttacgtttcggtactttacggtttacacgtttacggtcggtaccgggtagttacggttacgggttacggggtaaccggttaaggggttcgggttaccggggaacgggggtaacgggtaaaccggtaacggggttaccggtaacccgggttaccgtaacgggtacccgtaaccgggttacccggaacgggttcccggtacccggtcccccggttagggttaccccg

SEQ ID NO: 130014 - DNA, 702 bp, Homo sapiens
  misc_feature: GYAE6OF02FPUG1.49.52.E08.1.454.CMB.1.raw
tcagagtcgagagacacgaccggtgctcgatttagtcgagctctctcggcgggggggtcacgaagaggctagcgctctcgggacgttcgttccggaccgactgggcctgggctctgcgtgctcctcactctcctcactccaggactacaccggtcctcggcccagtctgccctgactcagcctggccctccgtgtctgggtctcctggacagtccgactcgaccatcctcctcgccacgtacgaaaccaggccagtgatcggttggaattacttacgtttctctcggtaccaacaacaccgagacaaacgaccccaactctatctaattagtcggacggaccgactacgacgccgcccgtgtacgggttctacgtcgtaacttccgtacttcgttcgtacggtccgtcccgacggttaccggtccggtcgacgaccgtaaccggttcccctcccgtacggtaacctaacctccgtaccggtccggtaccgtccggaacgggtaccggtacggggtaccggtacggtccgttacggtaatttacgttagttcggtaccgtttcggttaacaggttacgcggtccggtagttagtacggttacgggacggttaagggttcggttacggaccgggaggtaaccgtaagggcggtaccgttacggcgtacgacgtccggtaggtcccgtcggcccgttggtacccg

SEQ ID NO: 130015 - DNA, 581 bp, Homo sapiens
  misc_feature: GYAE6OF02HQGMU.49.52.E08.1.454.CMB.1.raw
  modified_base (398)..(398): a, c, t, g, unknown or other
  misc_feature (398)..(398): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattgtaccagcagaagccggccacggcccctgtgttggtgatgtaataagacactgagacggccctcgagggactcccgtgacgcgattcctcgtggctccgaggtcgagggacaacggtcactagtcgctatcgagtggacgtcgaggngaaggaggacgaggctaggtacttagtttattggtactaatacaaacgacgtaaccaaccgttagttacggttaactttagttcgttacgttaccggaactcggtaccgaaccggtaacggtcctaccggttcggtacgggtacgacggaccccgaaaccggccccaacccgtctaccgtacc

SEQ ID NO: 130016 - DNA, 736 bp, Homo sapiens
  misc_feature: GYAE6OF02H2GSB.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttcctcccctcctcactctctgcacaggctctgaggcctcctatgagctgacacagcccacccgtcggtgtcagtcgtcccaggacaggacggccaggatcactgctcgtggagatgctaattcgaaccaaaaccgtataactgtactttagttacggtaacagacgaaggaacggccgggaccacgggtccccgtaggttcggttggtcgtaagttgtaaagtaaaacggacacgtaggaaggtaccggcccttacggaacgggtacctaccccgtaggacgtacgtacttcttacggtcggtcctaccggtacgggtacgaacggggaaccgtaacggtactaacgtacgtttacggacctagtacgtaggtacggacgtaccgaggacgaaagggaacggacggacggtacttaaggtaactttaagtttaacttacgtaactaaaccgtaacaaaccgtaacgaaccctaaccgttaagtttacggttaactttagttacgttaccgttaacggaacgttacgggtaacaccggtaaacggtcccgtaacccggttacgtaccgggtaccaaccgggtaaccgaaaccccggacccctaaacccttcgttacgtaacccg

SEQ ID NO: 130017 - DNA, 612 bp, Homo sapiens
  misc_feature: GYAE6OF02GR35Z.49.52.E08.1.454.CMB.1.raw
  modified_base (225)..(225): a, c, t, g, unknown or other
  misc_feature (225)..(225): n is a, c, g, or t
  modified_base (300)..(300): a, c, t, g, unknown or other
  misc_feature (300)..(300): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgatgttggaattataacctttctcctggtaccaacaacaccaggcaaacgcccccaaactcatcatttangaggccgatcagcggccctcgaggggtctctgatcgcttctctgctccacgtctggcagcacggcctcctagacatctcgtcgggctccgaggcgtggggacgaggtctgtacttagttattgcttgttcaattacgtcggtaccggtgtaacgttagggtacgggaccggtaaggggttcgggttacgggacggggtaacggggaaccggtaaaggggttccggtaacccgggttccggttaacgggtacccgaacgggtaccccggtaacgggtccccgtacccggttacccccccggtcgggttacccc

SEQ ID NO: 130018 - DNA, 565 bp, Homo sapiens
  misc_feature: GYAE6OF02GYG48.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaaaccgatatgcttattggtaccagcagaagccgggccaggcccctgtgttggtgatgtaataaagacactgagaggccctgaggactcccgtgacgcgattctctggctcgaggtcagggacaacggtcacgattcggccatcgagtggacgtccaggcaggaggacgaggctgacttattattgactaatcaacagacacctagttacgttacttatcgttcttacggacttcgaccgtacgtaacgggtcctaacccgggttcccgttaggggtacccaacggtccccgtaaaccgggaccccaacccccgtacgtaccgtacccg

SEQ ID NO: 130019 - DNA, 610 bp, Homo sapiens
  misc_feature: GYAE6OF02IQQPB.49.52.E08.1.454.CMB.1.raw
  modified_base (305)..(305): a, c, t, g, unknown or other
  misc_feature (305)..(305): n is a, c, g, or t
tcagagtcgagagacacgaccggtgctcgatttagtcgagctctctcggcggggggggtcgacaagaggcagcgctcgtcgggacgtctccaccatggcctgggctctgctgctcctcactctcctcactcaggacacagggtcctgggcccagtctgcctgactcagcctgcctccgtgtctgggtctcctggacagtcgatcaccatctcctgcactgaaaccagcagtgatgttgggaattataaccttttctcctaggtaccaacaacaccaggacaaacgcccccaaactcatcatttangaggccgatcgacgcggccctcgaggggtctctgactcgcgttctctcggctccacgtctggcacgcaccggtccctccctgaacactctcgtcgggcctaccgaggtcgtaggggacgaggcttaggtatttaagttagttgtctttggttacctagttacttcgggaccggttgaacgttgggtacgggtacccggtaaggggttccggttcgggacgggtaacgggacctaacggggtcgtaccggttccgtaggtccggaacgcccggaaggtccgtacccggccccgttaccggtacccg

SEQ ID NO: 130020 - DNA, 738 bp, Homo sapiens
  misc_feature: GYAE6OF02IWGEZ.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttcctcccctcctcactctctgcacaggctctgaggcctcctatgagctgacacagcccaccctcggtgtcagtcgtccccaggacagacggccaggatccacctgctcgtggcgatgctattcgaaccaaaaacagtatgacttaactggtaccaagcagacggccaggcctacggcccctgtcttggtctaagtttaataaaagtctttaggagtacggtccctaggacgggtaccccctggagaccggtattcgtacgtcggctacctaagccttacggaagggaacccaactacgtacctaacccgttcgaacctaacttaccgagggtttacggggaccgttaccccgggccgtaaacgggaacggggtaacggtaacgggaccgttacgggtaaaccgttaaacgttttaaccggtcgttaccgtacggtacccgtacgaacggtaccgaacggtaccgagggttacgggtaccgttaacgttaacggttcgttaaccgggtaacgtttccgggaccggggtaggggtaacccttaacgggaccgttcgggaacccggttaccgttaagggacctacccggtacccgaacgggttccgccccgttcccccgttacccggg

SEQ ID NO: 130021 - DNA, 600 bp, Homo sapiens
  misc_feature: GYAE6OF02HUDXA.49.52.E08.1.454.CMB.1.raw
  modified_base (222)..(222): a, c, t, g, unknown or other
  misc_feature (222)..(222): n is a, c, g, or t
  modified_base (370)..(370): a, c, t, g, unknown or other
  misc_feature (370)..(370): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggatctgaggcctcctatgagctgacacagccaccctcggtgtcagtgtccccaggacagacgccaggatcacctgctctgganatgcattcgaccaaaccgatatgcttattggtaccagcagaagccgggccaggcccctgtcgttggtgatgtaataaagacactgagacggccctcgagggactcccgtgagcgattctctggctcaggtcgaggacaacggtcaacnttcggcatcgagtggacgtcgaggcaagaggacgaggactcggaacttagttattgtacaaacgttcaaacgagaacctaaccgagtttacggtaactttaagtcggttactttacgggaacttggaccgtaaccgtaaacgggttcctaacccgggtcccgttaggggtacctaaccgggaccccgtaaaacgggaccccctaaacccccgtaccgttacggtaacccc

SEQ ID NO: 130022 - DNA, 799 bp, Homo sapiens
  misc_feature: GYAE6OF02JZM5Y.49.52.E08.1.454.CMB.1.raw
  modified_base (790)..(790): a, c, t, g, unknown or other
  misc_feature (790)..(790): n is a, c, g, or t
tcagagtcgagagacacgaccggtgctcgatttagtcgagctctcagagagaaagggggtgggtccaggaggcagaactctgggtgtctcaccatggcctggatccctctacttctcccctcctcactctctgcacaggctctgacggcctctatgagctgacacacgccctacctcggttgcagtcgtccccaggacaggaccggccagggactccacctgtcctacgtgggacgattgacctattacgaacccgaaaaccggtattagttcgtaccgttttaagttcggtaaccgacgacgtaagggaaacgggtccccggggacccgaacggggtcccccgttggttacggtttacggggtagtaagtttaggtaaactaaacggtaccacggttagggaacgtaccggacccctacggtacgggactacccggtggaccggtccgttacgtttcctacggttcggccgtttacggacgggggtcaacggggtacctaacgggtacctacttacggttcgacctttaagcggaagttcgggtacgaccgtagggacaacggggtacggacggacgggtactacgggtaaccttttgttaaaccgtagtaccgtaaatacccgtaaagtaaccggtaccctaaacggtacgttttaagttttaaccgttaacttcggttaccggttaacgtaacctcgggtaccgaaccgttaacggttacccgtaccgggttacccgtaacgggtccaacccgtaccggggaaccccttaaccccgaaccccggttntaccgtccc

SEQ ID NO: 130023 - DNA, 713 bp, Homo sapiens
  misc_feature: GYAE6OF02HMKUS.49.52.E08.1.454.CMB.1.raw
tcagagtcgagagacacgaccggtgctcgatttagtcgagctctcagagagaaagggggtgggtccaggaggcagaactctggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaaccgatatgcttattggtaccagcagaagccgggccaggcccctgtgttggtgatgtaataaagacacgtgagacggccctagagggactcccgtagacgcgtattctcgtcggcctaccgaggtcgaacgggaaccgaaacggtcacgtagtttcgggacctagtacgtagggtacggtacggtacccgaagggcgaagggtacgggaacggagggtccgttaaggtaaccgttaagttttaacgttacgtaacctaaagttaccaaaaccgtaacggtaacctaaccgtaagtttacgggtttaaacctttaaggtttcggtttaccgtttaaccgggtaaccttacgggtacccggtaaacccggtaaacgggttaccctaacccgggttaccggttaccggggtaccgtaacccggtaccccggtaaacccggtacccccctaaaacccccgtaccgttaccggttaaccccg

SEQ ID NO: 130024 - DNA, 589 bp, Homo sapiens
  misc_feature: GYAE6OF02G0JF6.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccggccacggcccctgtgttggtgatgtataaagacactgagacgccctcgagggactcccgtgacgcgtattctcgtggctccgaggtcagtcggaacaacggtacacgtagttcggcctagtcgtaggtacggtacgtccgaggacgaggaaggacggaggtcgtagtaacttatttacgttacgtactaactaccaaacgtacgaaccacctagttacgttaacttagtcgttacgtacgtacgtcgtaccgaccgtaacggtacctacccggttccgtacggtaccacggacccgtaaccggcccctaccctacgtaccg

SEQ ID NO: 130025 - DNA, 582 bp, Homo sapiens
  misc_feature: GYAE6OF02GO7GH.49.52.E08.1.454.CMB.1.raw
  modified_base (224)..(224): a, c, t, g, unknown or other
  misc_feature (224)..(224): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatgctattcgaccaaacgatatgtcttattggtaccagcagaagccggccaggcccctgtgttggtgatgtaataaagtctttagagacggccctcgacgggacccctgacgcgtattctcgtgctccagctcgagggacaacagtccaccttcgaccatcgagtggacgtccggacgagacggacggaggctagacttattactgtactacgtccgacgacgtacgagcgaggtggacgtagttactcggttacgtacgttcggggacggacgggtaccgtacggtcgttacggtacccgttccgtaaggtccaaccggtacccgaacggtcccgttacccggcccccgttacccgg

SEQ ID NO: 130026 - DNA, 631 bp, Homo sapiens
  misc_feature: GYAE6OF02HBLNH.49.52.E08.1.454.CMB.1.raw
  modified_base (224)..(224): a, c, t, g, unknown or other
  misc_feature (224)..(224): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctgganatgcattgaccaaaccgatatgtcttagttggtaccagcaagaacgcccgggccacggtcccctggtcggttggtgatagtataaagacacgtggagacggccctcgacgggtactcccgtaggacgccgtattccgtcgtcggacctccggaggtccgaacggggaccgtaacggtcaacgtagttcggaccattacgaggtggacgtcgaggcgaggacggacggaggccgtagtacttattagttacgtactaatccaaagacgacccaactagtttacggttaacttacgttgttaccgttacggtaacctacggaccgtaaccggtaacggtaccgtaacccgtccgttacgggacctaccggacccgaaaccggaccccctaacccgtactccgtaacccg

SEQ ID NO: 130027 - DNA, 729 bp, Homo sapiens
  misc_feature: GYAE6OF02HWQ1O.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctttgaggcctcctatgagctgacacagccaccctggtgtcagtgtccccaggacagacggccaggatcacctgctctggagatgcattgaccaaaccgatatgcttaattggtacagcaagagccggcaggccccgtgtgttgtgatgtaagtaaagacactgagacggccctacgagggactcccgtggacgcgtatttcctacgtcggtctccgtaggttaccgaaggggaaccgaaacggtcgtaacgacgttttacgggaccctaagttaccgtaggttacgggaaccggttacccgaaggggtaccgaaagggaaacggggaaccggacggggtaccttaacggtaaaccgtttaacgtttagtttacgttaaactaaacgttaaccgaaaacgtacggaaaacctaacccgaacgttttaacgggttaaccttttaagttacggttcgtttaaccgggttaaacgtcggtaccgtaacccggtaaacggtccgtaaccccggttaccggtacgggttacccgaaccggtaccccggaaaccggacccccgtaaaccccgtacttaccggacccgttaacccg

SEQ ID NO: 130028 - DNA, 850 bp, Homo sapiens
  misc_feature: GYAE6OF02I25Y2.49.52.E08.1.454.CMB.1.raw
  modified_base (243)..(243): a, c, t, g, unknown or other
  misc_feature (243)..(243): n is a, c, g, or t
tcagagtcgagagacacgaccggtgctcgatttagtcgagctctcagagagaaagggggtgggtccaggaggcagaactctgggtgtctcaccatggcctggatccctctacttcctccccctcctcactctctgcacaggctctgaggcctcctatgagctgacacagccaccctcggtgtcagtgtccccaggacagacggccaggatcacctgctctggagatgcattcgaccaaaccgntaatgactttagttacggtaaccagacaaggaacggcccgggacccacgggtccccctaggttggttcggtacgtaagtttaggttaaagtaaaacggtacctaccgttaggaacgggtaaccgggacccccgttacgggaacggggttaaccttaccccggttaggaacggtaccgttaacgtttcccggttccgtaccggggtccgttacccggtaaggggttaccggaaacggggggtaacccgtaaacccggggttaccgtaaaccgtacgttttaccggggaccccttaagttacccggtaagggttacgggtaaccgggttacccggaacgggtaccgaacgggtaaccggggaaccgggtaacgggtaccgttaacggttaacgtttaacgttttaacgtttacggtaacccttaaacgtacccgtaaaaccgaacgtaaaccctaaccgttaacgtttttaacgggttaaccttttaggttacgtttaccgttacgggttaaccgttcggtaaccgtaaccggtaacggttacccgtaccggttaccgttagggaccctacggacccgaaccggtaccccaacccgttacctacgtacc

SEQ ID NO: 130029 - DNA, 646 bp, Homo sapiens
  misc_feature: GYAE6OF02F0YMZ.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttcctccccctcctcactctctgcacagactctgacggcctcctatgagctgacacagcccaccctcggtgtctgtgtcctcgaggacagacggccagtatccaccttgcctcgtggagtatgctattcggaccaaaagcaatatgtcttactcggtaaccagacaagaacgccgacggccgacggcccctgttcgttcgattctaatttaataaagtactttagacggtacgggtcctcgacgggacccctggacgcgtacttcctcgtcggtcctccgtacgtcgtacacgaccaaccgaacgtacgtccgtaccgttacgtacctagtcgtaacggtcgggtacggtcccgggagacgggacgggacggaggtcgtagtaccttacgttactcgttacgtacgtactacgtacgaacgacgtaggtacgtcggtctacgtttcgtgttacggttcgttacgggacggtacgggaacccgtagtcccgtacggtaccggttaccgtacggtaccgtaccgcccggtaaccgg

SEQ ID NO: 130030 - DNA, 862 bp, Homo sapiens
  misc_feature: GYAE6OF02H2OXL.49.52.E08.1.454.CMB.1.raw
  modified_base (410)..(410): a, c, t, g, unknown or other
  misc_feature (410)..(410): n is a, c, g, or t
tcagagtcgagagacacgaccggtgctcgatttagtcgagctctctcggcggggggggtcacccccccaagaggcagcgctctcgggacgtctccaccatggcctgggctctgctgctcctcactctcctcactcaggacacagggtcctgggcccagtctcgccctgactcagcctgcctccgtgtctgggtctctggacagtcgatccacatctctgcactagaaaccagcagtgatggttaggtaaattacttaaaccttttcaccgttacggtaaccaaacaaccacccgaggaaccaaacggaccccaaaacttcactactaagttttaagcggacggacccgaatccgaacggccgtcccgtacggtacggggttcccttggagaactccgtctttaccgttcncgggtacctcccggaactttccggttacggaccgtaaacgcccggaaccgggttcccctttaccccgtaagaaacctaaccgtttccggttacggttacccggggccttaccgggacgggttccggggtaaacggggggacggttaaccggtagttaaggtaaacttttaaggtttaattacgggttcctttagggtttaacctaaggtttaaccgttcccggggtaacggttacggttaagtttaacggggtttaccggggaaacccggggttaaaaggggtttcccggggtttaacggggacccgggggttaaacggggtaaacccggttaaaagggttccccgggtaacccggtttaacccgggtttaacgggacccggtttaaaccggaccccgtaaacggggttaaccccgtttcccccgggtacccccggtttcccgggtaaaccc

SEQ ID NO: 130031 - DNA, 573 bp, Homo sapiens
  misc_feature: GYAE6OF02FPN29.49.52.E08.1.454.CMB.1.raw
  modified_base (240)..(240): a, c, t, g, unknown or other
  misc_feature (240)..(240): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttattggtaccagcagaagccgggcacggcccctgtgttggtgatgtaataaagacactgagacggccctcgagggtactccctgacgcgtattctctggcctcgaggtcagggacacggtcactagttcgcctatcgagtggacgtccaggcaaggaggacgaggtctagacttaattagttatactaatacaaacacgaaccaccgtaagttcggttaacttatacggttccttacggaacttcggacgtaaccgtaacggtccgtacccggtccgtacgggtacaccggacccgaacggacccctaacccgtacgtccgtacccg

SEQ ID NO: 130032 - DNA, 762 bp, Homo sapiens
  misc_feature: GYAE6OF02IXM7B.49.52.E08.1.454.CMB.1.raw
  modified_base (229)..(229): a, c, t, g, unknown or other
  misc_feature (229)..(229): n is a, c, g, or t
tcagagtcgagagacacgaccggtgctcgatttagtcgagctctcagagagaaagggggtgggtccaggaggcagaactctgggtgtctcaccatggcctggatccctctacttcctccccctcctcactctctgcacaggctctgaggcctcctatgagctgacacagcccaccctcggtgtcagtgtccccaggacagaccggccaggactccacctgctcgtgganatcgctattcgacccaaaaccgtatatgactttatttcggtaccctagcaaggaacggccccggggccaacgggccccctggttcggtttcgggtggtattggtaataaaacggaccaacgttggaacggacggccccgtacgacggggacttcccgtagaacgtccggtaactttccgtaccgttgggacccttaccggacgggttccgaagggggtaaccctaaccgggtaccaaccgtagttttccgggaccgtaacggttccgggtagggacggttacccgaagggtaccaagggtaacggggacggtacgggtacgttagtaccgttaatttacgtttacggtaacctaaataccgtaaacgaacgtaaccctaaccgtagtttacggttaactttagtttcggttaccgtttaacgggacttacggaccgtaaccgtacgggtaccgtaccggttacccggtgggttacccgtaacggtaccccgaacggtaacccccaaccccgtacgtcccgtaccgttaccccg

SEQ ID NO: 130033 - DNA, 611 bp, Homo sapiens
  misc_feature: GYAE6OF02JCEE8.49.52.E08.1.454.CMB.1.raw
  modified_base (223)..(223): a, c, t, g, unknown or other
  misc_feature (223)..(223): n is a, c, g, or t
  modified_base (241)..(241): a, c, t, g, unknown or other
  misc_feature (241)..(241): n is a, c, g, or t
  modified_base (330)..(330): a, c, t, g, unknown or other
  misc_feature (330)..(330): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgcccaaaccgntatgcttattggtaccagcagaacgccgggcacggcccctgtgttggtgatgtataaagacactgagacggccctcgagggactcccgngacgcgtattctcgtggctaccgaggtcgaagggacaacggtcacagtttcgccatcgagtggacgtccgaggcaggaggacggaggctgtacttagtttactgtacaattcaaactacgaactaaccttaagttacgggttaactttaagtcgtttaccgttacgggtaaccttcggaaccgtacccggtaaacggttacccacccgggttacccgttcggggtaacccacggaccccgtaaacccgggtaccccaaacccccgtacgttaccgtacccg

SEQ ID NO: 130034 - DNA, 591 bp, Homo sapiens
  misc_feature: GYAE6OF02HXGDK.49.52.E08.1.454.CMB.1.raw
  modified_base (490)..(490): a, c, t, g, unknown or other
  misc_feature (490)..(490): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagcccacctcggtgtcagtgtccccaggacagacggccaggatcacctgctctggagatgcattgaccaaaaccgatatgtcttattggtaccagcagaacgccgggccacggcccctggtcgttggtgatgtaataaagacactggagacggccctcgaagggactccgtgagcgattctcgtcggctcgagtcgaggacaacggtcactagtcggacctatcgagttaggacgtaccgaggtcgaaggacggaacggagctagtacttatttagttgtacaaatacaacgaacgacctactaagtttcggttaactttagtnttaccgttacgaactacgaccgaaccgtaaggttcccaaccggttccgtacgggtaccaccggtaccccaaacgggtcccccaaacccgtcgtcgtaaccc

SEQ ID NO: 130035 - DNA, 786 bp, Homo sapiens
  misc_feature: GYAE6OF02HF9KC.49.52.E08.1.454.CMB.1.raw
  modified_base (222)..(222): a, c, t, g, unknown or other
  misc_feature (222)..(222): n is a, c, g, or t
  modified_base (228)..(228): a, c, t, g, unknown or other
  misc_feature (228)..(228): n is a, c, g, or t
  modified_base (246)..(246): a, c, t, g, unknown or other
  misc_feature (246)..(246): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacaggacggccaggatccactgcctntagganatgcattcgaccaaacgntatgtcttattggtaccagcaggaacgccggccacggcccctgtgttggagatagtaataaagacacgtagagaccgccctagacgggtacctcccgtagacgacgtattccgtacgtcgggacctaccgtaggtaccggaagggaaccgtaaaccgggttcaaaccgtacgtttccgggacctaagtaccgaagggttcggtaaccggtaccgacgggaacgtaacgggaacggggaaccggtacgggtccgttaacggtaaaccctttagttttaaacgttccgggttaacctaaaacgttaacccgaaaacggttaaccggaacccttaaacccgttaacgggttttacggttaaaccgttttaacggttccgtttaaccgggttaccggtaaccgttacgggtaaccccggttaaaccccgtaaaacggggttccccgttaaacccggttacccgggttaccgggttaacccaacccgggtaaccccgtaaaccgggaccccccttaaaccccgttaccgttcccggttaaccccg

SEQ ID NO: 130036 - DNA, 677 bp, Homo sapiens
  misc_feature: GYAE6OF02IIIP0.49.52.E08.1.454.CMB.1.raw
  modified_base (229)..(229): a, c, t, g, unknown or other
  misc_feature (229)..(229): n is a, c, g, or t
  modified_base (326)..(326): a, c, t, g, unknown or other
  misc_feature (326)..(326): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagcccaccctcggtgtcagtcgtcccaggacaggacggccaggactccacctgcctcgtgganatgctattcgaccaaaccgatatcgtacttattcggtaaccagtacagaacggcccgggccacggtcccctggttcggttggtcgtagtaggttaanaaacggacacgtggaacggcgcccgtacggagggtacctccgagacgtcgtacttcgtacgtggtcctacgtacggtccgaagggaacctaacggtacaacgtagttccgggacctaagtcgtagggtcggtacgtacccgagggacgaggaacgggaccggtaagccgtacggtaacttaagttacgttagacaataacaacaagtaccgaacttagttacgttaacttacgttaggtaccttacgggaacttcggaccgtaaccggtaacggtaccctaccggttaccggttcggtaccgtaccggacccggtaaaccggtacccctaaccgtaccgttaccgtacccg

SEQ ID NO: 130037 - DNA, 692 bp, Homo sapiens
  misc_feature: GYAE6OF02JJPYQ.49.52.E08.1.454.CMB.1.raw
  modified_base (229)..(229): a, c, t, g, unknown or other
  misc_feature (229)..(229): n is a, c, g, or t
  modified_base (249)..(249): a, c, t, g, unknown or other
  misc_feature (249)..(249): n is a, c, g, or t
tcagagtcgagagacacgaccggtgctcgatttagtcgagctctcagagagaaagggggtgggtccaggaggcagaactctgggtgtctcaccatggcctggatccctctacttctcccctcctcactctctgcacaggctcgtgacgcctcctatgagctgacacacgccaccctcggtgtaccagtcgtccccgaggacaggacggcaggatcacctgctctagganactgctatcgaccaaacgtntactgtacttagtcggtaccagacagaacgccggcgtacggtccctaggtgttcggtggtataggtaataaacggactacgtaggacgaaccgcccgtagacggtactcccgtaggacgcgtacgtcgtcgtcggcttaccggaggtcgaagggtaacaaaccggtcacgttaagtcggaccagtaccgtaggtcggtaacggtcgaacggaccgagggaacggaaccggtaggtcggttaacggtaacgtttattaacggtttcaacgtaaacgttacgaaacacgaacccgtacgtaacgttaccggtttaattacgttacgttaccgtttaacgggaactccgggttaaccggaccgttaaccgggtacctccggtaaccggttacggtacccgacgttaacccgaacccggttacccaacccggtaccttacggtaccc

SEQ ID NO: 130038 - DNA, 728 bp, Homo sapiens
  misc_feature: GYAE6OF02JX01P.49.52.E08.1.454.CMB.1.raw
  modified_base (376)..(376): a, c, t, g, unknown or other
  misc_feature (376)..(376): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgacggcctcctatgagctgacacagcccaccctcggtgtcagtcgtcccccaggacacgacggccaggactcacccgtgcctcgtagggacatcgcaacttcggacccctaaacccgattactcgctttaacttcggtaccagcaggaacgccgggcctcggccccctgtgttcggttgattgtaactaaacgctaactggacgacggccctcgaacgggtctccctggacncgtacttccgtctcgggtcctccgaggtccgacggggtaaccgaaccggttccaccgtacgtttccggacccagtccaacgtggtaaccgtcccgagggaccacggtaccgggaacgcgggtccttacgtacccgtttaattacggtttccgtcctaacttaccaaaaccgacggttacccaaccgtaacgtttacgggtttaacccgttattacggtttaccttaccgggaaccttcggaaccccggacccggttaaaaccgggtcccggtaaccccgttccccggttaggggtcccaaccggaccccgttaaaccgggcccccaaacccccgttacggttaccgtacccc

SEQ ID NO: 130039 - DNA, 799 bp, Homo sapiens
  misc_feature: GYAE6OF02I268T.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctctcactctctgcacaggctctgaggcctcctatgagctgacacagccacctcggtgtcagtcgtccccaggacagacggccaggatccacctgctcgtggagactgctattcgaccaaacgttacgtgtcgtttattcggtaccagcgaaggaacggcccgggaccaccggtccccgtggttacggttcggtagtacgttagttaagtaaacggtaacaccggtaggaacggtacggtaccccttaggaacggggtaccttcccgtaggacggtcgtaacttccgtcgtcggtaccgttccgaacggttacggaacggggtaaccgaaccggttactaaccgttaggttaccggaccgtacgtaccggtaaggttcggggaacccgttaccggaagggtaccgtaaggggaaccgggaaccggacgggttaccttacggtaaactttaacgtttaacgtttacgtaacctaacgttaaccgtaaaccgtaaccgtacctaacccgtttaagtttaccgggtttaaacgtttacgtacgggttttaaccgttacggttaacgtacggtaccgtaaaccggtacggttaccccgacccggggtttacccggttacgggaacctacccgggaccccgaaaccgggttccccgaaaaccccgtcggttacccgtaaccccg

SEQ ID NO: 130040 - DNA, 557 bp, Homo sapiens
  misc_feature: GYAE6OF02FQENR.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtcccccaggacagacggcccaggatcaccctgctctggagatgcattgccaaaccgatatgcttattggtaccagcagaagccgggccaggcccctgtgttggtgatgtataaagacactgagaggccctcagggactcccgtgagcgattctctggctcccgaggtcagggacaacggtcacgattcggccaatcgagtggacgtccgaggcaagaggacgaggctgacttattacttgtcaaatcaaacacgacaacctagtttagtaacttatgttcttaccggaacttcggacaccgtaacggtccaaccccggttcgtacgggtccaacggcccaaaccgggacccaacccccgacgtcgtacccg

SEQ ID NO: 130041 - DNA, 770 bp, Homo sapiens
  misc_feature: GYAE6OF02I4ER6.49.52.E08.1.454.CMB.1.raw
  modified_base (239)..(239): a, c, t, g, unknown or other
  misc_feature (239)..(239): n is a, c, g, or t
tcagagtcgagagacacgaccggtgctcgatttagtcgagctctctcggcggggggggtcacaagaggcagcgctcgtcgggacgtctccaccatggcctgggctctgctgctcctcactctcctcactcaggacacagggtcctgggcccagtctgcctgacgtcgagcctgcctccgtgtctggtctccgtggacacgtccgactaccacctattcctcctcgccactacgaaaccngcagtgacgtggttaggaatttactaaccttttctccgttacggtaacccaacgtaaccaccccgaaggccaaaaccggacccccctaaacttcctaactaccgtaattttaacgtggacggtacccgagttaccgaggtccgggaccccttacggacggggttcctcgtgtacgttcgctttaccgtcgtcggtcctcctacgttcgtacgggctacggccgtaccgggcccttacctacgtaacctaacttccgttacgttcggggtcccgttacccggacggggtaccggttacgggggaccggtaggtacccggtttagttaaccggttttaattttaaccgtttgtccgtttatttaccgtacgttaacggttcggtaccgggttacggtaagttacgggtaccgggtacggttaaacggggttcgggttaccggggacggggtaacgggaacggtaaacggttacggtaaccggtccggtaacggtcgaccgaccggtacggactcccggtcccgtacggtcccg

SEQ ID NO: 130042 - DNA, 604 bp, Homo sapiens
  misc_feature: GYAE6OF02I7XGI.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctcgtggacgatgcattcgaccaaacgatatgcttattcggtaccagcagacgccaggccacggcccctgtcttgatctaatttaataaagtctttagaggacggtcctacgacgggacccctggaacgcgtacttcctcgtcggcctacgagtcctacgacgacgaacaaacgacggttccaacggttcgaccctagtccgaagggttcgggacggtccgggacgtagggacgggaccgaggtctagtacgttacgttacgtcgtacacgtcaatcgtaacgacgtaagttacggcgtactacgttcgtcgtcgttagtcgggacgggtacgaaccgtacgcttcgaccggttacgtacggtcaccgaccgtacgtcgtaccccgg

SEQ ID NO: 130043 - DNA, 1097 bp, Homo sapiens
  misc_feature: GYAE6OF02GWL4O.49.52.E08.1.454.CMB.1.raw
  modified_base (178)..(178): a, c, t, g, unknown or other
  misc_feature (178)..(178): n is a, c, g, or t
tcagagtcgagagacacgaccggtgctcgatttagtcgagctctcagagagaaagggggtgggtccaggaggcagaactctgggtgtctcaccatggcctggatccctctacttctccccctctcactctctgcacaggctctgaggcctctatgagctgacacagcccacctcggtntcagtcgtccccaggacagacggccaggactcacctgctcgtaggagatgacctagttacgacccaaacgtatacgtacgactttaagttacggtaacccgaagaccgaaggtaaacggccccggggacccgtaacgggtcccccccgttagggttaccggtttaggggtaggtaacgtttaggttaaacgttaaaaacggaaccgtaacggtttacgggaacgggtaaccgggtaccccccgttacgggtaaccgggggtaaccgtttacccccgttagggtaaaccggtaccgggttaaacttttccccgtttcggttaccgggtacccgtttacccggaacggggtttaccggaaaccggggtaaacccggtaaaacccgggttacctaaaccggttaacgttttacggggaccctaaacggttacccggttaaacggggttcgggtaaacccggttacccggaaaacggggtccgtaaaacggggggaacccggggtaaaaccgggtaaccggggttaaccgttaaacggggttaaaaccccgtttttaaaggttttaaccggttttaaacgggtttaacccgtaaaaaccggttttaaccccgaaaaaccgggttaaaccgttaaacccgtaaaacccccggttttaagtttttaaccgggggttttaaaaccttttaaaccggttttaaccggtttaacccgggtttttaaccgggtaaaccgtttacccgggtaacccggttaaaaccccgggtaaaccggggttttaaacccccgtaaccccccggggtttaacccggtttaacccggggggttaacccctaaacccgggtaacccccccgggtaaaaccggggttaaacccccccctaaaccccccgttaaccgggtttaccccggtttaaaccccccgg

SEQ ID NO: 130044 - DNA, 635 bp, Homo sapiens
  misc_feature: GYAE6OF02F0LCG.49.52.E08.1.454.CMB.1.raw
  modified_base (242)..(242): a, c, t, g, unknown or other
  misc_feature (242)..(242): n is a, c, g, or t
tcagagtcgagagacacgaccggtgctcgatttagtcgagctctcagagagaaagggtggtccaggaggcagaactctgggtgtctcaccatggcctggatccctctacttctcccctcctcactctctgcacaggctctgaggcctcctatgagctgacacagccaccctcggtgtcagtgtccccaggacagacggccaggactcaccctgcctctgggagatgcattggcccaacccgntatgcttattggtacccagcaggaacgccggggtccagggcccccttggttgtgatagtataagacactgagaggccctcgagggtactccccgtgacgcgattctcttcgggctccgaaggtccgaggggacaccgggtcacgattcggccatccagtcggagtccaggcaggaggacgaggcgttgacttattattgtcaactacaaacctacggaaccaaccgtaagtttacggttaacgtttaacttcggttaccgttaccgggtaaacgtcgtaccggtaacccgtaaacgggttccaaccccggtttcccgtaccggggttacccgaaccgggacccccggtaaaccgggtccccgtaaacccccccgtacgttaccggttaccccg

SEQ ID NO: 130045 - DNA, 750 bp, Homo sapiens
  misc_feature: GYAE6OF02I5UJT.49.52.E08.1.454.CMB.1.raw
  modified_base (226)..(226): a, c, t, g, unknown or other
  misc_feature (226)..(226): n is a, c, g, or t
  modified_base (257)..(257): a, c, t, g, unknown or other
  misc_feature (257)..(257): n is a, c, g, or t
  modified_base (303)..(303): a, c, t, g, unknown or other
  misc_feature (303)..(303): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaaccngcagtgattggttaggaattactaactttcnctgtaccaacaacaccaggacaaacgaccccaaatcaatcatttangacgccatcacgccgtccctgacgggtctcgtagtactcgtccttcgtctcggtcctaccgtacgtcgtcggccgtaacggtcccgtaaccggtccccgttaccgtacgtaaccgtaacttcccgtaacccggtttcggggacccttacccggtaacgggtacgggttaccgggggtaaccggacgggtacgttaacggtttaagttttaactttaacgtttcgtccgtttacggtttaaccttagttaccgttacgggtacccggttaggttaacggttagggttaaccgggaccgggttaaacggggttcgggttaccggggtaccggggtaacgggtaacccgggtaagggttccgggtaacccggttaaccggttacgggttaccgaaccggtacccggtaacgggtaccccggtcccggtaccccccgttaggttaaccccg

SEQ ID NO: 130046 - DNA, 573 bp, Homo sapiens
  misc_feature: GYAE6OF02HA646.49.52.E08.1.454.CMB.1.raw
  modified_base (241)..(241): a, c, t, g, unknown or other
  misc_feature (241)..(241): n is a, c, g, or t
  modified_base (312)..(312): a, c, t, g, unknown or other
  misc_feature (312)..(312): n is a, c, g, or t
  modified_base (332)..(332): a, c, t, g, unknown or other
  misc_feature (332)..(332): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgntatgcttattggtaccagcagaagccgggcaggccctgtgttggtgatgtataaagacactgagagccctnagggactcctgagcgattcnctggctccgaggtcagggacaacggtcacagttcggccagtcagtggagtccgaggcaggaggacgaggctgaacttattattgtacaattcaaagtaacgacaacctagttacggttaactttaagtcggttacgttaccgggaacttcggacggtaacccgaaggttccctaaccggtccgttacgggttacgaaccggaccccggaaccggtaccccaaacccccgtgtaccgtaccc

SEQ ID NO: 130047 - DNA, 871 bp, Homo sapiens
  misc_feature: GYAE6OF02JUMYK.49.52.E08.1.454.CMB.1.raw
  modified_base (128)..(128): a, c, t, g, unknown or other
  misc_feature (128)..(128): n is a, c, g, or t
  modified_base (213)..(213): a, c, t, g, unknown or other
  misc_feature (213)..(213): n is a, c, g, or t
tcagagtcgagagacacgaccggtgctcgatttagtcgagctctcagagagaaagggggtgggtccgaggaggcagaactctgggtgtctcaccatggcctggatccctctacttcctcccctcctcnctctctgcacaggctctgaggcctcctatgagctgacacagcccaccctcggtgtcagtcgtccccgaggaccagacggccaggntcacctgccttctgggacagtcgctaagttcggaacccaaaaccggtattacgtagtctttagttaggtaacccagaccaacggaacggacccggggaccccgaaccgggtcccccgtggttacgggtttcgggtacggtagttacggtaagttaaaacgacgtaaccgttggaacggacggtccccttaacgggacgggtaaccttcccgtagggtacgtacggtacgtttccttcgtcggccttaccggaggtccggtaacggggaaccgtaaccgggttaccaacgttacgtttcggaccgtaaacgtccggtacggggttacggtaacggttaccccggagggtaaccgaacggggaaaccggggtaaccgggtagggacccggttaaggttaacccgttaaaggttttacggtttaacgtaaccggtaaccgttaaaccgtaaaaccggaccgtaacggtaacccctttaggtttaacccggtttaactttaacggttaacggtttcgtttaaccgggtaaccgttacggtacccggttaaccggtaacggttccccgttaaccgttcgggtttaacccgggtaccctaaccgggtaaccccggtaaccccgggtaacccctaacccccggttacgtacccggtttaaccccg

SEQ ID NO: 130048 - DNA, 684 bp, Homo sapiens
  misc_feature: GYAE6OF02I1YSO.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacaggacggccaggatcacctgctctggagatgctattcgaccaaaaccgatatgtcttaattggtaccagcaagaacggcccgggcacggccccctggttcgttgggtagtagttaggtaataaaacgacacgttaggaacggacggcccctacgacgggtactcccgtaggacgacggtacttctccgtggtcctccgagggttccaaggggacctaacggtacaacgtcgtttacggacctagtacgtaggtgggtacgtaccggaaggcgaagggacgggaacggtggtaccgtaggtaacctttagttacgttgtactaaacgttacaaacgtaacgaccaccgttaagttacggttaactttaatcggtttacgttacgtaacgtcggaccgtaaccggtaacgtacccgtaccggttaccggtacgggttaccgaaccggttacccgaacccggtaccccaaccccgtacgtctaaccccgg

SEQ ID NO: 130049 - DNA, 635 bp, Homo sapiens
  misc_feature: GYAE6OF02II0GI.49.52.E08.1.454.CMB.1.raw
  modified_base (240)..(240): a, c, t, g, unknown or other
  misc_feature (240)..(240): n is a, c, g, or t
  modified_base (328)..(328): a, c, t, g, unknown or other
  misc_feature (328)..(328): n is a, c, g, or t
tcagagtcgagagacacgaccggtgctcgatttagtcgagctctcagagagaaagggggtgggtccaggaggcagaactctgggtgtctcaccatggcctggatccctctacttctccccctctcactctctgcacaggctctgaggcctcctatgagctgacacagcccacctcggtgtcagtgtccccaggacagacggccaggatcacctgctcgtggagatgcattgaccaaacgntatgcttatggtaccagcagaacgccggcagccctgtgtggtgtatgtaataagacacgtgacgacgccctagacggactcccgtagngacgtattccgtcgtcggctccgaggtaccgagggaacgaacggtcaacgtgttcggacctatacgtaggtcggagtaccgaggtcaaggacgggacgacgggtctagtaacttagttaacgtttcgtaacaacgttacaaacctaacggacctaaaccgttagtttacggtttaaacctttagtaccggttttacgttaaccgggaacttacggaaccgtaaaccggtaacgggttcccgtaacccggttcgttacgggtaccaccggtaaccgaaccgtaccccgaaacccttcgacttaccccg

SEQ ID NO: 130050 - DNA, 671 bp, Homo sapiens
  misc_feature: GYAE6OF02IQPNW.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttcctccccctctcactctctgcacaggctctgaggcctcctatgagctgacacagcccaccctcggtgtctgtcgtcctcaggacagacggccagtactcacctgctcgtggagatgctagttcgaccaaaagcaatatgtacttacgtggtaccagacagaacgcgacggccacggcccctgtcttgatctatttaagtaaagtacgtttaggaggtacggccttacgacgggtacccctgacgtcgtactttcctacgtcggtcctccgtaacggtcctacgacgaaccgaacctaaaccgtacgtaccgtaccggtttacgaaaccctacgtctagggtacgggacgggtaccggggtacgaacgggtacgggaacggtggacgttacgtaactttagttaccgtagtcgtacgtactacgtacaggtaacgtagttacggtcgtactacgtttacgttacggttacgttacggttcggggaccgggtaacgggaaccgtaggtaccgtacggtacccggtaccggttacggaccgtaccggacccgtaaccggg

SEQ ID NO: 130051 - DNA, 757 bp, Homo sapiens
  misc_feature: GYAE6OF02GQUW4.49.52.E08.1.454.CMB.1.raw
  modified_base (237)..(237): a, c, t, g, unknown or other
  misc_feature (237)..(237): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagcccaccctcggtgtcagtgtcccaggacagcgcaggatcacctgctctggagatgcattgaccaaacgntatgtacttattggtacagcagaacgccgggccacggcccctggtgttaggtgatgtaataaagacactagagacggccctagacgggacttcccgtagacggaccgtaattccgtcgtcgggcctaccggtaacggtcggaacgggtaacctaacggggtcaacgtagtttcggacctaagtcgtaaggtacgggtacggtacccgaagggccgaaacgggaacgggaaccggaacgggtccttaacggtaaccgtttaagttttaacgttcggtaaaccttaaaggtacctaaaaccgtaacggtaacccgtaaaccgttaaggtttaccgggtttaaactttacggttcggtttaaccgtttaccgggaaaccgttcgggtaacccggtaaacccgttaaacgggtaccccgttaacccgggttccccggttaacgggggttaaccctaaccgggtaaccccccggtaaccgggaaccccccgttaaacccccgtaccggttacccgttaaccccgg

SEQ ID NO: 130052 - DNA, 825 bp, Homo sapiens
  misc_feature: GYAE6OF02HTD5Y.49.52.E08.1.454.CMB.1.raw
tcagagtcgagagacacgaccggtgctcgatttagtcgagctctcagagagaaagggggtagggtccgaggaggcgagaactctgggtgtctcaccatggcctggatccctctacttctcccctcctcactctctgcacagctctgaggcctctatgagctgacacagccacctcggtgtcagtcgtcccgaggacaggacggccaaggatccaccgtgcctcgtaggacgatcgacctaattccgaaccaaaaccgtattacgtcgtctttaacgttcgggtaaccagtacgaacggaacggtcccgggaccaccgggtccccgtaggttcggttcgggtacgtaagttagtaacgtaaaacggtacgtaacgtggaacggtaccggtccccgttaacgacggggtaacctcccggttagggtaacggtaccgttaacgtttcccgtacggttcgggtccgttacccggtaacgggttaccggaacgggggtaacccgttaacgggtaccgtaacggtacgtttaccgggaccctaaggttccggtaagggtttaccgggaacttaccccgggaggaaccggttaacggaacggggtacggtaaccggactaacgggttaaacccgtagttttaaccgttagggtaacctaaacgttaacgaaaccgtaagaacccgttaacgtcccgtttaaggtaaccttttaagtccgttacgttaaccggtacgacgtacggttaaaccgaacggttaccgtacccgttaccggttcggacgtacccggaccgtaaaccgggacccctaacccgacgtttccgtaacccg

SEQ ID NO: 130053 - DNA, 633 bp, Homo sapiens
  misc_feature: GYAE6OF02HUL00.49.52.E08.1.454.CMB.1.raw
  modified_base (244)..(244): a, c, t, g, unknown or other
  misc_feature (244)..(244): n is a, c, g, or t
  modified_base (328)..(328): a, c, t, g, unknown or other
  misc_feature (328)..(328): n is a, c, g, or t
  modified_base (351)..(351): a, c, t, g, unknown or other
  misc_feature (351)..(351): n is a, c, g, or t
  modified_base (448)..(448): a, c, t, g, unknown or other
  misc_feature (448)..(448): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggtctcctatgagctgacacagcccaccctcggtgtcagtgtcccaggaccagacggccaggatccacctgctcgtggagatgcattgaccaaaccgntatgtctttagttcgtaccacgacgagaacggcccgggccacgggcccctgttggttggtgaactgtaagtaacgacacgtagngacggtccctcgagggactccgngagacgtacttctctcggtctccgacggttacgagggacctaacggtcactacgtttcgactactcgtacgtggagtccgaggcgaggacggacggngcgtacgacttagttacttgtactaatccaaacgacgtaactacctaagttcgtttacgttaagttcgttaccgttagaaccgttcggaccgtaccgtaaacgggtccctaccgggttaccggtacggtccgtaaccggacccggtaaaccggacccccgtaaccccgtacgtcccgttaacccg

SEQ ID NO: 130054 - DNA, 570 bp, Homo sapiens
  misc_feature: GYAE6OF02GSGEF.49.52.E08.1.454.CMB.1.raw
  modified_base (245)..(245): a, c, t, g, unknown or other
  misc_feature (245)..(245): n is a, c, g, or t
  modified_base (342)..(342): a, c, t, g, unknown or other
  misc_feature (342)..(342): n is a, c, g, or t
  modified_base (439)..(439): a, c, t, g, unknown or other
  misc_feature (439)..(439): n is a, c, g, or t
  modified_base (452)..(452): a, c, t, g, unknown or other
  misc_feature (452)..(452): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacaggacggccaggatcacctgctctggagatgcattcgaccaaaaccgntatgcttattggtaccagacagaacggccgggaccacggcccctgtggttggtgatagtataaacgacactggagacggccctcgagggactcccgngacgacgtattctcgtggctcgagtcgaggacacggtcacgtatcgaccagtcagtggacgtccgaggcaaggacggacggagactagacttagttntgtacaatacaanagacctacattacgtacttagtcgtacttacggtaactcgaccggtaaccgtaaggtacccacccggttccgtcgggtaccgacgtacccgaacggaccccaacccgtcctcgtaccc

SEQ ID NO: 130055 - DNA, 882 bp, Homo sapiens
  misc_feature: GYAE6OF02H4LI1.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttcctccccctcctcactctctgcacaggctctgaggcctcctatgagctgacacagcccaccctcggtgtcagtcgtccccaggacaggacggccaggactcacctgctcgtggagatgacctagttacgaccaaaaccgtattaagttcgtactttagtttacgggtaacccaggtaccaaggaaacgggcccgggtacccgaccgggtcccccgttgggttacggtttgggtacggtaagttaggtaaacgtaaaaacggtaaccgtaaccttagggaacgggaccggtacccccgtagggtaacggggtaccttccccgtaggacggtccgtaacgttttcctaccgtcggtaccgttaccggtaacgggtaccgaacggggaaccgtaaaccggtcctaaacgtcgtttacggaccctaagtcccgtaagggttaccgggtaacgttacccggaagggaccgaacgggggtaacggggaccggtacgggtaaccttacggtttaaacgtttaaagttttacgtttaacggtaacctaaacgttaaccaaaaccggtaacgtaacccgtaaaccgtttaacggtttacggtttaaaccttttaggtaccggttttaccgttaacgggtaaaccttacggtacccgttaaaccggtaaccgggttaccccggtaacccggtttacccggttaccgggaacccggacccggtaacccccgaaacccgggtcccccctaaaacccccggtccgtttaccggtaaccccg

SEQ ID NO: 130056 - DNA, 713 bp, Homo sapiens
  misc_feature: GYAE6OF02GIRAA.49.52.E08.1.454.CMB.1.raw
  modified_base (225)..(225): a, c, t, g, unknown or other
  misc_feature (225)..(225): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccngcagtgtagtgttagggaattactaaccttttctccgtggtaaccaactaaccacccgaggaccaaacgacccccctaaactcactacctaatttaacgtaggacggaccgactcgaacggccggccctacgtacggggtcctcgtgactccgtcttacgtcgtcggtcctccgacgtccgtcggacagccgtaaccggccctcccgtggaacctaatccgtcggtcggtacctccggtaggtaccgggttacggggaacggaccggtgttaccggtaatttaagtttacgttagtccgttcggttactaagttaacgttcgggtacggtaagttaggtaacgggttcgggtaacgggtaacggggttcggttaccggggacgggtaacggggtaacccggaagggttccggtaaccccgggttagttaaccgggtcacccggtaacccgtacggtaccccgtcccggtacccccgtggttaaccccg

SEQ ID NO: 130057 - DNA, 662 bp, Homo sapiens
  misc_feature: GYAE6OF02G2Q52.49.52.E08.1.454.CMB.1.raw
  modified_base (244)..(244): a, c, t, g, unknown or other
  misc_feature (244)..(244): n is a, c, g, or t
tcagagtcgagagacacgaccggtgctcgatttagtcgagctctcagagagaaagggggtgggtccaggaggcagaactcctgggtgtctcaccatggcctggatccctctacttctccccctctcactctctgcacaggctctgaggcctcctatgagctgacacagccaccctggtgtcagtgtccccaggacagaccggccaggactcacctgctctggagatgcattggacccaaaccgntatgtcttattggtaccagcaagaagccgggccaggcccctgtgttggtgatgtataaagcaactgagaggccctcagggtatccccgtgagtcgaattctactcggctccgaggtcagggtacaacggtcacgtagtggcccaatccgaggtaggacgttcccgaaggtccagggaacgggaaccggacgggtcgttacgtaaccttaagtttaacgtttgtaccaaacgtcgaaacctacgaacctaacccgtagtttaacggtaacttttagttccgttactttacccgggtaactttcggacccggtaacccgttaaccgggtaccctaaccccgggttcccgtacgggtttacccaaccggtcccccgtaaaaccgggccccctaaacccccgtacgttaccggttaaccccg

SEQ ID NO: 130058 - DNA, 726 bp, Homo sapiens
  misc_feature: GYAE6OF02IJ0N5.49.52.E08.1.454.CMB.1.raw
  modified_base (225)..(225): a, c, t, g, unknown or other
  misc_feature (225)..(225): n is a, c, g, or t
tcagagtcgagagacacgaccggtgctcgatttagtcgagctctctcgccggggggggtcacaagaggcagcgctctcgggacgtctccaccatggcctgggctctgctgctcctcactctcctcactcaggacacagggtcctgggcccagtctgccctgactcagcctgcctccgtgtctgggtctctggacagtcgatcacatctcctgcactacgaaaccncgcagtcgagtggttagggaaatttacttaaccctttttctcccgttacggttaacccaaaccaaacctaccccgaaggaccaaaaccggaccccccaaaacctccaactacctaattttacgtggaacggccgtaacttccgaacggtccggtacccctcggtacggggtcctcgtgacgtccgtcttctcgtcggccttacccgacgttcgtcggcacgccgacccggtccctcccgtacgacctaacgttccctcggtccgggtccctacggtaccgggtcgggtacgggggtacgtaccggttcgtaggtttaactttaacgttttacggttcgttccgttagtttacgtaacgttaggtccgggtccggtagtaagtacgggttacgggtacgggtagggttacggtcggggacgggtaacggacggaagggttccgccggttaccggtaagtccgaccggaccggtacggtcctcccggtccccgtggtaccccg

SEQ ID NO: 130059 - DNA, 692 bp, Homo sapiens
  misc_feature: GYAE6OF02GWHS1.49.52.E08.1.454.CMB.1.raw
  modified_base (230)..(230): a, c, t, g, unknown or other
  misc_feature (230)..(230): n is a, c, g, or t
  modified_base (460)..(460): a, c, t, g, unknown or other
  misc_feature (460)..(460): n is a, c, g, or t
tcagagtcgagagacacgaccggtgctcgatttagtcgagctctctcggcgggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcaccatcctcctgcactacgaaaccngcaggtgtagttggttagggtaacttactttaaccttttctaccgtacggtaaccaaacctaaccaccccgaggaaccaaaccgacccccctaaaactccaactactatttagtacgacggaccgtactccgacggccggtacccgtcggacggggttcctacgtgactccgtcttccgtcgtcggtcctccgacgtcgtcggactacgaccgaccggtcctacccgtanaccgtactcgtcggtaccggcctacggagggtccggtaggggaccgaggtcgttagttacgtttacttgttcgttcgttacgttactacggttacgtaccgggtcgtagtacggttacgggtcgggtacggttaagggttcggtagggaccgggaagtaacgggtaacggtaccggtaaccggtcggtaaccgcgtaacggccgacggtcccgtcccgtacccgtgtacccg

SEQ ID NO: 130060 - DNA, 689 bp, Homo sapiens
  misc_feature: GYAE6OF02G8K8N.49.52.E08.1.454.CMB.1.raw
  modified_base (237)..(237): a, c, t, g, unknown or other
  misc_feature (237)..(237): n is a, c, g, or t
tcagagtcgagagacacgaccggtgctcgatttagtcgagctctcagagagaaagggggtgggtccaggaggcagaactctgggtgtctcaccatggcctggatccctctacttcctccccctcctcactctctgcacaggcctctgacggccctcctatgacgctgacacgacgcccacccgtcggtgtcaggtcgtccccaggacaggaccgccgaggatcacctgctcgtgganatgctagttcgaccaaaaccgattatgtctttagttacgtaccagacgaagaacggcccgggaccgacggtccccgttggttcggttggtgtagtagtaactaaagacacgtgacggacgcccgtagacggtactccgagacgacgtattcgtcgtcgtccgtacgacggtcggaacgggaaccgtaacggtacacgtacgttacgcctagtacgtaggtcggtacgtacgtacggaaccgagggtaacgggacggacggtacgtaacgttacgttaatttacgtacgtactaaagtaccaaacgtaacgtacctaaacgttacgtttaacggttaactttacgttacgtttaccgttaaccgtacgtacgaccggtaaccgttaacggtcccttaaccggttcggtaccggcgtaccgaacccgaaccggacccaacccgtacaccgttcc

SEQ ID NO: 130061 - DNA, 226 bp, Homo sapiens
  misc_feature: GYAE6OF02GOES2.49.52.E08.1.454.CMB.1.raw
  modified_base (214)..(226): a, c, t, g, unknown or other
  misc_feature (214)..(226): n is a, c, g, or t
tcagagtcgagagacacgaccggtgctcgatttagtcgagctctctcggcggcacgaccggtgctcgatttagagagagtagtgttgggtttggggggaagaggaagactgacggtccccccaggagttcaggtgctgggcacagcggccctgggctgcctggtcaaggactacttcctctctcgactctgagcgggctggcaaggcgcatagnnnnnnnnnnnnn

SEQ ID NO: 130062 - DNA, 588 bp, Homo sapiens
  misc_feature: GYAE6OF02HOTWJ.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattcgaccaaaccgatatgcttattggtaccagcagaagccgggccacggccctggtcgttggtgatgtaataaagacactgagcggccctcgagggactcccgtgagcgtattctcgtggctcgagtcgaggacaacggcacagttcgccatcagtcggacgtccgaggacaggacggacgaggcgtacgtatacgttattgtacaatcaaacgagaacctactaagtttcggttaacttacgtgttaccttacggaacctcggtaccgtaaccgtaacgggttaccctaccggttacccgttacgggtacctaaccggtacccgtaaacggacccctaaccccgtaccgttacgtacccg

SEQ ID NO: 130063 - DNA, 933 bp, Homo sapiens
  misc_feature: GYAE6OF02HYS4U.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatccacctgctcgtggagatcgctattcgaccaaaaccgatatgtacttagttacggtacctagcaacggaaacgccccggggacccaacggggtcccccccgttaggttcggtttacgggttcggtaacgtttaacgggttaaacgttaaaaacggtaaccgtaaccgttacgggaaacgggtaccgggtacccccgtttacggaacggggtaaccgttcccccgttagggacggtaccggtaacttttccgtttaccgttcgggtcccttacccggtaacggggttaccggaacgggggtaacccgtaaaccggggttcccgaaaccgttaacggtttccggggaccctaacgttaccggtaagggttacgggtaacggttcccggtaaggggtaccgaaaggggaacggggaaccgggtaacggggtacccgttaagggtaacctttaacgttttaacgtttacggttaaccaaacgtttaccgaaaaaccgtaacgtaaacccgtaaaccgttaaggtttaaccgggtttaaccttttaacgttacggtttaccgtttaccgggtaaaccgtttcgggaacccggttaaacccggtaaacgggttaccccgttaaccccgggttcccggtttaaccgggggtaccctaacccgggtacccccggtaaaacccggtaaccccccggtaaacccccgttaccggttcccggttaaacccccgg

SEQ ID NO: 130064 - DNA, 608 bp, Homo sapiens
  misc_feature: GYAE6OF02FSPKE.49.52.E08.1.454.CMB.1.raw
  modified_base (224)..(224): a, c, t, g, unknown or other
  misc_feature (224)..(224): n is a, c, g, or t
  modified_base (451)..(451): a, c, t, g, unknown or other
  misc_feature (451)..(451): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatgcattgacccaaaaccgatatgcttattggtaccagcagaagccgggccaggccccctgtcgttggtgatgtaataaagacactagaggaggccctcgagggactcccgtgacgcgattctcgtgctcgaggtcgagggacaacggtcacgtattcggaccatcgaggtggacgtccgaggcgaggacggacggaggctagacttagttattagtacaatcaaanacgacctaacctagtttacggttacttaagttcgttacgtttaccggtaacgttcgaccgtaaccgtaacggtacccgtaacccggttcccggtacgggttaccgaaccgggtaccccgaaaccgggaccccaacccccgtacgtaccggtaccccg

SEQ ID NO: 130065 - DNA, 770 bp, Homo sapiens
  misc_feature: GYAE6OF02GQUM6.49.52.E08.1.454.CMB.1.raw
  modified_base (229)..(229): a, c, t, g, unknown or other
  misc_feature (229)..(229): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacagggtcctggcccagtctgccctgactcagcctgcctcgtgtctggtctccgtggacagtcgatcaccagtcctcctgctacgtacgaaaccngcagtcgaagttggttaggtaactttacttaaccttttctccgtaggttaaccaaacgaaccaccgtaggaccaaaccgaccccctaaactctaatacgtaatttacgtcggtacggaccgtacgtacgaaccggtccggtacccctacggtaaccggggtcctacgttacgtacgttcccgttacgttccttacggtcggtccctttacccgacggttccgtcggacgtaacgcccgtacccgggtcccttacccgtagtaaccgtaaacttccggtaccgttcgggacccgttaccggacgggtaccgggttacggggaacccgtagggtaccttaacgtaagtttactttacggtcgtgtttacgttactagttacgtccggtaccgtaggtacgttaggggtccggacggttaacgggttcgggtaccgggacgggtaacggtaaccggacgggtaccggtacccttaacgggtacgttaccgacccggtaaccggtaacggtcccggtttacccgaccccggtttccggtaacccg

SEQ ID NO: 130066 - DNA, 570 bp, Homo sapiens
  misc_feature: GYAE6OF02F6F3Z.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggactccacctgctcgtggagatgctattgacccaaaaccgatatgcttattcggtacagacagaagcccgggccacggcccctgtgttggtgatgtaataaagacacgtgagacgccctacgagggactcccgtgacgtcgattccgtctcggctccgtaggtacgacggggaccaacggtcaacgtagtttcgacctagtacgagtggacgtcgaggcaggaggacgagctgacttattagttacgtacaatacaacataccactagttacggtacttactgtcgtacgtactgacgtaccgagttaccgtaccgtcgtcggtaccacgacccgacgaccccgaacccgtacgtccgtacc

SEQ ID NO: 130067 - DNA, 682 bp, Homo sapiens
  misc_feature: GYAE6OF02F7Z26.49.52.E08.1.454.CMB.1.raw
  modified_base (228)..(228): a, c, t, g, unknown or other
  misc_feature (228)..(228): n is a, c, g, or t
  modified_base (262)..(262): a, c, t, g, unknown or other
  misc_feature (262)..(262): n is a, c, g, or t
  modified_base (643)..(643): a, c, t, g, unknown or other
  misc_feature (643)..(643): n is a, c, g, or t
tcagagtcgagagacacgaccggtgctcgatttagtcgagctctcgtcgcgggggggtcacaagaggcagcgctctcggacgtctccaccatggcctgggctctgctgctcctcactctcctcactcaggacacagggtcctgggcccagtctgccctgactcagcctgcctaccgtgtctcgggtctccgtggacagtcgatcactatctccgtgctactgaaaccngcagtgactgttagggaatttagtaaccttttcnccttacggtacctaactaacaccccaggacctaaacgccccctaaactctaagtccttaagttttagtcggacggtccgaactacgacgtcccggtcccttacgggacggggttacctcgtacgtacgttccggtcttcctacgtcggtaccctacccgtaacgtcgtacggcctaaggccctaacggtccctcgtagacctaagttccgtacggtcgggtccctacggtacggccgttaagggggaccgtacgggtacgtaggtaactttaactacgttcgcgtttagttactagtacgtcggtcgtacgtagttacggtcggtacgggtaaggttcggtcggaggacgggtacgtaaagggtcgtaaccgtcgttacgngtacccggtacgaacccggtctccggtacccgtgtaccg

SEQ ID NO: 130068 - DNA, 663 bp, Homo sapiens
  misc_feature: GYAE6OF02GYJNQ.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacacgacggccaggactcacctgctctggagatgctagttcgacccaaaccgtatagtcgtacttattggtaccagcaacggaagcccgggaccacggccccgtggttcggttggtgattgtaataaagacacgtgacgacggtccctacgacgggtactcccgtgacgtcgtacttctcgtgctcgaggtcgagggactacggtacacgtacgttcggactagtcgtaggtcgggactccggaaggacgagggtaacgggacgacgggtactacgtaacttagtttacgttcgtaacctaacttacgaaactacgtaaccgtaacgttagtttaacggttactttacgttcgtttaccgttacggtaaccgtcgtacccgtaacggtacggttaccgtacccggttaccggtaccgggtacaccggaacccgaacggtacccccaacccgttaccgtcgttaacccg

SEQ ID NO: 130069 - DNA, 909 bp, Homo sapiens
  misc_feature: GYAE6OF02JTJXL.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagcccaccctcggtgtcagtcgtcccaggacagacggccaggactccacctgcctcgtggagtatgactagttcgacccaaaacgatacttggtactttaagttcggtaaccaggactaaggaacggccccgggccgaaccggtcccccgttggttggttacgggtcgtaacgtagttaacgtaaaagtaccacgttaggaacgaccgggtcccctaggacgggtaccttacccgtagggaacggaccgttaacgttcccgtcgttacggggtacccttacccggtaacgggtaccggaaacgggtaacccgtaaacccgggttaccgaaaccgttaacgggttttccggaacccgttaaacggttacccggtaacgggttaacggggtaacccggtacccggtaaacggggtaccgtaacgggggtaaaccggggtaacgggaacgggtacggttaacccggttaaacgtttaatttacggtttacggtaaaccttaaaccggtaacctaaaacgaccggtaaaccttaaaccggttcgttttaacgggttaaacctttacgtttaccggttaaccggttttaacgggaaccgttaccgggtaaccgtaaccccgggttaacggttaaccccgttaaccggggtccccgtttaacgggggtaaccccaacccgggttaccccgggtaaaaccccggtaaccccccggttaaaccccggttaccgttaacccccggtttcccg

SEQ ID NO: 130070 - DNA, 681 bp, Homo sapiens
  misc_feature: GYAE6OF02HRVVT.49.52.E08.1.454.CMB.1.raw
  modified_base (180)..(180): a, c, t, g, unknown or other
  misc_feature (180)..(180): n is a, c, g, or t
  modified_base (245)..(245): a, c, t, g, unknown or other
  misc_feature (245)..(245): n is a, c, g, or t
  modified_base (264)..(264): a, c, t, g, unknown or other
  misc_feature (264)..(264): n is a, c, g, or t
tcagagtcgagagacacgaccggtgctcgatttagtcgagctctcagagagaaagggggtgggtccaggaggcagaactctgggtgtctcaccatggcctggatccctctacttctccccctctcactctctgcacaggctctgacggcctcctatgagctagacacagccacctcggtntcagtcgtcccaggacagacggccaggatcactgctcgtaggagatcgactattcgaccaaacgnttatgctttataggtaccngtacagaacggcccgggccacggtccccgtagtcggttggtgtacgtgtaataaaagacctaactggaacgacggtccctacggagggactccgtaggagtcgtacttcgtccgtggtccttcgaacggtcggaacgggacctaaaccggtcaacgtaacgtttcggaccacgttacggtagttacgggacgtccgtaaacgggcgtaacgggaacgggtaacgggaacggtactacggtaacttactttaagttcgaactaacttaacgaaactaggaactaccgtagtttaggttaactttaagtcgttaaccgtacggtactacggacgtaaccggtaacgtcccgttacggtcccgttagggacccacgggtaaccccgaaccggtaccccaaccccgttcgtacttaccccg

SEQ ID NO: 130071 - DNA, 708 bp, Homo sapiens
  misc_feature: GYAE6OF02IOYBJ.49.52.E08.1.454.CMB.1.raw
  modified_base (181)..(181): a, c, t, g, unknown or other
  misc_feature (181)..(181): n is a, c, g, or t
  modified_base (245)..(245): a, c, t, g, unknown or other
  misc_feature (245)..(245): n is a, c, g, or t
  modified_base (388)..(388): a, c, t, g, unknown or other
  misc_feature (388)..(388): n is a, c, g, or t
tcagagtcgagagacacgaccggtgctcgatttagtcgagctctcagagagaaagggggtgggtccaggaggcagaactctgggtgtctcaccatggcctggatccctctacttcctccccctcctcactctctgcacaggctctgaggcctcctatgagctgacacagcccacctcggtntcagtctccccaggacagacgccaggatcactgctctggagatgctagttcgaccaaaaccgtntatgtacttaagttcggtaaccagacagaacggccgggccacggtcccctggttcgttgggtcgtagttacgtaataaacgacaacgtaggagacggcccttacgacgggtactccgtaggacgcgtattcgtctggcctcgnggtacgaacgggtactaacgggtcaacgtagtttacggacctagtccgtaaggtacgggaacgttacccggaagggtcgaaacggggtaacggaaccgggagtccggtacggtaaacgttattttaagggttctaaacctaattaacgaaaccgtaagaacctaacgtagttttaacgggttaacttttaacgtacgtttaaccgttacggtaaccttcggtaaccgaaccggtaaacggttaccctacccggttacccgtggggttaaccacggtaccccggtaaaccgaccccctaaaccccgtcttaccgtaacccg

SEQ ID NO: 130072 - DNA, 727 bp, Homo sapiens
  misc_feature: GYAE6OF02JOLC0.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctcccctcctcactctctgcacaggctctgaggcctcctatgagctgacacagccaccctcggtgtcagtcgtccccaggacgagaccggccgaggactcaccgtgcctcgtaggagagtcgactagttcgaacccgaaaccgtatagtacgtacgtttacgttacggtaacccgtagacgaacggaacggccccggggtacccgaaccgggtccccgttggttcgggtttacggtagtagttagtaaacgtaaaacgtacctacgtaggaacggaccgtaccccgtacggaacgggtaccttcccggtaggacgtacgtacttccgttcgtcggtacctaccggacgggtcggtaaacggggtaccgtaacggtccaacgttcggtttaccgactacgtacggtagggtacggacgtaccggagggcgaaggtaacgggaccggaggttcctagtaacgttaattacgttacgtaacaacttacaaacgacgtaccacgttagttacgttattacgttcgtacgttacgtaacgtcgtaacgtacccgtaacggtccctaccggttaccgtcggtacacccgacgtacccgacccgaacccttgtaccgtac

SEQ ID NO: 130073 - DNA, 686 bp, Homo sapiens
  misc_feature: GYAE6OF02FF5Y0.49.52.E08.1.454.CMB.1.raw
  modified_base (196)..(196): a, c, t, g, unknown or other
  misc_feature (196)..(196): n is a, c, g, or t
  modified_base (243)..(243): a, c, t, g, unknown or other
  misc_feature (243)..(243): n is a, c, g, or t
tcagagtcgagagacacgaccggtgctcgatttagtcgagctctcagagagaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacngacggccaggatcacctgctctggacatgcattgacccaaaaccgtntagtgtcttattcggtaccagacaggaacggcccgggccacgggtcccctgtggttacggtgatagtaataaacgacacgtgaggacgcctcgagggtacctccgtagacgcgtattccgtcgtcggccttcggaaggtccgaacggggtaacctaaccggttaccaacgtacgtttccgggacctaattcggaacgtgggtaaccgtacccgaagggccaaagggaacgggaaccggtagggtaccttaaggtaccgtttaagtttaacgttcgtaacgaattaccaaatacggaactacccgtaagtttacggttaactttactagtttaccgttaccggaacgtttcggaccgtaacccggtaacggtcccgtacccggttccggtggtaccgaccggttaccccgaagggtcccccaaccccgtagttacgttaccccg

SEQ ID NO: 130074 - DNA, 575 bp, Homo sapiens
  misc_feature: GYAE6OF02FSTRW.49.52.E08.1.454.CMB.1.raw
  modified_base (446)..(446): a, c, t, g, unknown or other
  misc_feature (446)..(446): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctggagatgctattcgaccaaaccgatatgcttattggtaccagcagaagccggccaggccctgtgttggtgatgtataaagacactgagacggccctcgagggactccgtgacgtcgtattctcgtggctaccgaggtcgaacgggtacgaacggtcagtagttcggcctaagtcgaggtggacgtccgaggacagggacggacgaggctagacttagttatcgtanatacaacgagaccacctattacgttacttagtcgttcgttacggactgaccgtaaccgtaacggtccgtaacccgtccgtcgggtaccaccggacccgaaccggaccccaacccgtaccgtcgtacccg

SEQ ID NO: 130075 - DNA, 586 bp, Homo sapiens
  misc_feature: GYAE6OF02F897Z.49.52.E08.1.454.CMB.1.raw
  modified_base (222)..(222): a, c, t, g, unknown or other
  misc_feature (222)..(222): n is a, c, g, or t
tcagagtcgagagacacgaccggtgctcgatttagtcgagctctcagagagaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgganatgcattgaccaaaaccgatatgcttattggtaccagcagaagccgggccaggcccctgtgttggtgatgtaataaagacactgagaggccctacgagggactcccgtagacgcgtattctcgtcggctaccaggtcacggggaacgaacggtcacgtagtttcggccatcgaggtggacgtaccgaggcgaaggacgggacgaggctagacttagttattgtacaatcaaacgacgacctaacgtagtttgtaactttatacggttcttaacggaacttgaccgtaaccgaaggttccctaaccggttcccgtagggtaccacggacccgaaacgggaccccaaccccgtacgtcgtaacccg

SEQ ID NO: 130076 - DNA, 613 bp, Homo sapiens
  misc_feature: GYAE6OF02JD6BS.49.52.E08.1.454.CMB.1.raw
  modified_base (180)..(180): a, c, t, g, unknown or other
  misc_feature (180)..(180): n is a, c, g, or t
  modified_base (245)..(245): a, c, t, g, unknown or other
  misc_feature (245)..(245): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtntcagtcgtccccaggacagacggccaggatcacctgctctggagatgcattgaccaaacgatatncttattggtaccagcagaagcccgggacacggccctgtggttggtgatgtaataaaggacatggagacggccctagagggtactcccgtggacgcgtattccgttcgtacggtcctccggacggtcgaacggggacctaacgggtacaccgtaaggttcggacccagttacagggtcgggaacgtccgaaggcgaaggacgggacgacggcgtacggacttagttagttcgtactaacgtacaaacgtacgacctaaccgtaagtttacgttacttagttcgttcttacgggaactcggaccgaccgtaaggtccaaccgttcgtacggtacgaccgacccgtacggaccctaacccacgtcgtaccc

SEQ ID NO: 130077 - DNA, 790 bp, Homo sapiens
  misc_feature: GYAE6OF02IGZGU.49.52.E08.1.454.CMB.1.raw
  modified_base (230)..(230): a, c, t, g, unknown or other
  misc_feature (230)..(230): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctaatgagctgacacagccaccctcggtgtcagtcgccccgaggacacggacggacctagtactcactgctcgtgganatcgctattcgacaaaacgctaaatagtgtacttacgtacggtaccagaccaaggacgaccgacggccgaccgtccccttagttaccgttcgtacttacttaagttttaagtaaaacgttgtttacggaacgggtaccggtacctaccgggaaccgggtcccgagtacggtacgtaacttccgttacgttcggtacctaacgtcggtactaaccgaggaaaccgtaacctaaacgtaacgttaccgttaaccggttacgtaacccgtacttaacggacggttacggtacccggggtaacggtaccggaaacgggacgggtaacggacggttacggtaacgtaaccgttaactttaccggttacgtacgtacgtaacgtacgttacgaacgttaacgtaacggttacgggtcggtaacctttaccgtttacgtttaccgttacggttaacggtttaccggggaccgggtaaccgggaaccgtaaccggttaccgtaccgggttacccggttaccgttaaccgggttacccgaaccgggtacccggtaccgggtacccccgg

SEQ ID NO: 130078 - DNA, 617 bp, Homo sapiens
  misc_feature: GYAE6OF02I5ZL7.49.52.E08.1.454.CMB.1.raw
  modified_base (210)..(210): a, c, t, g, unknown or other
  misc_feature (210)..(210): n is a, c, g, or t
  modified_base (414)..(414): a, c, t, g, unknown or other
  misc_feature (414)..(414): n is a, c, g, or t
  modified_base (513)..(513): a, c, t, g, unknown or other
  misc_feature (513)..(513): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgacggcctcctatgagctgacacagtccaccctggtgtcttgtgtcctcaggacagacggccaggntcacctgtctctggcgatgactattcgaaccaaaaacatatgtacttacgtcggtaaccagacgacggaacggccgaggccacggtcccttgtcgttggtcgtaatttaataaagtacgtttaggacggtacggccccgttagaccgggtacccctggacgcgtacttccgtcgtcggcctcacgtcgtacgaagggaccaaanacgtctaccgtttacaccagtacgtaggcgggtacgcccggacagggtaggaacggaggcttagaacttactttacgtgtacgacgtccgacgtagacnggactaggtcgtcgtagttgttgtacgttggtcgggacggacgggtcgtaccgcgtacggtccgttaccggtgtaccgccgacccgtaggtcctcccggtcccg

SEQ ID NO: 130079 - DNA, 583 bp, Homo sapiens
  misc_feature: GYAE6OF02IHU4H.49.52.E08.1.454.CMB.1.raw
  modified_base (252)..(252): a, c, t, g, unknown or other
  misc_feature (252)..(252): n is a, c, g, or t
  modified_base (379)..(379): a, c, t, g, unknown or other
  misc_feature (379)..(379): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcacatctcctgcactgaaaccagcagtgatgtaggaattataaccttttcnctaggtaccaacaaccaccaggacaaacgccccaaactcaactctatttatacggacggccgaatcgaacgccggaccctaggagggtcctactgtatccgtacttctctggcctcgacgtcgtgcngccgacgcctccgacgacaatcctcgtcggccgtcaggtcgtcgggacgcggctagttacttattacgttgtccgtttgtactagtacgttcggaccgtagtagttacggtcggtacggtaacgggttcgtacgggacgggacggaacggtaagggacgtaccgtacgtagtcgacgaccgagtccgtccgtccccgtgtaccc

SEQ ID NO: 130080 - DNA, 852 bp, Homo sapiens
  misc_feature: GYAE6OF02I2HJS.49.52.E08.1.454.CMB.1.raw
  modified_base (228)..(228): a, c, t, g, unknown or other
  misc_feature (228)..(228): n is a, c, g, or t
tcagagtcgagagacacgaccggtgctcgatttagtcgagctctctcggcggggggggtcacaagaggcagcgctctcgggacgtctccaccatggacctgggctctgctgctcctcactctcctcactcaggacacagggtcctgggcccaggtctgcctgactcagcctgcctcgtgtctgggtctccgtggacaggtcatcaccatcctctgcacgtcgaaaccngacacgtagagttcggtaggtaacttaattaaccttttctaccgtaggtaaccctaaacgaaacctaccccgacgggacctaaaccggaccccctaaaacttccaattaccttaagtttaacggtaggaaccgggacccgtaagtaccgtaacggccggtaccccgtggtaaccggggttctcgtacgggtactcggtccttacgtcgtcggtacgtcccggaacggttcgtagggaccgttacggaccgtacccggggtccctttaccgtaagtaacccggtaaactttcccggtaccgggtcgggccctaccgggtaaacgggtcggttacgggggaaccgtcggggttacttacggtaaacgtttagtttaacgttcgtcccggtttaagttacgttacggtttacgttaaccggggttccgggttaaggttaacggttacggggtttaaccgggaccggggtttaaacggggtacggttaccgggggtaacgggtacggggtaaaaccgttaacgggggtacccggtttaaccgggtaacggtccgggtttaaaccgaccgggtacccggttaaacggtcccggttaacccccgggtccccgttaagggttacccccggg

SEQ ID NO: 130081 - DNA, 629 bp, Homo sapiens
  misc_feature: GYAE6OF02G77OW.49.52.E08.1.454.CMB.1.raw
  modified_base (230)..(230): a, c, t, g, unknown or other
  misc_feature (230)..(230): n is a, c, g, or t
  modified_base (290)..(290): a, c, t, g, unknown or other
  misc_feature (290)..(290): n is a, c, g, or t
  modified_base (308)..(308): a, c, t, g, unknown or other
  misc_feature (308)..(308): n is a, c, g, or t
  modified_base (340)..(340): a, c, t, g, unknown or other
  misc_feature (340)..(340): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacagggtcctgggcccagtctgccctagactcagcctgcctccgtgtctgggtctcgtggacagtcgactcaccatcctcctgcactacgaaaccngcagtgtatggttaggaattacttaacctttctcgtacgtaccaacacaccagacaaacnccccaatcatactatttngacgcgatcgagccgctgacgggtctcgtagntccgtcttctacgtcggcctaccgtacgtacgtcggactacggcctacccggtcctaccgtagacctactccgtcggtcggcctaccgcggtcggtacgggaccgtggtacttagtaatttattatcggtcttgtacgtagttcgtacgggtccgttagtacggttacgtcggggaaccggttaaggggtccggttaacggggcgggaacgggaacgttaacgggccgttaccggtaccgtacgtagacccggaccggacggtcccgtacccggtaccccggtgtcccg

SEQ ID NO: 130082 - DNA, 679 bp, Homo sapiens
  misc_feature: GYAE6OF02H8TPY.49.52.E08.1.454.CMB.1.raw
  modified_base (305)..(305): a, c, t, g, unknown or other
  misc_feature (305)..(305): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacagctctgaggcctcctatgagctgacacagcccacccgtcggtgtcagtgtcccaggacagaccggccaggatcacctgctcgtggagatgctatcgaccaaaccgatatcgtactttagttcgaccagacgagaacggccggccgacggccccgtgtcgttgggtanagttagttaataaagactacgtagacgacggccctcgacgggtactcccgtagacgtacgtacgttcctcgtcggtaccttacggaacgggttaccgaaggggaacctaaaccgggtaccaacgttaacgtcgggaacctacgtacgacgggttcggaacgtccgtacgggacgtaacgggaacgggacggacggtcgtacggtaacgttactttacgttacgtaactaataaccgaaacgtaacgaccctaaccgttagttttaaccggttaatttaaggttcgttaacgttaccggtacgtacgccgtaaacgtacggtaccgtaccgtcgtacggacgaccgtaccgaccggacccaccctacgtcgtacc

SEQ ID NO: 130083 - DNA, 568 bp, Homo sapiens
  misc_feature: GYAE6OF02HSGZL.49.52.E08.1.454.CMB.1.raw
  modified_base (182)..(182): a, c, t, g, unknown or other
  misc_feature (182)..(182): n is a, c, g, or t
  modified_base (232)..(232): a, c, t, g, unknown or other
  misc_feature (232)..(232): n is a, c, g, or t
  modified_base (251)..(251): a, c, t, g, unknown or other
  misc_feature (251)..(251): n is a, c, g, or t
  modified_base (298)..(298): a, c, t, g, unknown or other
  misc_feature (298)..(298): n is a, c, g, or t
  modified_base (340)..(340): a, c, t, g, unknown or other
  misc_feature (340)..(340): n is a, c, g, or t
  modified_base (441)..(441): a, c, t, g, unknown or other
  misc_feature (441)..(441): n is a, c, g, or t
tcagagtcgagagacacgaccggtgctcgatttagtcgagctctcagagagaaagggggtgggtccaggaggcagaactctgggtgtctcaccatggcctggatccctctacttctcccccctcctcactctctgcacaggctctgaggcctcctatgagctgacacacgcccacctcggtntcagtcgtccccaggacaggaccggccaggactccgacctgcctctgganatgcattcgacccaaacgntatgtcttagttcgtaccagcagaacgccggccacggccctgtgtgngatgtaataaacgctacgtgagacgtcccagaggtactccgngacgctacttctgtcggctcgaggtcgacggtacacggtcacgtagtcggacatcgaagtcgagtccgagcgaggcgacgaggtcgtagtatagtttagtntactaacgtcaaacgacgacctacttagttacgtaatttcgtacgtacgtacgtacgtcgtaacgaaccgtaaggtccctacgtcggtacgtccacgtaccgaccgtacccaacccgtcgtcgtacc

SEQ ID NO: 130084 - DNA, 796 bp, Homo sapiens
  misc_feature: GYAE6OF02H0GFI.49.52.E08.1.454.CMB.1.raw
  modified_base (232)..(232): a, c, t, g, unknown or other
  misc_feature (232)..(232): n is a, c, g, or t
tcagagtcgagagacacgaccggtgctcgatttagtcgagctctctcggcgggggggggtcacaagaggcagcgctctcgggacgtctccaccatggcctgggctctgctgctcctcactctcctcactcaggacacgagggtcctgggcccagtctgccctgactcagcctcgcctcgtgtctgggtctccgtggacagtcgatccaccattctcctgcactacgaaaccngcagtcgtagttggttaggtaatttaacttaaccttttctaccgtaggtaacccaaacaaccaaccgaggaaccaaaccgacccccctaaaactcaacttacttaatttagacggacggtaccgtactccgtaacggccggtaccccgtacgggtaggggttcctcgttacgacgttccgttccttccgtcggttccggtccttacccgtaacggttccggtcggaccgtacggcccgtacccgggtcccctcccgttaacgtaacgtaacgttccggttacccgggtacggggtccctaccgggtaaccggggtcgggtacgggggtaaccggtacggtaccgtttaagtttaagtttaactttacggtttccgttcgttacgttacttaaggtccggttacgggtccgtagtaacggtcgggttacggtaacgggttaggggttcgggttccgggacgggaaccgggtaacggtaacgggttacccggtaccggttaaccggttacggaccgtaccggtacccggtacggttccccgcccggttcccccgtacggttacccg

SEQ ID NO: 130085 - DNA, 635 bp, Homo sapiens
  misc_feature: GYAE6OF02FSOH3.49.52.E08.1.454.CMB.1.raw
  modified_base (226)..(226): a, c, t, g, unknown or other
  misc_feature (226)..(226): n is a, c, g, or t
  modified_base (231)..(231): a, c, t, g, unknown or other
  misc_feature (231)..(231): n is a, c, g, or t
  modified_base (290)..(290): a, c, t, g, unknown or other
  misc_feature (290)..(290): n is a, c, g, or t
  modified_base (301)..(301): a, c, t, g, unknown or other
  misc_feature (301)..(301): n is a, c, g, or t
  modified_base (363)..(363): a, c, t, g, unknown or other
  misc_feature (363)..(363): n is a, c, g, or t
  modified_base (366)..(366): a, c, t, g, unknown or other
  misc_feature (366)..(366): n is a, c, g, or t
  modified_base (428)..(428): a, c, t, g, unknown or other
  misc_feature (428)..(428): n is a, c, g, or t
tcagagtcgagagacacgaccggtgctcgatttagtcgagctctctcggcgggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcaccatctcctgccactgaaaccngcagngatggttaggaattatacctttctcctgtaccaacaacaccaggcaaacgcccccaaancatactattangacgccatcacgccggcctcggacgggttctctgactcgtcttctcgtcggctccgacgtcngcncgaccaccgtccctcctacgacctaacgtccttcgcgggtcctcgaggcggtaggggaccgnggtccttagtagtttaacttagttcgtacttcggttactagttacggtcggtaccgggttagtacggttacgggacggtaccgggtaaggggtttccgggttcggggacgggaacgggtaaccggtaacggggttcgtaacccggttcgtacgggtacccgacggtacccgaaaggtcccgtcccggttacccccgtcggttacccc

SEQ ID NO: 130086 - DNA, 676 bp, Homo sapiens
  misc_feature: GYAE6OF02H1W12.49.52.E08.1.454.CMB.1.raw
  modified_base (327)..(327): a, c, t, g, unknown or other
  misc_feature (327)..(327): n is a, c, g, or t
  modified_base (640)..(640): a, c, t, g, unknown or other
  misc_feature (640)..(640): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggccctcctatggagctgacacagcccacccgttcggtgtcagtcgtccccgaggacaggacggccaggactcacctgctcgtaggagatcgcagttcgaccaaaccgatatgactttagttcggtacagacaaggaacgccgggtaccacggccccgttgtggttgtgtagttacgtaanaaagtactacgtgaacggacggtccctacggaagggacttccgagacgtcgtacttcgtcgtgaccgttcgtacggtacgtacgggaacctaacgggtctaacgtagttcggacctagtacgtacgggttacgggtacgtccggaagggtacgaagggacggaacgggtacggccgttagtaacgttaacgtttagtacgtaactaagtaaccgtaagaaaccgtacctaacgttagtttacgttaacgtttagtacggttaccgttacgtaactcgaaccgtaacgcggtaacccgtcgtccggttacggtnaacccgtaccgaacgtaccccaacctcgtcctaccc

SEQ ID NO: 130087 - DNA, 701 bp, Homo sapiens
  misc_feature: GYAE6OF02IUY02.49.52.E08.1.454.CMB.1.raw
  modified_base (228)..(228): a, c, t, g, unknown or other
  misc_feature (228)..(228): n is a, c, g, or t
tcagagtcgagagacacgaccggtgctcgatttagtcgagctctcagagagaaagggggtgggtccaggaggcagaactctgggtgtctcaccatggcctggatccctctacttcctcccctcctcactctctgcacaggctctgagcctcctatgagctgacacagccaccgtcggtgtcagtcgtcccaggacacgacggccaggactcaccgtgctcgtaggganatgctattcgaccaaaccgatatcgtacttagttacggtaccagacgaagaacggccggaccgacggtccccgtggttacggttggtagaacgttgtaaacgtaaagaaccgtacgtaggaacggtaccggtacccgttacgaacgggtaccttacccgtggtaacgaccgttacgttccgtcgttacggtacctaccgtaggtaccggacggaaccgtaaaccggtacaaccgtacgtttacggacccgtaagttacgaagggtaccggtacgtaccggaaggacgtaacgggaacgggacggtacgtaacgtacgtaattaacgtttagtagtaacgaactacgaacgtacgaaacctaccgttagtacttacttatacgttagttaccgacgtggtaccgtaacggaacgttacctaccggttacgaccggtacaccgaccgtaaccggacccacccgtacgtcctaccg

SEQ ID NO: 130088 - DNA, 798 bp, Homo sapiens
  misc_feature: GYAE6OF02F76JE.49.52.E08.1.454.CMB.1.raw
  modified_base (218)..(218): a, c, t, g, unknown or other
  misc_feature (218)..(218): n is a, c, g, or t
  modified_base (231)..(231): a, c, t, g, unknown or other
  misc_feature (231)..(231): n is a, c, g, or t
tcagagtcgagagacacgaccggtgctcgatttagtcgagctctctcggcggggggggtcacaagaggcagcgctctcgggacgtctccaccatggccctgggctctgctgctcctcactctcctcactcaggacacgtagggtcctgggcccagtctgccctgactcacgcctcgcctccgtgtcgtgggtctccgtggacagtcgatcacatctcngcactcgaaaccngcagtgattaggtaggttaattacttaacctttcacgtacgaaccaacaacaccgaagacaaaccgcccaaatcaactctattacggcgacggtcgtatcgacggccggccgtacggcgggttccacgtgtacgtccggtcttacgtacgtcggtacccttaccgtacgttacggtcggaccgtacggcccggacccggttcccctaccgttacgaacctaacgttcccgttaccgggtcgggtacccgtaccggtacgggacgggtacgggggaccggacggttaccgttaagtttacgtttaacttttcggttacggttccgtttacggttaaccttagttaaccgggttcggtacgggttacgtaacgggttaccgggttaccggggtaacgggttaaacgggggttccgggtttaaccgggggtacgggggtacccggggtaaaccgggttacggggttacccgggttaacccgggttccggtttaacggtacccggttaaccggggaccccggtaacgggtcccccggtttacccgggaccccgtacggggtttaaccccgg

SEQ ID NO: 130089 - DNA, 847 bp, Homo sapiens
  misc_feature: GYAE6OF02JOOUV.49.52.E08.1.454.CMB.1.raw
  modified_base (159)..(159): a, c, t, g, unknown or other
  misc_feature (159)..(159): n is a, c, g, or t
  modified_base (253)..(253): a, c, t, g, unknown or other
  misc_feature (253)..(253): n is a, c, g, or t
  modified_base (359)..(359): a, c, t, g, unknown or other
  misc_feature (359)..(359): n is a, c, g, or t
tcagagtcgagagacacgaccggtgctcgatttagtcgagctctcagagagaaagggggtgggtccaggaggcagaactctgggtgtctcaccatggcctggatccctctacttcctcccctcctcactctctgcacaggctcgtagacggcctcctangtacgctacgacacgacgcctaccctggtcgtacaggtccgtaccccgaggaacacggaccgacccgagactaccacctggtctccgtaggganactgacctagtcgaaacccaaaccgtatacgtagtctttaaggttcggtaaccgtacgcgaaaggaccggacccgggccaccggtcccgttggttcggttagggtntaagttagttaaacgaaacgtaccgtaacgtaagggaacggtaccggtccccgttaacgggacggttaccccgtaccgtagggaaccggcgtttcttaccgtcggtaccggtacccgtaacggtacggttacccgggaacgggtaaacccggtaacgtttacccgaacgttaacgggttaccggacccgttaaggaccgttagggtaccggtaaccgggtaccggtaacgggaacggtaaacgggtaaacgggtacgggaacgggtacgtttacggtaaaccgtttaaggtttacgtacgtttaaccgaaacttaaccgaactaaccgtaacgttaccgtaacgttttaacggttacgtttaacgttacgttaaccgtaccgtaacgtaccgtaacggtaccgtaaccggtaacccgttccggtaccggtccggtaagaccccggacccggttaaccggaccctaaccccgttagtaccccgtaaccg

SEQ ID NO: 130090 - DNA, 617 bp, Homo sapiens
  misc_feature: GYAE6OF02FGBKU.49.52.E08.1.454.CMB.1.raw
  modified_base (222)..(222): a, c, t, g, unknown or other
  misc_feature (222)..(222): n is a, c, g, or t
  modified_base (241)..(241): a, c, t, g, unknown or other
  misc_feature (241)..(241): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctggtgtcagtgtccccaggacagacggccaggatcacctgctctgganatgcattgacccaaaacgntatgcttattggtaccagcagaacgccgggccaggcccctgtgttggtgatgtaataaagacactggacgaggtcccctacgacgggtactcccgtggacgtcggtattcctacgtcggtcctcccgtacgggtcaacggggtaacgaaacgggtcaacgtatttcggcctaagtcgagtggacgtccgaggcaaggacggacgaggcgtgacttaagttattacgtacaactacaacgacgaacctaaccgtagtttacggttaacttattacgttcgttacggtaacttcggaccgaccgtaaacggtccaaccccggttcgtacgggttaccacggccccgaaaccggaccctaaccccgacttacgtacccg

SEQ ID NO: 130091 - DNA, 798 bp, Homo sapiens
  misc_feature: GYAE6OF02H8U5D.49.52.E08.1.454.CMB.1.raw
  modified_base (136)..(136): a, c, t, g, unknown or other
  misc_feature (136)..(136): n is a, c, g, or t
  modified_base (183)..(183): a, c, t, g, unknown or other
  misc_feature (183)..(183): n is a, c, g, or t
  modified_base (267)..(267): a, c, t, g, unknown or other
  misc_feature (267)..(267): n is a, c, g, or t
  modified_base (359)..(359): a, c, t, g, unknown or other
  misc_feature (359)..(359): n is a, c, g, or t
tcagagtcgagagacacgaccggtgctcgatttagtcgagctctcagagagaaagggggtgggtccaggaggcagaactctgggtgtctcaccatggcctggatccctctacttctcccctctcactctctgcacncggctctgacggcctcctatgagctgacacagccaccctcggtgtcngtcgccctggacagacggccaggacttaccgtggtagggggaaacactagttggaaagtaagactgtcgacacgtggtaaccgngacaagaacgccgaggtccaccggcccctggcgtcgtggttcctcgtagtggtgagtcggaccgacccggtccctcggagggtacctccggngacgtcgtattccgtcgtcggcccttacgaacttcggtaccgggaaccccgccctaaccgtcgaaaccctgtacccgacggggtcccgggtaaacggtaacggggtacggggtagtaccgggaaccgggtaccccgtaactttaaccgtttacgtacggttaccggtagggttacgggtacggggttaaagtttacggggttacgggttaggttcggggttcggttaccggtttcgggtttacggggacggttcgggtaccggggtaaccggtccgggttacccgtacccgggttccgtacgggtttacccgaaccggtaacccccggtaaacccggaccccggttaaccccgtacggttaccgtaccccgtttaccgttcccgtttaccccggtcccccgtaaccccttcccgttcccgtttccccgtccgttacccg

SEQ ID NO: 130092 - DNA, 700 bp, Homo sapiens
  misc_feature: GYAE6OF02G73PG.49.52.E08.1.454.CMB.1.raw
  modified_base (515)..(515): a, c, t, g, unknown or other
  misc_feature (515)..(515): n is a, c, g, or t
  modified_base (570)..(570): a, c, t, g, unknown or other
  misc_feature (570)..(570): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacaggacggccgaggactccacctgcgtccgtggagatcgactattcgaaccaaaccgatatgtctttagttacggtaccagcaagacggccggccacggtccccgtggttgttggtcgagtagtaacgtaagaccgtacgtggaacggacggtcccgtacgacgggtacctccgtagcgtacgtacgttccgtgtccggtcctccggtacggtcggtaacgggtaaccgaaccggttccaagttacggttaccggtacctaccgttacgtacggtcggtaaccggtaccgaagggaccgaaaggacgggtaaaccggnggtacgttaacgtaacgttagttaacgttcgttaacgactaaacgaccggtaaanacccctaattacggttacgttactttagtttacgtacgttacgtaccgtacggactaaccggtaagttccgtccgtacggtcgtaccgaccggtacccgaccgtaaccccgaaccgtctaccgttacccg

SEQ ID NO: 130093 - DNA, 780 bp, Homo sapiens
  misc_feature: GYAE6OF02HC4HM.49.52.E08.1.454.CMB.1.raw
  modified_base (231)..(231): a, c, t, g, unknown or other
  misc_feature (231)..(231): n is a, c, g, or t
tcagagtcgagagacacgaccggtgctcgatttagtcgagctctctcggcgggggggggtcacaagaggcagcgctctcgggacgtctccaccatggcctgggctctgctgctcctcactctcctcactcaggacacagggtcctgggcccaggtctgccctgactcagcctgcctcgtgtcgtgggtctcctggacaggtcgatccaccatctcctgccactacgaaacngcagtgtagtggtaggtaattacttaaccttttcctaccgttacgtaacctaaaccaaccacccgtaaggacctaaaccgaccccctaaactacactactactttagtcggacgacgatcgacggccggaccctacggtacgggttctacgtacgtcgtaccgttccttaccgtcgtcgggtaccctccgtacggtcgtcggtaccacggtaccggtccggtacccttacccggaacgtaacctaacctcgttaaccgggttccggggacccgtcggaacggggttaccgggtaacgggggaccggtaacgggtccgttaaggttaactttttaacggtttacgtcgggtttacctaacggtttaaccttaggttaccggttagggccggttaagttacgggttaacgggttccggggtaacggtaaacgggggttgttaaccgggggacgggaagggtaaaccggacgggttaccggttaccggtaccggtaacggtaccggtaccgtaccggtaccggttccgtaccccggtccggttacgtacccg

SEQ ID NO: 130094 - DNA, 839 bp, Homo sapiens
  misc_feature: GYAE6OF02HS78Y.49.52.E08.1.454.CMB.1.raw
  modified_base (145)..(145): a, c, t, g, unknown or other
  misc_feature (145)..(145): n is a, c, g, or t
  modified_base (279)..(279): a, c, t, g, unknown or other
  misc_feature (279)..(279): n is a, c, g, or t
tcagagtcgagagacacgaccggtgctcgatttagtcgagctctcagagagaaagggggtgggtccaggaggcagaactcctgggtgtctcaccatggcctgggactcccgtcttacttcctccccctctctactctctgcacgnggctcgtgacgccctcctatgagtctgacacgcgtcccgacctcgggtgtcagttcgtccccgacgggcaggaccggcctaagggactccaccgtgcttcgtaggacgattcggctagttcgaccgtaaacgtntagtgactttagtcggtacagcaggaacggcccggacgacggtccctggttaggttcggtaggtagttacgtaagttaaacgcgtacgttggaacggtacggtcccttaagggacggtaaccgtcccgtaggtaacgaccgtattttaccgtccggttacggtacccgttaccggtaaacgggttacccgggtaaaccggggtaaccggtaaaaccggggtttcccaaaccggtttaacggtttacccggtaaccttaacccggttaccggtaacggggtttaaccggggtaaacttccccgggaaagggtaccgtaaagggggtaaccgggacgggtacgcgttaaacgtaacttaacgtttagtacgtaataaccgttaacaaaccgtaggtaccctaacttttacggtaacgtttaaccgttgtacggttaccgtttacggaacctttcgggtaaccgaaccgggtaccgtacccggttacccgttacgttaccgggtacgaaccccggtcccggtaaaccggaacccccgttaaccgtcccgtagttaacccccgg

SEQ ID NO: 130095 - DNA, 579 bp, Homo sapiens
  misc_feature: GYAE6OF02IQ5PC.49.52.E08.1.454.CMB.1.raw
  modified_base (302)..(302): a, c, t, g, unknown or other
  misc_feature (302)..(302): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaaccgatatgcttattggtaccagcagaagccgggccaggcccctgtgttggtgatgtataaaganactgagacggccctgagggactcccgtgagcgtattctcgtggctccgaggtcgaacgggacaacggtcacgtagttcggcctagtcgaggtcggacgtccgaggcaaggacggacggaggctagacttattagttgtacaatcaaacagaccaacgtagttacgttaacttagtcgttacgttacggaacttggaccgtaaccgtaaggtcccaccggttccgtacgggtaccaaccggacccgaaccggaccccaaaccccgtacgtccgtaccc

SEQ ID NO: 130096 - DNA, 775 bp, Homo sapiens
  misc_feature: GYAE6OF02FT859.49.52.E08.1.454.CMB.1.raw
  modified_base (241)..(241): a, c, t, g, unknown or other
  misc_feature (241)..(241): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctggtgtcagtcgtccccaggacagacggccaggatcacctgctctggagatgcattcgccaaaccgntatgcttattggtaccagcagaagccggccaggcccctgtcgttggtgatgtagtaaagacacgtgacgaggccctacgaggggtactcccgtaggacgacgtatttacctcgttcggccgtacccgacgggttcgaacggggtaacccaaacggggttccaaccgtacggtttacgggacctaagttacccgaagggttcgggaacgtttacccggaagggtccgaaggggtaacggggaaccggaacggggtaccttaggtaacccgtttaattttacgttaacgggttacctaaaagtacccgtaaaaccgtaacggtaaccctaaacccggtttaagttttacgggtttaaaccttttaagttcccggtttaaccgtttaccgggtaaccgttccgggaaccggttaaaaccccggtaacgggttaaccccgtaacccccgggtttccggtaacccggggttacgaacccggtacccccgtaaaaccgggggccccctaaaaccccccgtaccgttaccggttaaccccc

SEQ ID NO: 130097 - DNA, 587 bp, Homo sapiens
  misc_feature: GYAE6OF02IYXZB.49.52.E08.1.454.CMB.1.raw
  modified_base (224)..(224): a, c, t, g, unknown or other
  misc_feature (224)..(224): n is a, c, g, or t
  modified_base (241)..(241): a, c, t, g, unknown or other
  misc_feature (241)..(241): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccacccctcggtgtcagtgtccccaggacagacggccaggatcacctgctctgganatgcattgaccaaacgntatgcttattggtaccagcaagaacgccgggccagggtccccctgttggttgggtgagtgtaagtaaaagaacacgtagacggacggtccctacgagggtactcccgtgagacgtattctcgtggcctccgtaggtcgaggacaacggtacacgattggccagtctagcggtacgtccaggacgaggagggacgagggtactaggacttatttattagtacaacttacaaacagtaacctacgagtttacgtaacttgtacgttcgttacgtaacgtcgaccgtaacgtaacgtccgtaccgttccgtacgggtcacgacccgaacgcccaaccctacctgtaccc

SEQ ID NO: 130098 - DNA, 653 bp, Homo sapiens
  misc_feature: GYAE6OF02FXDV1.49.52.E08.1.454.CMB.1.raw
  modified_base (224)..(224): a, c, t, g, unknown or other
  misc_feature (224)..(224): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatgcattcgacccaaaccgatatgtcttagttggtaccagacagaacgccgggaccacggcccctgtgttggtgatgtaataaagacactgagacggccctcgagggactcccgtgacgcgtacttctcgtcggtcctccggacggtcgaacggggaacctaacgggtaccaacgtacgttcggacctagtaccgaggtgggtacgtaccgaagggtccgaacgggaagggaccggtagggtcttaggtaacttagtttacgttagtactaacgtacaaacgagtaacccgactagttacgttacttagtcgttcgttacgtacgtacgaccgtaaccgtaaggttacccgtacccggtccggttacggtaccgaacccggtacccgaaacccgggtaccccctaaccccggtacgttccgttaccccg

SEQ ID NO: 130099 - DNA, 220 bp, Homo sapiens
  misc_feature: GYAE6OF02F0FCG.49.52.E08.1.454.CMB.1.raw
  modified_base (152)..(152): a, c, t, g, unknown or other
  misc_feature (152)..(152): n is a, c, g, or t
  modified_base (203)..(220): a, c, t, g, unknown or other
  misc_feature (203)..(220): n is a, c, g, or t
tcagagtcgagagacacgaccggtgctcgatttagtcgagctctctcggcgggcacgaccggtgctcgatttagtcgagctctctcgcggcacgaccggtgctcgatttagtcacgcgagaaagggaaaggggctggccctgacgtgtttcngttcccgccctcctctctctcgactctgagcgggctggcaaggcgcatagnnnnnnnnnnnnnnnnnn

SEQ ID NO: 130100 - DNA, 616 bp, Homo sapiens
  misc_feature: GYAE6OF02FL8RU.49.52.E08.1.454.CMB.1.raw
  modified_base (225)..(225): a, c, t, g, unknown or other
  misc_feature (225)..(225): n is a, c, g, or t
  modified_base (247)..(247): a, c, t, g, unknown or other
  misc_feature (247)..(247): n is a, c, g, or t
  modified_base (365)..(365): a, c, t, g, unknown or other
  misc_feature (365)..(365): n is a, c, g, or t
  modified_base (435)..(435): a, c, t, g, unknown or other
  misc_feature (435)..(435): n is a, c, g, or t
tcagagtcgagagacacgaccggtgctcgatttagtcgagctctcagagagaaagggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggactcacctgctctggganatgctattcgacccaaaaccgntatgtacttagttggtaccagcaacggaacgccgggtccacggtcccctgtggttggcgatgtaataagacagtgagacggcctagaggtactccgtgagacgtatctacgtgctcgnggtacgagggtacacggtcactacgtcggacctagtcgagtcgggaacgtcgaggacgacggaggaccgnggtcgtagtaccttagtttagtcgttaacaattcaaacgcgaaacctaccgttagttacgttaacgttagttcgttaccgtaacggtacgtcgtaccgtaacggtaccgttacggtacccgttacgggtccgtacgtaccggtacccgaaccggcccccgtaaacccgtactaccgtaccc

SEQ ID NO: 130101 - DNA, 606 bp, Homo sapiens
  misc_feature: GYAE6OF02GR0OU.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttagttggtaccagcagaacgccgggccacggcccctgtgttggtgatagtaataagacacgtgacgacggccctacgacgggactcccgtgacgcgtacgttctcgtcggctaccgaggtacgacgggacgaacggtcacgtagttcggcctagtcgaggtggacgtaccgaggcgaaggacggacgaggcgttagacttagttagttgtactaatacaaacagaaccaccgtagtttacgttactttagtcgttacgttacgtacgtcgacgtaaccgtaacggttacctacccggttaccgtcgggtaccgaccggtacccggaaccggtaccccaaccccgtaccgtacgtacccg

SEQ ID NO: 130102 - DNA, 631 bp, Homo sapiens
  misc_feature: GYAE6OF02GQCWK.49.52.E08.1.454.CMB.1.raw
  modified_base (225)..(225): a, c, t, g, unknown or other
  misc_feature (225)..(225): n is a, c, g, or t
  modified_base (313)..(313): a, c, t, g, unknown or other
  misc_feature (313)..(313): n is a, c, g, or t
  modified_base (434)..(434): a, c, t, g, unknown or other
  misc_feature (434)..(434): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcacatctcctgcactagaaaccngcagtgagttgttaggtaattacttaacctttctccgtacgtaccaacaaccaccgagacaaaccgaccccaaactcatactagttangacgccgatcgacgccgccctgtacgggtctacgtgtactcgtcttcgtacgtcgtctccgtacgtcgcggacacgccgcccggtccctcccgtacgaacctactcgtcgtcggctaccgngggacggtcggggacgtcggtacttaggtactttaattcgttcgtacgttcttacgtagttacgtcggtaccggtagtagtacggggtacggtacgggtacgggttcggtcgggacgggtacgggtaacgtacgggtaccggtaccgtacgttcgacgtcggaccgtacggtccgtacccggtccccgtacgtaccg

SEQ ID NO: 130103 - DNA, 660 bp, Homo sapiens
  misc_feature: GYAE6OF02H4PCS.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctctcactctctgcacaggctctgaggcctcctatgagctgacacagcccaccctcggtgtcagtcgtccccgaaggacaggacggccaggactccaccgtgctcgtggagatgactattcgaccaacgtatatcgtacttagttacggtaccagacacggaacggcccggaccaccggtccccgtagttggttcggtgtacgttagtaagtaaacgtacgtaacgtaggacggaccggtccctacggacgggtactaccgtagacggtacgtacttccgtacgtcggtacctccggtaggtaccgacggtaaccgtaacggtccaacgtcgtttcggacctagtacggtacggtggacgtaccgaggtaccgaagggacggacgacggtactagtaacgttagttacgttacgtactaaactacgaaccgtaacgacctacgtagttacgtacttagtcgttacgtacgtactacgacgtaacgtacggtcctaccgtacgtcgacgtacgacccaacgacccaaccgtgtcgtacccg

SEQ ID NO: 130104 - DNA, 619 bp, Homo sapiens
  misc_feature: GYAE6OF02HF9VJ.49.52.E08.1.454.CMB.1.raw
  modified_base (423)..(423): a, c, t, g, unknown or other
  misc_feature (423)..(423): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagcccacccctcggtgtcagtcgtccccaggacagaccggccaggatcacctgctctggagatgcattcgacccaaaccgtatagtgtcttaattggtaaccagcaagaacggcccgggccacggtcccctggttgttcggtgagtgtaataaagacacgtggagacggccctcgagggtactcccgtgacgctattcgtcgtggcctcgaggtcgagggacgaacgtcactacttggccatcgagtcggagtacgnggtacgagagggacaggcttagacgttagttacttagtaccaagttacaaacgtacgtactaaccgtagtttaccgttaatttaacgtcgttaaccgttacggtaaccgtcggaccgttaaccgaacggttccgtaacccgttcgtaccgggtacaccggtacccgtacggacccctaacccgtcgtacgtacccg

SEQ ID NO: 130105 - DNA, 584 bp, Homo sapiens
  misc_feature: GYAE6OF02FUHGX.49.52.E08.1.454.CMB.1.raw
  modified_base (579)..(579): a, c, t, g, unknown or other
  misc_feature (579)..(579): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctcgtggagatgcattcgaccaaacgatatgtcttagttggtaccagcaggaacgccgggcacggcccctgtgttggtgatgtataaagacacgtaggagacggccctacgagggtactcccgtgaggccgtattccgtcgttcggctcccgaggtcgacggggaacaacggtcacgtagttcgcctatcgaggtcggacgtccgaggtacgaggaacgggacggacggcgttacggaactttagttacgttacgtactaataacgtaacacgacctaacctatttacggttacttattcgtacgttacgactgacctacgaaggtccaccgtcgtggtacgacgccgaaccgcccaccgctntaccg

SEQ ID NO: 130106 - DNA, 795 bp, Homo sapiens
  misc_feature: GYAE6OF02I85R4.49.52.E08.1.454.CMB.1.raw
  modified_base (165)..(165): a, c, t, g, unknown or other
  misc_feature (165)..(165): n is a, c, g, or t
  modified_base (246)..(246): a, c, t, g, unknown or other
  misc_feature (246)..(246): n is a, c, g, or t
tcagagtcgagagacacgaccggtgctcgatttagtcgagctctcagagagaaagggggtgggtccaggaggcagaactctgggtgtctcaccatggcctggatccctctacttctccccctctcactctctgcacaggctctgaggcctcctatgagctgacanacgccaccctcggtgtcagtgtccccaggacagacgccaggatcacctgcttcgtacggagatgcattcgaaccaaaccgnttactgtacttagttcggtaccaggtaccaaggaacggccccgggaccgacgggccccccgttggtttcggtttgggttggtaacgtttaggttaaacgtaaacggtaacctaaccgttgggaaacggtaccgggaccccgttacggtaacggggtaccttaccccgtaggaggtaccgtttacgttccgttcgttcgggtaccttccccggtagggtaccggaacggggtaaccgtaacggtacccacgttagttccgggacctacgtacgaggttagggtaaccgttaccggacgggtacgacgggtaacgggaccgacggggttcttaaacgtacgttaactttacgtttacggacctaaacttacaaacgtaacaacccgtaaccgttagttacggtttaaccgtttacttacggtttaaccgttaaccgggttacgtaccgtaacgtaacccggtaacggttcccgtaacccgttaccgggtactacccggaccgtaaccccggtaaacccgtaccccgtaaacccccgtcgtaccgtaccccg

SEQ ID NO: 130107 - DNA, 631 bp, Homo sapiens
  misc_feature: GYAE6OF02IJGPO.49.52.E08.1.454.CMB.1.raw
  modified_base (224)..(224): a, c, t, g, unknown or other
  misc_feature (224)..(224): n is a, c, g, or t
  modified_base (292)..(292): a, c, t, g, unknown or other
  misc_feature (292)..(292): n is a, c, g, or t
  modified_base (324)..(324): a, c, t, g, unknown or other
  misc_feature (324)..(324): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacagggtcctgggcccagtctcgccctgactcagcctgcctccgtgtctgggtctcctggacagtcgatcacatctctgcactgaaaccngcagtgatgtaggaattatacctttctctagtacaacacaccagacaacgacccaatacatcatttancgaggcctatcgacgccgcctgacgggtctcngtatcgtcttctcgtcgtctaccgtcgtcgtcggcacggcctaccggtcctccgtacgtactaacgtcttcggcggtcctaccggaggtcggtacggggacgtacgcgtagttatttaacgttcttcgtctagttacagttacgtcggtaccggtagtacgttaagggtccggtaacggttaacggggttcgggttaccgggacggggtaagggtaacggtaaaaccgggtccggtaacccgggttccggtaacgtaccgaccggacccggaacggttcccgtccccggttacccgcggttaacccg

SEQ ID NO: 130108 - DNA, 758 bp, Homo sapiens
  misc_feature: GYAE6OF02JWQOU.49.52.E08.1.454.CMB.1.raw
  modified_base (231)..(231): a, c, t, g, unknown or other
  misc_feature (231)..(231): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacagggtcctgggcccagtctgccctgactcacgcctcgcctcgtgtcgtgggtctccgtggacagtcgactcaccatctcctgcactcgaaaaccngcagtgagttaggttaggtaatttaacttaaccttttcctaccgttcggtaaccaactaaccaacccgaacggtaccaaaccgacccccaaacttcaactacctaatttaacgacggtacggaccgtactaccgacggcccgtacccgtacgacgggttcctactcggacttccgtacgtttccgtcgttccgaccttacccgacgttcgtcgccgtacggcccgtaccgtcccgtaccgaccgtaactaccgtcgtacgtccgggacccttacgggaccgggtcgggtaacgggacgcggttattaacggtttactttaacgttcgtttcgcgtttcgtaacgtagttacgttcgggtaaccggttagtaccgttagggtaccgggtaccgggttaagggtccggggttacgggcggggttaaacggtaacggtacggggtttaccgcccggtttaaccggtacggtaccgaccggggaaccgtaaccggttcccggtcccccgtaccccgggttacggttaaccc

SEQ ID NO: 130109 - DNA, 811 bp, Homo sapiens
  misc_feature: GYAE6OF02F8JEZ.49.52.E08.1.454.CMB.1.raw
  modified_base (234)..(234): a, c, t, g, unknown or other
  misc_feature (234)..(234): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacgacgggtcctcgggcccagtctcgccctgactcagcctcgcctccgtgtcgtgggtctcctggacagtcgatcaccatcctcctgcactacgaaaccngcagtgtagtggttaggtaatttaactttaacccttttccgtaccgttacggtaaacccaaacctaaacccaccccggaacggaaccaaaaacccgaccccccctaaaacttaccaacgttacttaacttttaagacggtaaccggaccgtaacgttacggaccggtcccggtacccgtaccgggtacgggggttcctacgtgtaccgttccgtctttcctcggtccggtccctccgtacgtcgtacggcacggccgtacccggtccctaccgcgacctacgtcgtcggtcggtccgtacggcgggtacggtacgggggtacggacggtaccgttagttaacgttttaacgtttagtttaccgtccgttttcgttacgttaagtacggtcgggttaccgtaggttaggttcggttaccggggacgggttaggggttcggggttacccggggggacgggtaaccggggtaccgggtaacggggttacccggtacccgggtttaacccgggttacggtaccggaaccggtaaccccgggtaacgggtccccgtacccgggtccccgttcggttaccccg

SEQ ID NO: 130110 - DNA, 810 bp, Homo sapiens
  misc_feature: GYAE6OF02IVKW8.49.52.E08.1.454.CMB.1.raw
  modified_base (294)..(294): a, c, t, g, unknown or other
  misc_feature (294)..(294): n is a, c, g, or t
tcagagtcgagagacacgaccggtgctcgatttagtcgagctctcagagagaaagggggtgggtccaggaggcagaactctgggtgtctcaccatggcctggatccctctacttcctccccctcctcactctctgcacaggctctgacggcccttctagtgacgctgacacgacgcccctaacccgtcggtgtccgtaggtccgtaccccgagggaccgacggtaccggcccgaagggactccaccgtcggtccttgtagggagtgtcgactagttacggaacccaaaaccgtntagttcgtctttaagttcggtaacctggaccgaaggaacccggcccgggaccaccgggtccccggttggttcggttagggttacgtagttaacggtaaataacggtacgaacgttaggacggtacgccctaggacgggtaacctccgtaggtaacgtaccgtacgttctcggacggtacctaccggacgggttaaccggaacgggtaaacccgttaccggtaacgtaacgttacggtaccggtcctaacgtcggtacggtaacggttcggtaccggacgacggaagggacgggtaacggaacgggtacgttacgtaacgtttaacgttacgttaacgtaacctaactaacggtaaacaacggtaaccctacgttacggttaacgtttaacgttacggttcggttaccgttaaccgggacgttaccggtaaccggacgttaaccggtccgttacccggttggaccgggtacctaaccggcccgtaaacccgacccgtaaccctacgttccgtacccg

SEQ ID NO: 130111 - DNA, 818 bp, Homo sapiens
  misc_feature: GYAE6OF02IXIAP.49.52.E08.1.454.CMB.1.raw
  modified_base (212)..(212): a, c, t, g, unknown or other
  misc_feature (212)..(212): n is a, c, g, or t
  modified_base (231)..(231): a, c, t, g, unknown or other
  misc_feature (231)..(231): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacagggtcctgggccctagtctcgccctgactcacgcctgcctccgtgtctcgggtctccgtggacagtcgatcaccntctcctgcactagaaaccngctagtgattggtaggaatttactaaccttttctcgtacggtaaccaacaaccacccgaggaaccaaaccgaccccaaactacctatcctaattttacgagacggaccgaattcgaacggtcccgggccctacggtacggggttctacgttacgactccgtccttacgtcgtcggtacctcccgtaacgtcgtacggaccgtacgccggtaccggaccctttccgacggtactaactccgtcgtcggcctacgcggtccggttacggggaacgtcggtacgtagttagtttaacgttactttgtccgttacggttacgttaacgttaacgggtccggttacccggggttagtaacgggtttacgggtaacccgggggttaacccgggaaagggggtttcgggtaccccggggttaacgggggtaaacgggggtaaaccccggttaaaagggggttcccccgggttaaacccgggtttacccgggttaaaccggtaccccgggtaaacccggtaccccgggttaaaaccggggttcccccgggtaaccccggggtttaccccccccgttacggggttaaccccccggg

SEQ ID NO: 130112 - DNA, 720 bp, Homo sapiens
  misc_feature: GYAE6OF02JUP1M.49.52.E08.1.454.CMB.1.raw
  modified_base (235)..(235): a, c, t, g, unknown or other
  misc_feature (235)..(235): n is a, c, g, or t
  modified_base (420)..(420): a, c, t, g, unknown or other
  misc_feature (420)..(420): n is a, c, g, or t
  modified_base (529)..(529): a, c, t, g, unknown or other
  misc_feature (529)..(529): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacgaggtccgtgggcccagtctcgccctgactccagcctgcctccgtgtcgtgggtctcctggacacgtcgatccaccatcctctcgctactacgaaaccngtcagtgacttggtaggtaattacttaacttttactcctacgtacaacaaccaccgagacaaacgccctaaactacattcaactttatacgacgcgtactcgacggtccgacccgttcggtacgggtcttccgcgtaacgtcccgttcgttcttccgtacggtcctcccgtggttcgtcggtacnccgacgtcccggtccctccgacgtaacctcttccgtacgtccggtaccgtccggtaaacgggtccgggttacggggaccggtaggttccggtagtttaaaccggttttnttaacggtttcgtacgtttagttaacgtacggttacgtcgggtaaccgtggttaacggttccgggtaggggttaacccgggttacggggtcgggttacgggaaccgggtacgggtaccggtaacgggttccgtaaccggtacggttacggtacgacggcccgtacggtccgtcccgtacccggtcgtaccg

SEQ ID NO: 130113 - DNA, 799 bp, Homo sapiens
  misc_feature: GYAE6OF02F949O.49.52.E08.1.454.CMB.1.raw
  modified_base (229)..(229): a, c, t, g, unknown or other
  misc_feature (229)..(229): n is a, c, g, or t
  modified_base (250)..(250): a, c, t, g, unknown or other
  misc_feature (250)..(250): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagcccaccctcggtgtcagtcgtccccgaggacacgacggccagactcacctgctcgtagganatgctattcgacccaaaacgntatgtcttattggtaccagacaagacggcccgggccacggcccctggtgttggtagtatagtaagtaaagaccacgtaggacggacggccctacgagggtactcccgaggacgtcgtacttcctcgtcggtccgtacggacggtacgaacgggtaaccgaaccggtacgaccgtaacgttcggacctacgtacgagggtacgggtacgtaccgagggaccgtaaggaacgggacgggtaacggtaccgttacgtaacgttaatttacgggttacgttacctaaaagttacccgaaaacgtaccggaaccctaaacccgttaacgttttaacggttttaaacccgtttaacgtttaccgggtttaccgtttaaacccggggtaactttacccgggtaccccgttaaacccgggttaaaccgggttacccccggtaaccccggggtttaccggttacccggggtaaccctaacccggtaacccccccggggtaaaacccgggaacccccccttaaacccccccggtaccgttaaccccggttaacccccgg

SEQ ID NO: 130114 - DNA, 868 bp, Homo sapiens
  misc_feature: GYAE6OF02FYY5A.49.52.E08.1.454.CMB.1.raw
  modified_base (180)..(180): a, c, t, g, unknown or other
  misc_feature (180)..(180): n is a, c, g, or t
  modified_base (230)..(230): a, c, t, g, unknown or other
  misc_feature (230)..(230): n is a, c, g, or t
  modified_base (253)..(253): a, c, t, g, unknown or other
  misc_feature (253)..(253): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctctatgagctgacacacgcccaccctggtntcagtcgtccccaggacaggacggccaggactccaccgtgctcgtagganatgctagttcgaacccaaacgtntactgtactttagtcggtaacccaggtaccgaaggtaaccggccccggggaccgtaccgggtacccccgttggttacgggtttcgggtaggtaacgttaacggttaaacttaaaaccggaaccttaacggttcggaacggtaacccgggtaccccgttacggaacggggttaccttacccggtaggaccggtaccgttaactttccgtacggtaccggtacccgtaccggtagggtaccggtaacgggtaaaccgtaaccgggttacctaaaccggttagtttcccggtaaaccgttaacgttaacccggaagggttacggtaaccggttaccgaacgggtaccgtaaagggaaccgggtacggacggttaccgttaacggtaacgttatttaacggttacgtaacctaacgtaaccgaacgtaaacgacccggttaaactttaaggttaccggttaaatttaccgtaccggtttaacgttaccggaacgttacggaaccccggttaacgttaaaccggtcccggttaacccgggttacccggtacgggttaacccgaacccggtaacccggaaaccggtaacccccctaaaccggtaccgtacccgtttaaccg

SEQ ID NO: 130115 - DNA, 869 bp, Homo sapiens
  misc_feature: GYAE6OF02IPOGD.49.52.E08.1.454.CMB.1.raw
tcagagtcgagagacacgaccggtgctcgatttagtcgagctctctcggcggggggggtcacaagaggcagcgctctcgggacgtctccaccatggcctgggctctgctgctcctcactctcctcactcaggacacgagggtcctgggcccagttctgccctgactcagcctgcctcgtgtctgggtctccgtgacagtcgatccaccatcctcctgccactacgaaaccagctagtgtattggttaggtaattttacttaacccttttcctccgttacggtaaccccaaccaaccaaccccgaagaccaaacccgaccccaaactctactactaatttagcggacggaccgtataccgacggtccccggtacccgtaggtacgggtccttcgtacgtaccgttccgttctttccgtccgttcggtcccttacccgtaccggtcgtacggaccgaccggacccgtaccccgttcccctacccgtacgtaaacccttaacccgttccggtaccggttaccgggtcccgtaacccgggtacggggtccggggttacgggggaaccgggttacggttaccgtttaacggtttaactttttaacggttttacgttacggttacccgttttaggttaacgttacgtttaccggttacgggttaccgggtttaaggttaaccggttacggggttaccgggttaaacgggggttaaccggggtttaccgggggttaccggggtaagggggtaacccgggtaaaccgggttaaccggggttacccgggttacccgggttaaccccggtacgggtaacccgaccgggtacccggtaccggttcccggtaccccggttacccccggttcgttaccccgg

SEQ ID NO: 130116 - DNA, 690 bp, Homo sapiens
  misc_feature: GYAE6OF02J1KSK.49.52.E08.1.454.CMB.1.raw
  modified_base (215)..(215): a, c, t, g, unknown or other
  misc_feature (215)..(215): n is a, c, g, or t
  modified_base (229)..(229): a, c, t, g, unknown or other
  misc_feature (229)..(229): n is a, c, g, or t
  modified_base (235)..(235): a, c, t, g, unknown or other
  misc_feature (235)..(235): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacagggtcctgggcccagtctgccctgactcagcctgcctcgtgtctgggtctcgtggactagtcgctcaccatctccgtncctactcgaaaccngctagngtagtggttaggtaattacttaaccgtttctccgtagtaaccaaccaaccaccgaacggaccaaaccgaccccctaaatcagtacttaattacgtacggaccgtacgtaactccggaacggcccggtccctcgggtaaccgggttctacctagtactccgttcttaccgtctacgtccgtactacggttcaccggcgaccgtcccggtacccgtccgtaccttaggtaaacctcttaccggtcgtaccggtccgttaccgaggggtaccggacgggtacgtacgtacgttaggttaactttacgtgttaccgttcgttagttaaccgtgttaccgtacgggttaacgttggtacggtccgtaaggtacgggttcggtacgggacggtacgacggtcggaccgtcccgtagtcgaccgcgtacgccggttccgtaccgtcccggtacgtacctccg

SEQ ID NO: 130117 - DNA, 610 bp, Homo sapiens
  misc_feature: GYAE6OF02F3XAC.49.52.E08.1.454.CMB.1.raw
  modified_base (242)..(242): a, c, t, g, unknown or other
  misc_feature (242)..(242): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaaccgntatgcttattggtaccagcagagccggcacggcccctgtgttcggtgtatgtaataaacgacacgtgagacggtccctacgacgggactccgtgacgcgtacttctcgtcggcctacgacggtcgaaggggaaccaacggtcaacgagttcggacctagtacgaggttcggacgtccgagggcagggaggaccggaggtcgtagtatagttagttcgtataacactaaacgagtaccaccgttagttacggtttaacttagttcgtttaccgttacgacgttcgacgtaccggtaacgttccgtaaccggttccgtacgggttacaccggtacccgaaccggtaccccaacccgtaccgtcgtacccg

SEQ ID NO: 130118 - DNA, 683 bp, Homo sapiens
  misc_feature: GYAE6OF02JY5JT.49.52.E08.1.454.CMB.1.raw
  modified_base (228)..(228): a, c, t, g, unknown or other
  misc_feature (228)..(228): n is a, c, g, or t
tcagagtcgagagacacgaccggtgctcgatttagtcgagctctcagagagaaagggggtgggtccaggaggcagaactctgggtgtctcaccatggcctggatccctctacttcctcccctcctcactctctgcacagctctgaggcctcctatgagctgacacagcccaccctggtcgtcagtcgtcccaggacagaccggccaggatcaccgtgcctcgtagganatgctacgttcgaccaaaccatatcgtacttattcggtaccagacgaagacggccgggaccacgggtccctggtttacggtggtcagttacgtaaataacggactacggagacgggtaccgtccgtacggaacggtccttaccggaggtacgactacgttccttacgggtacgtcccgtaacgggtacgtacgggaacgtaacggtacgtacctacgtagttacgaccgtatacgtacgggtacggtaccgacgacggtacgagggtaaccggaaggtcgtaagtacgttaaccgttagtttaaccgtgtaaacctacgaaactacgaacgactacttaggtttacgttaacgttctacgttacgtaaccgtacgtacggaccgtaacggtaacccggtagtacccgttggtacggtacacccggtaccaaccgtaccctaccgcttacgtaacc

SEQ ID NO: 130119 - DNA, 732 bp, Homo sapiens
  misc_feature: GYAE6OF02JP1LG.49.52.E08.1.454.CMB.1.raw
  modified_base (233)..(233): a, c, t, g, unknown or other
  misc_feature (233)..(233): n is a, c, g, or t
tcagagtcgagagacacgaccggtgctcgatttagtcgagctctcaggagagaaaggggtgggtccaggaggcagaactctgggtgtctcaccatggcctggatccctctacttcctcccctcctcactctctgcacaggctctgacggcctcctatgagctgacacacgccacccgtcggtgtcagtcgtccccgaggacagaccggccaggactcaccgtgctacgtgganatcgcagttcgaccgaaaccgatacgtagtcttagttcggtaccagcaagacggcccgggccacggccccgtggttcgttgggtagagttacgtaagtaaacggacgtacgtaggaacggtacgggccccttacggaaccggggtaccttacccgtaggtaccgtaccgttaacgtttcccgtcggttacggccctttaccggaacgggttccgaacggggaacctacggttacacgtacgtttacgaccgtagtcgtacgggtagaccggtccaggtacgacggtaagggacggtaagcgttaacgtacttacgtttagtcgtaactacgtacgagtaacgtactaccgttagttacgttacgttactacggttaccgttaacgtacgtacggtaaccggtaaccgttaaccgggttcctaacccgggttccgttaacgggttccaacccggtacccgaaacccggaccccttaacccggtaacgttccgtaaccccg

SEQ ID NO: 130120 - DNA, 664 bp, Homo sapiens
  misc_feature: GYAE6OF02FN787.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgtcttattggtaccagcgaagaacgcccgggccacggcccctggtgttggtgatgtaataaagacactgagacggccctagacgggactcccgtaggacgtcggtattcctacgtcggccttccgaggtcgaaggggtaaccaacgggtaccacgtagtcggacctatcgaggtcgggaacgtccgaggtacgagggtacggacggacggcgtagtacctttagttaagttcgtactaacgtacaaacgtaacgaacctaccgttaagtttacggttaacctttaagttcgttacgttaccggtaaccgttcgaccgtaacccgtaaggttaccctaccgggttaccccggttaggtacccggtaacccgtaccccggaaaccgggtacccccctaaaccccggtacgttaccgtacccg

SEQ ID NO: 130121 - DNA, 635 bp, Homo sapiens
  misc_feature: GYAE6OF02JCQK3.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgactattgaccaaaaccgatactgcttattggtaccagcaagaacgccgggccacggtcccctggtgttggtgatgtaataagacagtgagacgcctgaggtactccgtgacgcgtattctcgtggcctcgaagtcgaaggacaacggtcacgtagttcggaccaagtcagtcggacgtccgaggacgaggaacggacggacggtcgtacgaacttaagtttacgttagttacctaaactactaaaacgaccgaacctaaccgtaagtttacggttaaactttacgttaggttaacgttacgggtaaccttacggaaccggtaaaccggttaacggtacccgtaaccggttccgtacgggtaccaacgtaccccgaaacggacccctaaacccctacgttacgttaccc

SEQ ID NO: 130122 - DNA, 741 bp, Homo sapiens
  misc_feature: GYAE6OF02G0VMM.49.52.E08.1.454.CMB.1.raw
  modified_base (229)..(229): a, c, t, g, unknown or other
  misc_feature (229)..(229): n is a, c, g, or t
tcagagtcgagagacacgaccggtgctcgatttagtcgagctctctcggcgggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatccaccatctcctgcactacgaaaccngcagtgtacttggttagggtaattacttaaccttttctaccgtacggttaaaccaacctaaccgaaccaggaaccaaaccgacccccaaaactcaatacctaatttacaggacggtaccgatacgaacggtccggtaccccgtacgtacggggttacctcgtaggtacttaccggtcttcgtcgtcggtccttacgaccgttcgtacggacacgtaccgaccggtccccttaaccgtgaacctaacgtccgttacgtacgggtcccttaccggacggtacgggtacgggggaacggtacggtacgttacgtttaaagtttaagtttaacgttgttacgtttagttacctagttacgtacggttaccggtagtacggtaggtaccggtaccgggtaagggttcgggtacgggacgggtaacgggtacggtaaacgggtaccggtaaccggtaccgtacggggtacaccggtaccgtaacccgggtcgtacccggtaccccggttcgtaacccg

SEQ ID NO: 130123 - DNA, 623 bp, Homo sapiens
  misc_feature: GYAE6OF02GKIBF.49.52.E08.1.454.CMB.1.raw
  modified_base (328)..(328): a, c, t, g, unknown or other
  misc_feature (328)..(328): n is a, c, g, or t
  modified_base (439)..(439): a, c, t, g, unknown or other
  misc_feature (439)..(439): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacaggacggccaggatcacctgctcgtggagagtgctattcgaccaaaccgattatgcttagttggtaccagcagaacgccggcacggcccctgtgttggtgatgtaataaagacactgagacggccctagngggacttcccgtgacgcggtattctcgtcgtcctcgaggtcgacgggaaccaacggtcactagtcggaccatcgagttgggacgtaccgaggcgagggacgacggacggtntagaccttatttagttacgactaaatacgaaacacgtaacctaccgttaagtttacgtattttaacgttcggttacgtttacggaacgtcggtcgtaaacccgtacgggtcccttacccggttaccgttgggtaccgtaacggaccccggtaaacggaccccctaaaccctcgtacttacccgg

SEQ ID NO: 130124 - DNA, 715 bp, Homo sapiens
  misc_feature: GYAE6OF02GBJCD.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagcccacccgtggtgtcagtcgtccccaggacaggaccggccgaggactccacctgcctcgtggagatcgctattcgaccaaaccgattatgtctttagttcggtaccagacgaaggaacggcccgggaccgacggtcccccgttaggttcggtttgggtcgtagttacggtaagtaaaacggactaacgtaggacggacggtcccttacggacgggtactcccgtaggacggtaccgtacttccgtactcggtcctaccggtacggtacggaacgggaaccgtaaccggtacgtaacgtacgtttacggacccgtagttcggaggttcggtaaccgtaccggaggacggtaagggacgggaaccggacggtcgttaacgtacgtttaacgttagttacgtacgtaactaacgaaaccgtacgaccgtaaccgttagtttacggttacttaacgttcgtacgttacgtaaccgttcgaaccgtaccgtaacgtccgtaccggtcgtacggtcgaccgaccggtaaccgaccccacctacgtcgtacccg

SEQ ID NO: 130125 - DNA, 650 bp, Homo sapiens
  misc_feature: GYAE6OF02JWN0X.49.52.E08.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
  modified_base (481)..(481): a, c, t, g, unknown or other
  misc_feature (481)..(481): n is a, c, g, or t
  modified_base (553)..(553): a, c, t, g, unknown or other
  misc_feature (553)..(553): n is a, c, g, or t
  modified_base (574)..(574): a, c, t, g, unknown or other
  misc_feature (574)..(574): n is a, c, g, or t
  modified_base (586)..(586): a, c, t, g, unknown or other
  misc_feature (586)..(586): n is a, c, g, or t
  modified_base (592)..(592): a, c, t, g, unknown or other
  misc_feature (592)..(592): n is a, c, g, or t
  modified_base (598)..(598): a, c, t, g, unknown or other
  misc_feature (598)..(598): n is a, c, g, or t
  modified_base (606)..(606): a, c, t, g, unknown or other
  misc_feature (606)..(606): n is a, c, g, or t
  modified_base (628)..(628): a, c, t, g, unknown or other
  misc_feature (628)..(628): n is a, c, g, or t
  modified_base (648)..(648): a, c, t, g, unknown or other
  misc_feature (648)..(648): n is a, c, g, or t
tcagagtcgagagacacgaccggtgctcgatttagtcgagctctctcggcggggggggtcacaagaggcagcgctctcgggacgtctccaccatgcctgggctctgctgctcctcactctcctcactcaggacacaggtcctgggcccagtcncgccctgactcacgcctgcctccgtgtcctagggtcctccgtggaacncgtcgactccactagtcctcctagcgtactacgaaaacctgcgtaagtcgtagttggttaagggtaactttacttaaccgttttctacgttggaaaccctaaccaaccgtaacccgaacgggaaccaaaaccggtacccccctaaaacgttaccaacttaccgtaacgtttttacgacggaaccgggtcctacggttaccgaacggcccgggtccctacgggtacggttctcgtacgtactcggtacctttctccgtccggaccgtttacgacgttccgngaccgtcgaacccgtacccggcctacgtactacgtactcgtacgtcgtccgacgtcgtcgtagggagtacgntactgttactgcgtctgtacngtgtacctgtangtacgngtacgngtgacggnacgcgacggtcacgtactcganacggcgacgcgtccgtccgntc

SEQ ID NO: 130126 - DNA, 769 bp, Homo sapiens
  misc_feature: GYAE6OF02I12VY.49.52.E08.1.454.CMB.1.raw
  modified_base (139)..(139): a, c, t, g, unknown or other
  misc_feature (139)..(139): n is a, c, g, or t
  modified_base (146)..(146): a, c, t, g, unknown or other
  misc_feature (146)..(146): n is a, c, g, or t
tcagagtcgagagacacgaccggtgctcgatttagtcgagctctctcggcggggggggtcacaagaggcagcgctctcgggacgtctccaccatcggcctgggctctgctgctcctcactcctcctcactcaggacacngggtccngggcccagtctcgcctgactcagcctcgcctcgtgtcgtgggtcctccgtggactaggtcactcaccactctccgtgacctactacgaaacccagactaggtgtagtaggttacggtaatttactttaaccgtttcctacgtacggtaaccctaaacaaccgtaccgaacgtaccgaaacccacccccgaaaactctaactactaactttacgtacggaaccggaccgtaacgtccgaaccggtcccgaccccggttacgggtaacgggtcccgttacgtaacgtaccgtcgttccgtttaccgtccggttaccgtccgtaacccttaccggtcgtacggtccgaaccgtccggtacccggtccctaacccgtataaccgtacgtttcgtcgtaccggtcctacggcgggtacggtacgggggacgtagtacgttagttaagtttacttccggtattacggtactttacggtaattccggggtcctaggggtactacggtttaggtcccgggtaggttaggggtccgttacggggaccgggtaacggacgttaacgggtacgtcccggtaggttaaccgcccggacgtacggtacccgcccgggtacctcccggttattcccg

SEQ ID NO: 130127 - DNA, 763 bp, Homo sapiens
  misc_feature: GYAE6OF02F0RZR.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagcccaccccgtcggttgtccaggtcgttcccccgaggacacgacggccgaggactcacctgcctcgtggagatcgactacttacgaccctaaaaccgattagttcgtacgttagttacggtaaccaaggccaaggaacggcccggggacccgacggtcccccgtggttggtttacgggtgtagtaggttaataaaacggactacgtaggacgaccggtaccgtaggacgggtactcccgtagacggtacctacgtttcgtcgtcggtcctacggtacggtacgaacgggaacgtaccggtcctacgtacggtccggtactaacgtacgtagtacgggtaccgtacggtacggacgaacgggtaagggaccggaggtaccgttagaacgtttagttagttacgttctaaacgacttaaaccgaacgtacccgttaaacgttaggttacgtttaacgtttacgttcggttaccgttacgggtaccgtacgacccggtaacggttaccggtaaccggtaccgttcccgggttaacggtaccggaacccggtaccccgtaaaccggaccccttaacccgtacccgttacggttaaccccg

SEQ ID NO: 130128 - DNA, 683 bp, Homo sapiens
  misc_feature: GYAE6OF02I99O6.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacacgcccaccctcggtgtcagtcgtccccaggacagaccggccaggatccactgctcgtggagatgctatcgacccaaaacgtatatgtcttagttaggtaccagacagaacgcccggaccacggcccctgtggttggtagagttgtaataaagactacgtaggacggaccggaccctcggacggtacctacccgtagacgacgttacttcgtacgtcggtaccgtaccgtacggtacggaacgggtaaccgtaaccggtaccgacgttacggtccgactacgtacgagggtacggacgtaccgaggtacgaagggtaacggacgacggtcgtacgtaacgttagttagttaccgtaatactaacgtaaacgacgtaccctaaccgttagtttaaccgttaactttagttaccgttacgttacgtaacgccgtaccgaaccggtacggtacccgttacggtcccggtacggtacccgaccggaacccgaacccgaaccctaccctacgtccgtacccg

SEQ ID NO: 130129 - DNA, 723 bp, Homo sapiens
  misc_feature: GYAE6OF02IU1VF.49.52.E08.1.454.CMB.1.raw
  modified_base (280)..(280): a, c, t, g, unknown or other
  misc_feature (280)..(280): n is a, c, g, or t
tcagagtcgagagacacgaccggtgctcgatttagtcgagctctcagagagaaagggggtgggtccaggaggcagaactcgtgggtgtctcaccatggcctggactccctctacttcctcccctcctcactctctgcacgaggctctgacggcctcctagtcgacgcgtcgacacgcgcccaccgtcggtcgtcgacgtccgtacccgacggacacggaccggaccgaggactccaccgtcgtcgtcgtaggacgatcgactacgtacgaccgaaacgtntagtcgtcgttagtacggtacgagacgacgaccggcggccgtaccgtcgttggtcggtcggtacgtagtaacgtaaacgtaacgacgtacgtaggtaccggtaccggaccgtacggtacggtacccgtacggtaggtacgtacgttctcgtcgtcgtccgtacggacggtacggaacggtaacgacgtacacgtacgtacgacgtacgtacggtacggtacgtacggcgaacggcgaaaggtacggacggtcgtacgttaacgttaacttgttaacgtacgtaactaaccgttaagaaccgtaacgtaaccgtaacgttacggttacttaacgttcggttacgttaacgttacgtaacgtcggaacgttaccggtacgtaccggttacggtacggtccgacgtaaccgaccggtaacccgaccgaaccgtttcgaccttaccg

SEQ ID NO: 130130 - DNA, 748 bp, Homo sapiens
  misc_feature: GYAE6OF02IIRL1.49.52.E08.1.454.CMB.1.raw
  modified_base (182)..(182): a, c, t, g, unknown or other
  misc_feature (182)..(182): n is a, c, g, or t
tcagagtcgagagacacgaccggtgctcgatttagtcgagctctcagagagaaagggggtgggtccaggaggcagaactctgggtgtctcaccatggcctggatccctctacttcctcccctcctcactctctgcacaggctctgaggcctcctatgagcctgacacagcccaccctcggtntcagtcgtccccaggacagacggccaggatcacctgctctggagatgcattcgaccaaaccgtatatgtctttagttcggtaaccagtacaggaacgccgggaccacggcccctggttcggttggtgtacgttgtaataaacgacacgtgaaggacggtccctacgaacgggtactcccgtagacgtacggtaacttctacgtggtcctaccgtaggtaccgagggtaaccctaacggtcctacgtagttacggaccctaagtaccgtaaggtacgggtaccgttaaccggaggtaccgaaacgggaacggggaaccggtaggggtacccttaagggttaaaccctttagtttaacgttcggtaataaaaccgttaccgaaaaacctaccgtaaaccgtaaccggttaacgttacgggttttaacttaccgttgttaaacccgtttaccggaaacgttcgaaccggtaaccccggtaacggttacccgtacccggtaccgtttacgggacccaacccggtaacccggaacccggtaccccaaaaccccgtcgttacccgtaacccg

SEQ ID NO: 130131 - DNA, 873 bp, Homo sapiens
  misc_feature: GYAE6OF02F0BJP.49.52.E08.1.454.CMB.1.raw
  modified_base (180)..(180): a, c, t, g, unknown or other
  misc_feature (180)..(180): n is a, c, g, or t
tcagagtcgagagacacgaccggtgctcgatttagtcgagctctcagagagaaagggggtgggtccaggaggcagaactctgggtgtctcaccatggcctggatccctctacttctcccctctcactctctgcacaggctctgaggcctcctatcgagctgacacagcccaccctcggtntcacgtcgtccccaggacagacggccaggatcacctgctcgtggagatgctattcgaccaaaccgatatgtacttattcggtacctaggcaaggaacggccccgggaccacgggtcccccgtagtcggttttcgggagtactaggttaataaaaggtaccaacgttaggaacggacggtccccgttacgacggggacttaccccggttgggaacgccggtaatttccggttaccgtcgggtccctaccggtacgggttaccgaaacgggggtaacctaaaaccgggttccgaaaccgtacggttttaccggggaccctaagtttaccggaacgggtttaacgggtaaccggttcccgtaaacgggggaccaagggggtaaccggggaaccggggtaacgggtaccggtaaccggttaaaccgtttaacggtttaacccttacgggttaacgtacccgggtttaacccgggacgtaaaccgggttaaccgaacgggttcggaacgggttacgggtacttaaacggttttaagccgggttttaaggttaccggtttaccgggggaacggggttccggggtaaaccgttacccgggtaccggtttaacccgggtaaccccgggtttacccggttacggggttaacccgtacccggggtaaaccccgttaaccggggtcccgtttaaccccccgggg

SEQ ID NO: 130132 - DNA, 856 bp, Homo sapiens
  misc_feature: GYAE6OF02HOJYD.49.52.E08.1.454.CMB.1.raw
tcagagtcgagagacacgaccggtgctcgatttagtcgagctctctcggcggggggggtcacaagaggcagcgctctcgggacgtctccaccatggcctgggcttctgctgctcctcactctcctcactcaggacacgagggtcctgggcccagtctgccctgactcagcctgcctccgtgtctgggtctccgtggacagtcgactccaaccgattcctacctgtaccacgtaacgaaaaccgagtccgtaagtacgtagtcggtttagggtaaacttttacttaaccctttttcgtaccgttacggtaaacccaaacctaaaccctaaccccgaagggaaccaaaacccgacccccctaaaactcaactacctaattttaacgtacggaacggtaccgtacgtaccgtaacgggtcccggtacccggttaacggaccggggttacctcgtacgaatccggtaccttccgtacgtaccggtacctcccggtaacgtccggttcgaccgacggaccggacccgtccgtacccgacgtaaccaacgtccgttcgtaccggggtacctaccggtagggtaccgggtaccggggaccggaacgtcggttaacgttaacgttttacgttaggtttacggtcttacggttactaacggttacgggtccgggtaccggttagtacggtttacggggtaaccggttaaccggggttaacgggtttcccggtacggggtaacggggtaaccgggttaaaccggtaaacggggttccgggaaacccggtttacccgggtaacgggtacccgtaacccggtacccggttaagggccccttaacccggggcccctttacggtaacccg

SEQ ID NO: 130133 - DNA, 721 bp, Homo sapiens
  misc_feature: GYAE6OF02JJGPT.49.52.E08.1.454.CMB.1.raw
  modified_base (211)..(211): a, c, t, g, unknown or other
  misc_feature (211)..(211): n is a, c, g, or t
  modified_base (232)..(232): a, c, t, g, unknown or other
  misc_feature (232)..(232): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacagggtcctgggcccagtctcgccctgactcagcctgcctccgtgtcggtggtctccgtggacagtcgatcacctntcctcctgcactacgaaaccngactagtgagttggttaggtaactttacttaaccgttttctaccgtacgtaacctaaacaaccaacccgaggtaaccaaaccgacccccaaactcactacttatttacgcggacgtacctacgtccgacggcccgtccgtacggtacgggttctcgtacgattcccgtacttccgttcgtcgtccgttcccgcgtcgtaggaccgtacgacccgtaccggtccctaccgtacgaacctacgttccgtcggtaccggtcccgtacggccgggtcggtacggggtaacgtcggtaacgttcgtttaaacgtttagttacgttccgtacgttgttactacgttacgtcgggtaccgttagtaaccgtgggttacggacggttacggggtcggttacggggacggtacgggaaacggtacgggtaccggtcgtaaccggtacgttccgaaccgtaccgtaccggtcccggtaccccggtccgttaccgtaccg

SEQ ID NO: 130134 - DNA, 714 bp, Homo sapiens
  misc_feature: GYAE6OF02JP7XA.49.52.E08.1.454.CMB.1.raw
  modified_base (222)..(222): a, c, t, g, unknown or other
  misc_feature (222)..(222): n is a, c, g, or t
tcagagtcgagagacacgaccggtgctcgatttagtcgagctctctcggcgggggggtcacaagaggcagcgctctcgggacgtctccaccatggcctgggctctgctgctcctcactctcctcactcaggacacagggtcctgggccagtctcgccctgactcagcctgcctcgtgtctgggtctcctggacagtcgatcacatcctctgcactagaaccngctagtgatgttaggaattactaaccttttctccgtgtaacctaacaacctacccgaggaccaaaccgtaccccctaaacgtcaacttactatttacgagacggcgtactcgacgccgacctcgtacgggtctcgagtactcggtccttctcgtacgtccctacgtacgtcgtcgacgtacgccgtaccgtccctctacgacctaacgtccgtacgcggtacctaccgagggtcgtacggggaccgtacgggtacttacggttacctttaaacgttgttacgtaccgttttcgttacgtacgttaacggttcggtaacccgggttagttaacgttaacggggtccggttaaacggggtaagggtttccgggttacgggacggggtaacggtaaaccggtaacggggtaccgtaccgtttaaccgggttacgacccggttaaccggacccgtaacggttccccgacccggttacccccgttacgttaccccgg

SEQ ID NO: 130135 - DNA, 905 bp, Homo sapiens
  misc_feature: GYAE6OF02H41A1.49.52.E08.1.454.CMB.1.raw
  modified_base (225)..(225): a, c, t, g, unknown or other
  misc_feature (225)..(225): n is a, c, g, or t
tcagagtcgagagacacgaccggtgctcgatttagtcgagctctctcggcgggggggggtcacaagaggcagcgctctcgggacgtctccaccatggcctgggctctgctgctcctcactctctcactcaggacacagggtcctgggcccagtctgccctgactcagcctgcctcgtgtcgtgggtctctaggacagtcgatcacatctcctgcactagaaaccngctagtgagttggttaggtaacttaactttaacccttttcttaccgtacggtaaccctaaaacaaccgtaaccccgaacgggtaaccaaaacccggaccccccctaaaaaccttaccaacttaccgttaacgtttttaacggaacgggtacccggggtaccgtaaccttaccggaaccgggtaccccgggtaccccgttcgggttacggggggttacccctttcgtacggtaccgttaccggttcccgtttaccgttcggttccggtaccctttaccccggtaaccggtttcccgggttggaacccgtaccggtacccggtaacccggtccccctttaccccggtaagtaaacccgtaaacttcccggttccggtaccgggttccccgttaccgggacggggtccgggtaccgggggaacgtaacggttcgttaacggtttaattaaacgtttcggtttcgtagtttaccgttaacgttaaggtttaccgacgggttaccggttaaggaaccggtttcgggacgggtaccgggtaaagggggttcgggttaccgggacggggtaacggggaaccggtaaacggggtacccggtaaccgggtttaacccggacggggtaaccctaaccgggtacccggtaaccggtccccgtacccggttacccccggttacgttacccgg

SEQ ID NO: 130136 - DNA, 909 bp, Homo sapiens
  misc_feature: GYAE6OF02FHQNA.49.52.E08.1.454.CMB.1.raw
  modified_base (206)..(206): a, c, t, g, unknown or other
  misc_feature (206)..(206): n is a, c, g, or t
  modified_base (217)..(217): a, c, t, g, unknown or other
  misc_feature (217)..(217): n is a, c, g, or t
  modified_base (236)..(236): a, c, t, g, unknown or other
  misc_feature (236)..(236): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacgagggtcctcgggacccagtcgtcggcccctgacctcacgcctgcctccgtgtcgtgggtctcctggacngtcgatcaccntctctgctactacaaaccngctagtgtagttggttaggtaactttacttacctttcctcgtacgtaaccgtaacaacctaccgagtaaccaaccgtaccccctaaactctaactacttaattacgtacggtacggacctacgtacgaccgtaccggtccctacggtacgggttccttacgtacgtacggttcgttaccgttcgtccggttccggtcccgttaccgtaaccggttccggtacgggacccggtacggtacccggtacccggtccccgttaaccgtaccgggtaaccttacggtccggtttccggacgggttcccgtaaccgggtccgggtaaccgggttcgggggaaccgggtacgggttaccgtttacggttaaattttacggtttaccgttacgggttcgttttaaccggttaccggtttaacggttacggttacgggtttaccggggttaagttacgggggttaccgggtaacggggtaaaccccggggtttgggggttaccccggggttaacggggggtacccggggttaaccggggtaaccggttaaacccgggggttacgggtttaacccccgggtaacgggtttaaccggggtaaccgggtcccccggtaaaccgggttaccccgggttaaccccgggtccccccgggttacccccggttacccgggttaacccccg

SEQ ID NO: 130137 - DNA, 836 bp, Homo sapiens
  misc_feature: GYAE6OF02FL09R.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttcctccccctcctcactctctgcacaggctctgacggcctcctatgagctgacacagcccaccctcggtgtcagtcgtcccccaggacaggacggccgaggatccacctgcctcgtagggatatcgctattccggaacccctaaaaccggtattacgtacgtcgtttaacgtttggtaacccgtaaggaccgaaaggaaacgggcccccggggtcccccgtaacgggtcccccccgttgggttcggtttggggtacggtaacgttaggttaaaacgttaaaacggaacgtaaccggttaggacgggaacccgggtacccgttacggaaccggggtaccgttacccggtaggacggtaccggttacttccgttcggtccggtaccctaccggtaacgggtaccggaaacggggtaccgtaaaccggggttacctaacgttacggttacggaccctagttacggtaggttacgggtacgtcccggaaggaccggtagggaacgggacggtacggtacgaagttacgttacttagttccgtactaagtaaacctaacgtaaaccgtaacctacgttaagtttacggtttaacttacggtttcggtttacgtaacccgggttatacccggaccggtaacggtaccggttaccctaccggttccggttaccggtacgacccggtaccccgtaaacggacccccctaaccggttaccgtcttaaccccg

SEQ ID NO: 130138 - DNA, 837 bp, Homo sapiens
  misc_feature: GYAE6OF02I9SZ2.49.52.E08.1.454.CMB.1.raw
  modified_base (258)..(258): a, c, t, g, unknown or other
  misc_feature (258)..(258): n is a, c, g, or t
tcagagtcgagagacacgaccggtgctcgatttagtcgagctctctcggcgggggggggtcacaagaggcagcgctctcgggacgtctccaccatggcctgggctctgctgctcctcactctcctcactcaggacacgagggtcctcgggcccaggtctcgccctgacctcacgcctcgtcctccgtgtcgtgggtcctccgtgggactacggtcgactaccacctactccttcctcgacctaccgtacgaaaaccgngtaccgtaggttaggtagtacgggttaacgggttaaactttaaccgttttaacccctttcgtacccggtttaaccggttaaaccccaaaaccgtaaccccgtaaacccgacgggtaaaaccccctaaaacccccggtaaccccccaaaacttcctaaacgttttacccttaagttttaaaccgggtcgaaccggggtacccttaacgttaccgaaccggggttccccgacccggttaaggggtccgggttaaccgttcctaacggttccggttactcccgtttacgtccggtaccgtccttaccccggtaagtcggtccgacgtaccggaccgtacccgtcccttaccgtacgtaactacgttcgtcggtaccgctacggcgggtcggtacgggactaggtctagtttatacgttagtcgtcgtaagttctacgtgtcggtacgtggtacggtaggtcggtaacggttaggtaccgggtagggaccggtaacgggtcggtaacccggtacggtacgtaccgggtactacggaaccggtccgtaaaccggtcccgtacccggtcccggttaccgtacccg

SEQ ID NO: 130139 - DNA, 729 bp, Homo sapiens
  misc_feature: GYAE6OF02F87A7.49.52.E08.1.454.CMB.1.raw
  modified_base (230)..(230): a, c, t, g, unknown or other
  misc_feature (230)..(230): n is a, c, g, or t
  modified_base (247)..(247): a, c, t, g, unknown or other
  misc_feature (247)..(247): n is a, c, g, or t
  modified_base (638)..(638): a, c, t, g, unknown or other
  misc_feature (638)..(638): n is a, c, g, or t
  modified_base (721)..(721): a, c, t, g, unknown or other
  misc_feature (721)..(721): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacgtacgggttcctgggccctaagttctcgccctgactgacgtcctgccctcgtgtcgtgggtcctcgtaggactagtcgatcgaccgtatcctcngacctactcggaaaccngcagtcgagttgtacggtaattacttaacctttctcgtacgtaaccaactaacgtaccgaggaccaaaccggtccccctaaatcgtactacgtacgttagtacggtacggaccgtactacgcggtcccggtacttcgggtacgggttctacgtaggtctaccggtcttacgtccgtacgtccttaccgacgttcgtaccggcgaggtacccgccggtacccctacgtaccgaactaaccgtccggtaccggtttccggaccgtacccggtaacgggtaccgggttaacgggaacggtaccgttccgtaagttaactttaaagttcgtacggttccttagttactaggtaccggtacggtccggtagtacgtgggtaccgagggttaacggngggttacgggacgtacggaccgtaaggtccggtacgaccggttagacccgtagtacccggtaggtcccgtccggtccccggtntaccccgg

SEQ ID NO: 130140 - DNA, 646 bp, Homo sapiens
  misc_feature: GYAE6OF02JBCLV.49.52.E08.1.454.CMB.1.raw
  modified_base (449)..(449): a, c, t, g, unknown or other
  misc_feature (449)..(449): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgacggcctcctatgagctgacacacgcccacccgtcggtgtccaggtcgtccccgaggacacggacggccaggactccactgcttcgtggacatcggcagttcgacccaaaccgattactgctttagttacggtaccagtcaaggtaacggcccgggaccgacgggtcccctgttggtttggcgtagttgtaataaacggactacgtagaacggacgcccgtacgacgggactccgtagacggcgtacttcgtacgtcggtcttacgacggttcgacgggtacgtacgtcaacctagtaccgacngtacgtagtacggacggtcccgaagggtaccgtaggaacggaaccggtcggacttacgtaattacgttacgtcggtaactaactaacacgaaccgtacaccgttaagttccggtaattactcgtaccttaggactcgacgtacgacggtacctcgccgttaggaccacggaccaccgaccaaccccggtcacgttcc

SEQ ID NO: 130141 - DNA, 858 bp, Homo sapiens
  misc_feature: GYAE6OF02GHYIL.49.52.E08.1.454.CMB.1.raw
tcagagtcgagagacacgaccggtgctcgatttagtcgagctctcagagagaaaggggtggtccaggaggcagaactctgggtgtctcaccatggcctggatccctctacttctccccctcctcactctctgcacaggctctgaggcctcctatgacgctacgaacaccaggtccccaaccccgttcgggtcgttccaaggttcgtaccccccgaagggaaccacgggaccgggaccctaagggtacttccgaacccgttggtcccttaccggtaggggtaaacgtaagttggacttaagtttccgaaaccccgtaaaaaccggtattaagttcggttacgtttaacgtttaccgggtaacccgacggtacggaacgaaacgggccccgggacccgtaccggggtccccccgttggttcggttacgggttaggtaacgttacgttaaacgtaaaacgtaccggacgttacgaccgggacggtccccgtaggtacgggacgttcccgtaggtacgtacgtattccgtcgtacggtctacggaacggttccggaaacggtacgaacgggttcaccggtagtttccggactacggttacggtaacgggttcgggacgttacccggagaccggttaacggagggtaaccgacgggtccttacggttaaccgtttaagttcgttaacgactaacgttaccgaacgtagtaaccctagtacgtttcgttaactttggtccgttacgtacgtacgtaccgtaccgtaacggtaaccggtacccgaccggtttaccgtaccggggtaaccctaaccgggtaccccgtaaaccggtccccgtaaccccttagtacccgttacccccg

SEQ ID NO: 130142 - DNA, 780 bp, Homo sapiens
  misc_feature: GYAE6OF02HWIKE.49.52.E08.1.454.CMB.1.raw
  modified_base (167)..(167): a, c, t, g, unknown or other
  misc_feature (167)..(167): n is a, c, g, or t
  modified_base (264)..(264): a, c, t, g, unknown or other
  misc_feature (264)..(264): n is a, c, g, or t
tcagagtcgagagacacgaccggtgctcgatttagtcgagctctcagagagaaagggggtgggtccaggaggcagaactctgggtgtctcaccatggcctggactccctctacttcctccccctctcactctctgcacaggctctgacgcctctatgagctgacacncgcccaccgtcggtgtcagtcgtacccgaggacacggacggccaaggctccaccgtgtcctacgtggacgtagtcgactattcggaacctaaaacgnttacgtcgttactttagttacgtaccagtacgaacggtaacggcccgggccgacggccccgttgttacggttcggtagtagttagtaaagtaaacgactacgtacggacggtaccggtcccgtacggacgggtaccgttacccgtaggtacggtacgttacgttccgttcgttccggtccgtaaccggtacgggtaccggaacgggtaaccgtacggtacacgttacggtaccgtactacgtacgtacgggtacggtacggtaccgtaagggaccgtaacgggaacgggtaaccgggaggtacgttacggttaacttacgttttacgtacggtactaacggtaacaaacgtaacgtaaccgtacgttaacggtttacgtttaacgtttgttacgttacgttacggtacgtaccgtacgtaacccggtacgggttaccctaccgggttaccggtacgggtaccgtacccgggaaccctacccgggaaacccctacccggttacctacccgttacccg

SEQ ID NO: 130143 - DNA, 755 bp, Homo sapiens
  misc_feature: GYAE6OF02HJIPO.49.52.E08.1.454.CMB.1.raw
tcagagtcgagagacacgaccggtgctcgatttagtcgagctctctcggcggggggggtcacaagaggcagcgctctcgggacgtctccaccatggcctgggctctgctgctcctcactctcctcactcaggacacgagggtcctgggcccagtctcgccctagactcacgcctcgccctcgtgtcgtgggtactccgtggacagtcgatccaccactcctcctcgacctacgtacgaaaccgtcgacgtagtcgtagttggttaggtaaactttacttaaccttttctaccgtacggtaaccaaacctaaccaccgaacggaccaaaccgaccccaatacactactagttacgacggacggtaccacgtacgcggaccggtccgtcggtaggtcctagtacgtacgtcgtcttctcgtcgtcctacgtacgtcgtcgaccgacgtaccgtacccgtccgtacacggaacttacgtcgtcggtaccggccgtaccgggagggtacgggtacggggtaccggagttacgttaacgtttatttacgttacgtacggttacttcggttaactacggttacggtaccgggtacgggttaagtaacgggttacgggtaccgggtacggggttagggttccgggtaccgggggaccgggaaagggttaacccggaagggttacccggttcggttaacccgggtaggtacccgtccggtaaccggaccgggttcccctacccggttacccggtaccgtcccg

SEQ ID NO: 130144 - DNA, 754 bp, Homo sapiens
  misc_feature: GYAE6OF02IRVTL.49.52.E08.1.454.CMB.1.raw
  modified_base (214)..(214): a, c, t, g, unknown or other
  misc_feature (214)..(214): n is a, c, g, or t
  modified_base (233)..(233): a, c, t, g, unknown or other
  misc_feature (233)..(233): n is a, c, g, or t
  modified_base (239)..(239): a, c, t, g, unknown or other
  misc_feature (239)..(239): n is a, c, g, or t
  modified_base (315)..(315): a, c, t, g, unknown or other
  misc_feature (315)..(315): n is a, c, g, or t
tcagagtcgagagacacgaccggtgctcgatttagtcgagctctctcggcgggggggggtcacaagaggcagcgctctcgggacgtctccaccatggcctgggctctgctgctcctcacctctcctcactcgaggacacgagggtcctcgggcccagtctcgccctgactcagcctcggcctcgtgtcgtggtctcgtggacagtcgatccacntcctctgcactacgaaccngctagngtagttggtagtaacttacttaacctttctcctacggtaacctaacaaccacgacggaacaaccgaaccccctaanctactactagttagtacggtacggacctaccgtcggtaccggtacccggtaccccgtcgggttagggttccgttaccgtaggttaccgtccgtttccttaccggttccggttcggcccgtttccggtaacccgttcgggtacgtaaccgccgggtcccgtaacccgggtttcccctaaccggttacgtaaccttaccgtaccggttacggtaccgggtccgtaccggtcgggtaccgggtaggggtacccggacgggttaccttagtttaagtttacgttacgttcggttacctcgttaacgtagttcgtacgtcggttagtacggttacggtcgggtacggttacggtcgggtacgggcggaacgggtaccgtagggccgtaccggtacgtcggtaccaacggtccgaaggtccccggtaccggtccgcgttacccgg

SEQ ID NO: 130145 - DNA, 717 bp, Homo sapiens
  misc_feature: GYAE6OF02HL8HY.49.52.E08.1.454.CMB.1.raw
  modified_base (219)..(219): a, c, t, g, unknown or other
  misc_feature (219)..(219): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacagggtccgtggcccagtctcgccctgactcagcctcgcctccgtgtcgtgggtcctccgtcggacagtcgatcacctattccnccgtgcctactacggaaacctgcaggttgtagttaggttggtaaatttacttacctttctccgttagaaccaacaaccacccgaaggaccaaaccgaccccctaactactactacttactttacgacggaacggtaccgtaactacgacggtacccggcccgttacggacggggttccttacgtacgtacttcgtacctttcgcgttccggtacctcccgtacgtcgtacggccgtaacgccgttaccgtccctacccgtgaaccttaacgttcgaaccggtcggtacctaccggcgggtacggtacgggggacgtacggtacgttacgttagtttaccttaggtcgttacgttacgttatacgtcgtcgtaggtacgttaagtcggtaccgggtaggtaacgggttcgacgggtacggacgggtaacgaacgggtccgtaccggtacgttaccggacgaccggacggtaaccgtcccgtcccgtaccgtcgtacccg

SEQ ID NO: 130146 - DNA, 641 bp, Homo sapiens
  misc_feature: GYAE6OF02HOH3W.49.52.E08.1.454.CMB.1.raw
  modified_base (228)..(228): a, c, t, g, unknown or other
  misc_feature (228)..(228): n is a, c, g, or t
  modified_base (256)..(256): a, c, t, g, unknown or other
  misc_feature (256)..(256): n is a, c, g, or t
  modified_base (306)..(306): a, c, t, g, unknown or other
  misc_feature (306)..(306): n is a, c, g, or t
  modified_base (479)..(479): a, c, t, g, unknown or other
  misc_feature (479)..(479): n is a, c, g, or t
tcagagtcgagagacacgaccggtgctcgatttagtcgagctctctcggcgggggggggtcacaagaggcagcgctctcgggacgtctccaccatggcctgggctctgctgctcctcactctcctcactcaggacacgagggtcctgggcccagtctgccctgactcagcctcgcctccgtgtcgtgggtctccgtggacagtcgatcacatctctgcactagaaacngcagtgatggttaggaattatacctttntctagtaccaacacaccgagacaaacgccccaaatcactactatttacgnggacgaccacgtacgacgccggtcccgtacgtacgggtctacgtcgtatccggtcttacgtcgtcggtacctccgtacggtcgtcggacctacggaccgtaccggcccttaccgtacaacctacgttcgtccggtacggtccgtacgcgggtacgtacggggaacgtacggtnttacgttatttacgttagtcgtacttcgttactagttacgtcggtcggttatacggttacggtacgggtacggtaagggttcgtacggggagggtacggacgtaacggccgtacgtacgtacgtccgacggaccgaaggtcccgttaccgtcccgtgtaccg

SEQ ID NO: 130147 - DNA, 685 bp, Homo sapiens
  misc_feature: GYAE6OF02IEJLN.49.52.E08.1.454.CMB.1.raw
  modified_base (216)..(216): a, c, t, g, unknown or other
  misc_feature (216)..(216): n is a, c, g, or t
  modified_base (248)..(248): a, c, t, g, unknown or other
  misc_feature (248)..(248): n is a, c, g, or t
  modified_base (348)..(348): a, c, t, g, unknown or other
  misc_feature (348)..(348): n is a, c, g, or t
  modified_base (374)..(374): a, c, t, g, unknown or other
  misc_feature (374)..(374): n is a, c, g, or t
  modified_base (412)..(412): a, c, t, g, unknown or other
  misc_feature (412)..(412): n is a, c, g, or t
  modified_base (419)..(419): a, c, t, g, unknown or other
  misc_feature (419)..(419): n is a, c, g, or t
  modified_base (485)..(485): a, c, t, g, unknown or other
  misc_feature (485)..(485): n is a, c, g, or t
tcagagtcgagagacacgaccggtgctcgatttagtcgagctctctcggcggggggggtcacaagaggcagcgctcgtcgggacgtctccaccatggcctgggctctgctgctcctcactctcctcactcgaggacacgacgggtcctcgggacccagtctcgccctgactcagcctgccctcgtgtctggtctccgaggactagtcactcaaccntctccgtgacctacgaaagaaccagactaagngtaagtggttaaggaacttaattacctttctccgtaagaccaacaaccacgacgaacaaaccaccccaaatactactactattgacgacgtacctagacncggccgtacccgcggtcgggtcctancgacgttcgacttctccgtcggttccacgtacgtcgancgtaacnccgtaccggccttaccgactaataccgtcgtccggtacgtcgaccgtacgggtgaaacccgggggngacgtattacgtattagttacgttacgtagtacttagtaacgtggtaccggtcgtaagttacgggtacgggttaccgggtaacggttacggggtcgggtaccgggtacgggtaaacggtaacggttaaacgggccgttaacccggtacgtaaccggaccggtaccgaccggacgttcccgtacccgtcccgttacgtccg

SEQ ID NO: 130148 - DNA, 773 bp, Homo sapiens
  misc_feature: GYAE6OF02H36WJ.49.52.E08.1.454.CMB.1.raw
  modified_base (291)..(291): a, c, t, g, unknown or other
  misc_feature (291)..(291): n is a, c, g, or t
  modified_base (435)..(435): a, c, t, g, unknown or other
  misc_feature (435)..(435): n is a, c, g, or t
  modified_base (608)..(608): a, c, t, g, unknown or other
  misc_feature (608)..(608): n is a, c, g, or t
tcagagtcgagagacacgaccggtgctcgatttagtcgagctctcagagagaaaggggggtgggtccaggaggcagaactctgggtgtctcaccatggcctggatccctctacttcctccccctcctcactctctgacacgaggctctaggacggcccttacctagtgacgtctacgaacacgacgcccacccgttcggtagtacacggttccgtacccgagggaccacggaccggccgaggactccaccgtgtccttcggaggagactgactacttcgaaccgaaacctnttacgtcgtactttaggtacggtacagcgaaggaacggtcccggacgtaccggtcccttggttggttggtacgtagttaagtaaactaaacgacctagacggaacggtcggtacccgaggacggtacctccggtgtacgacctnttccgtcggtccgctaacggtaggaaccggacggtaactacggtacacgttagttaccggaccttagtaccggtaggtacgggtaaccgacggaaggtacggaacgggtcgggtaacgggacgttacggtacgttaatttaacggtttagttaacggtactaaacccggtaanaacccgtaacgttaaccgtaccttaggtttaacggtttactttacgtcggttaaccgttaccgaacgtcggtaacccgtacggaaacgttccgtccggtaccggttagggaccgttaacccggacccggtaaccgaaccccgtttaacgtaccgttcggttaccc

SEQ ID NO: 130149 - DNA, 767 bp, Homo sapiens
  misc_feature: GYAE6OF02HQ927.49.52.E08.1.454.CMB.1.raw
tcagagtcgagagacacgaccggtgctcgatttagtcgagctctcagagagaaagggggtgggtccaggaggcagaactctgggtgtctcaccatggcctggactccctctacttcctccccctcctcactctctgcacaggctctgacggccctctatgagctgaccacacgccctacccgtcggtgtacagtcgtccccgaggacacggaccggccgaaggtactaccaccgtggtcctcgtagggaatagtgacctagttacgaaccaaaaccgtattatcggtactttagttacggtaaccaggtacgaacggaaccggtcccgggacccgaccgggtccccgttggtaggtttggtacggtagttaagttaaaagtaaaccgacttaacggtaggaacggcgaccccgtaggagggtaccctcccggagtacgtaccgtacttccggtcggtcggtcctaacggtacgggtaccggaaggggtaaaccgtaaccggtacaacgttaggtaccgacgtaacgtccgtaagggttccggacgtaccgaagggaccgaagggacgggaacgacggtacggtaacgttaacgtttagtttagttacgtacgaaaccttaacgaaacctacgaaccttaacgtacgtttaaccggtatttcgtacgtaccgttacgtacggtacgccgtaaccgtaaggtacccgtcggtaccggttacggtccaaccggcccgtaaaccggaccccgtaaccgttacgcgttaccc

SEQ ID NO: 130150 - DNA, 275 bp, Homo sapiens
  misc_feature: GYAE6OF02IZZVM.49.52.E08.1.454.CMB.1.raw
  modified_base (252)..(275): a, c, t, g, unknown or other
  misc_feature (252)..(275): n is a, c, g, or t
tcagagtcgagagacacgaccggtgctcgatttagtcgagctctctcgccgggcacgaccggtgctcgatttagctctacgcgtcagggcacgacccggtgctcgatttagagagagtgtgttgggtttggggggaagaggaagactgacggtccccccaggagttcaggtgctgggcacagcggccctgggctgcctggtcaaggactacttcctctctcgactctgagcgggctgggcaaggcgcatagnnnnnnnnnnnnnnnnnnnnnnnn

SEQ ID NO: 130151 - DNA, 926 bp, Homo sapiens
  misc_feature: GYAE6OF02IAQX7.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctcccctcctcactctctgcacaggctctggacggcccttcctagtggagctacgaccacgacgccccaccccgtcggtcgtacgaggttccgtacccccgagggacgaaccggacggcccaagggtactaccgtacccgttcggtccttcggttaggaacggtagttacgactaacgtttacggaacccctaaaaccggtaattaaccgttcgttaactttaaggtttaccggtaaccgacggtacgaacggaaaccgggacccgggtaccccgaccgggtccccgttaggtttacgggtttacggggtacgttaaggttaagtaaaaccgtaaaacggtaccgaaccggtggggtaaccgaaccggtcccgtaagaccgggtacctttacccggaggtacggaacgttctttccgtcggtaccggtacctaccggaacggttacgggaacgggtaccgtaaacggtccgtaagtacggtaccggtactacgtaccggtaggccgggttaccgcggtaaccggaggacggggtaaacggacgggtacggacgtttaacggttacgtttaacgtttacggttaccgttaaacctaaacgtacccgtaaaacggtaacccgttaaccctaaccgtttaaggttttacgggttaactttttacggtacggtttacgtaacccggttaaccgtacgtttaaaccccgggtaaaggaaccccgggtttccggtaaacccggttaccgggttaccggtcccgaaccccgggttaccgaaacccccggaccctaaccccgttaccgaccggttaaccc

SEQ ID NO: 130152 - DNA, 702 bp, Homo sapiens
  misc_feature: GYAE6OF02HXIBH.49.52.E08.1.454.CMB.1.raw
  modified_base (210)..(210): a, c, t, g, unknown or other
  misc_feature (210)..(210): n is a, c, g, or t
  modified_base (361)..(361): a, c, t, g, unknown or other
  misc_feature (361)..(361): n is a, c, g, or t
  modified_base (392)..(392): a, c, t, g, unknown or other
  misc_feature (392)..(392): n is a, c, g, or t
  modified_base (421)..(421): a, c, t, g, unknown or other
  misc_feature (421)..(421): n is a, c, g, or t
  modified_base (569)..(569): a, c, t, g, unknown or other
  misc_feature (569)..(569): n is a, c, g, or t
tcagagtcgagagacacgaccggtgctcgatttagtcgagctctctcggcggggggggtcacaagaggcagcgctctcggggacgtctccaccgatggccgtgggctctgctgctcctcactctcctcactcgaggaccacgacgggtccgtagggccctaggtcctggccctggactccgagccgtcgccttccgtggtcgtgggtccncgtggactacggtcgaactctacactcctctcgactacgtacaaccgagacgagtcggtagttcgggtaggtaaactttacgtttaaccctttcgccgttacggtaaccaaacctaaccaccggtaaggaccaaaccgtacccctaaactnaaccgttacttagttacgtacgacggacctnacgaccggtccgacctggtacggtctcgntacctcgtcttccgtcgtaacgcctaacgtcgtcgagggtcaacgggtcctacccggtcttaacgacgacgtactcgtacgtcggtaccgtacggtcggacgggtcggaaggtcgtagtacgtttaactagtcgttcgtacgtctagntacggtacggaccgttagtaggtacggttacggtaccggttaaggggtcggtacggacgggtaacgtaacggtacggtacggtccggtaagacgtacgacgtacggtaccgaccgtcgtacccgttgtacccg

SEQ ID NO: 130153 - DNA, 766 bp, Homo sapiens
  misc_feature: GYAE6OF02IF5J4.49.52.E08.1.454.CMB.1.raw
  modified_base (170)..(170): a, c, t, g, unknown or other
  misc_feature (170)..(170): n is a, c, g, or t
  modified_base (427)..(427): a, c, t, g, unknown or other
  misc_feature (427)..(427): n is a, c, g, or t
  modified_base (456)..(456): a, c, t, g, unknown or other
  misc_feature (456)..(456): n is a, c, g, or t
tcagagtcgagagacacgaccggtgctcgatttagtcgagctctctcggcgggggggggtcacaagaggcagcgctcgtcgggacgtctccaccatggcctgggctctgctgctcctcactctcctcactcaggacacagggtcctgggcccaggtctcgccctgactcngtcctcgcctccgtgtcgtcggtctcgtgactagcgactacacctatcctcgtgacctaacgtacgaaaacctcgacaaggtgtagtaggttaggtaaactttacttaaccctttcctaccgttaacgaccaaaacaaccgaaccacggaacctaaaacccgaacccctaactacaacttacctaagttttacgaggaaccggtctaacgctacggccggaccctacgggttaggtctcgaatcgttcgtccttacncgtacgtcctaccgtacttcggccggacncgggttacccaacccgttcctacggtaaccaaacctcgttacccgtcggttccggaacctcggtaggcccgggtaagggccgagggtaccttattacgttaagtttacgtttcgaccgtttagtacttaaacggttacccgtagggtcccgttaagacggttaacgttaccgggggaaacggtacggggttaccggtaggggaacgggttaacggggaaccgtaaggtacccgggtaacggttaacccgtacggggtaccctaaccggtacggaaccggtccccggtacccttccccggtacgttacccg

SEQ ID NO: 130154 - DNA, 688 bp, Homo sapiens
  misc_feature: GYAE6OF02FRBQQ.49.52.E08.1.454.CMB.1.raw
  modified_base (249)..(249): a, c, t, g, unknown or other
  misc_feature (249)..(249): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagcccaccctcgggtgtcagtcgtccccgaggacagaccggccaggatcacctgctcgtggagatgctattcgacccaaacgntatgtcttattggtaccagcaaggacggcccgggccacggtcccctggtcgttgggtagtagtagtaataaacgacagtggaagacggccctggacgggactccgtgacgcgtacttcgtcgtggcctcgaggtcgacgggtacacggtacagtacgtcgaccatacgaggtggaacgtccggaggaccaagggaacgggacggacggtacgacgaaacgtttagttaccgttcgtaccgttaacgggtcccgaacgtaaccggtacgacggtaccggagggttacgtaccgttaggttttacgttacgggttaccggtttagggtcccgggggtaagggttaaccgggaaccggtttaccggccgggtttaacgtaccccggtttacggtacgggttacccgaaccgggtccccggtaacgggtcccgtccccccggg

SEQ ID NO: 130155 - DNA, 685 bp, Homo sapiens
  misc_feature: GYAE6OF02I66L6.49.52.E08.1.454.CMB.1.raw
tcagagtcgagagacacgaccggtgctcgatttagtcgagctctcaggagagaaagggggtgggtccaggaggcagaactctgggtgtctcaccatggcctggatccctctacttctcccctcctcactctctgcacaggctctgaggcctcctatgagctgacacagccacccgtggtgtcagtcgtccccaggacacgacggccaaggactccacctgccttctgggacgtatcgactagttacgaccctaaaccgatagtcgtactttagttcggtaccagaccaaggaacggcccgggaccgacggtccccgttaggttcggttcggtacgtacgttaggtaagtaaacggactacgtaggacgtacggcccttacggagggtacctcccgtaggacgtcgtacttcctacgtcggccgtcgacgggtacgaacgggtactaaacggtcaacgtacgttacggacctacgtacggacggtacggacggtaccgagggaccgaagggacgggtacgacgtcgttacgtaacgttagtttacgtacgtactaacgtacaaacgacgtaccacgttagttacgtacgttatcgttacgtacgtactcgaccgtaacgcggtaccaccgttacgtccgggtaacacccggaccgtaaccggaccccaacccgttacgccgtaccg

SEQ ID NO: 130156 - DNA, 823 bp, Homo sapiens
  misc_feature: GYAE6OF02GJRJ6.49.52.E08.1.454.CMB.1.raw
  modified_base (161)..(161): a, c, t, g, unknown or other
  misc_feature (161)..(161): n is a, c, g, or t
  modified_base (589)..(589): a, c, t, g, unknown or other
  misc_feature (589)..(589): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgagcctctatgagcgtnaacacacgcccacctcggtgtctacggtccgtcccccgaggacacgggaccggaccgtaaggaacttccaaccgtcgccgttcgtagggagtaagtcgactagttacgaaacccccgtaaaaacgtacttaagttccgtaccttttaagtttaccgggtaaaccacggtacgaaacggaaaccgggccccggggtaaccccgaccgggtcccccgtttggttcgggtttaggggtacggttagttaacggttaaagttaaaaaccgaccgtaacggtacggaacgggtacccggaccccgttaggtaaccgggtacccgttcccgtaacggtacggtacgtaacgttttccgtggtaccgtcgttacccgaagggtacggaaccgggtaaccgtaaccgtccgaagttacggtccgacctgtaaccgnggttaggacgttaccggacggtacgaagggtacggacgggacgtcgtaacgtacttaatttgttagtacctaaacgtcaaacgcgtaacccaacgtagttttaaccgttactttagttacttccggtacgacgttcgaaccgacggttaccggtaccgtaccgttccgggtaacgttacccggaaccggtaccccgtaaaccggacccccaaccgttaaccgtccgttaacccc

SEQ ID NO: 130157 - DNA, 559 bp, Homo sapiens
  misc_feature: GYAE6OF02F1080.49.52.E08.1.454.CMB.1.raw
  modified_base (198)..(198): a, c, t, g, unknown or other
  misc_feature (198)..(198): n is a, c, g, or t
  modified_base (226)..(226): a, c, t, g, unknown or other
  misc_feature (226)..(226): n is a, c, g, or t
  modified_base (232)..(232): a, c, t, g, unknown or other
  misc_feature (232)..(232): n is a, c, g, or t
  modified_base (327)..(327): a, c, t, g, unknown or other
  misc_feature (327)..(327): n is a, c, g, or t
  modified_base (350)..(350): a, c, t, g, unknown or other
  misc_feature (350)..(350): n is a, c, g, or t
  modified_base (399)..(399): a, c, t, g, unknown or other
  misc_feature (399)..(399): n is a, c, g, or t
tcagagtcgagagacacgaccggtgctcgatttagtcgagctctctcggcgggggggggtcacaagaggcagcgctctcgggacgtctccaccatggcctgggctctgctgctcctcactctcctcactcaggacacgagggtcctgggcccagtctgccctgactcagcctgcctccgtgtctgggtctcctggacngtcatcaccatctctgcactagaaaccngcagtnatggtaggaattatactttctctgtaccaacaacaccagacaaacgaccccaaactcaatcattatgacgccgatcacgcgcctcgcgggtctcngatcgcttctctggctcacgtcncgcacgcgacggtccctacctcgactaatcctacgtcgggctacccggngcggtcggggaaccgaggccgttagtaactttcgtttctgcgtagcctcaagttgtcgcagggacagggactaaacttaagtttgagtaagttagttacggggacggacggggtaacctaggactcggtccgtacgtagggtccacggtaccgtaacggg

SEQ ID NO: 130158 - DNA, 668 bp, Homo sapiens
  misc_feature: GYAE6OF02JFRS3.49.52.E08.1.454.CMB.1.raw
  modified_base (141)..(141): a, c, t, g, unknown or other
  misc_feature (141)..(141): n is a, c, g, or t
  modified_base (250)..(250): a, c, t, g, unknown or other
  misc_feature (250)..(250): n is a, c, g, or t
  modified_base (517)..(517): a, c, t, g, unknown or other
  misc_feature (517)..(517): n is a, c, g, or t
  modified_base (588)..(588): a, c, t, g, unknown or other
  misc_feature (588)..(588): n is a, c, g, or t
tcagagtcgagagacacgaccggtgctcgatttagtcgagctctcagagagaagggggtggtccaggaggcagaactctgggtgtctcaccatggcctggatccctctacttcctccccctctcactctctgcacagctcngagcctctatgagctgacacacgcccaccgtggtctcagtcgacccgaggacaggaccgcgaggactcaccgtgtctcgtggagacgtgctacgttcgaaccaaacgtntagtgtactttagtcgtacgagacgtaaggaacgtccgggacgaccggtcccgttggtcgttagggtacgtagttaacgtaacgtaaaacgtcacgtaggacgacggtcccaggtacgactccgtagacgtacgtacgtctcgtccggtactaccgtaaggtaccggtaagtaccgaacgtaccacgtagtacggacctaagacgtaggtacggacgacgacggtacgaaggacggagtcgtacgtacgtaacttagttaccgttanacgttaaagaccgaaacgtacgaacctaccgtaagtttagaacgtttacgtcgttaaccgtacggttaacnccggtaaccgtaacggtacgtaaccgtccggtagtccggacgaccgtacccggaaccgacccctaaccgtacgtcgtacg

SEQ ID NO: 130159 - DNA, 242 bp, Homo sapiens
  misc_feature: GYAE6OF02F5JCI.49.52.E08.1.454.CMB.1.raw
  modified_base (205)..(242): a, c, t, g, unknown or other
  misc_feature (205)..(242): n is a, c, g, or t
tcagagtcgagagacacgaccggtgctcgatttagtcgagctctctcggcgggcacgaccggtgctcgatttagtcgagctctctcggcgggcaccgaccggtgctcgatttagtcgcgcgagaaagggaaggggctggccctgacgtgtttctgttcccgccctcctctctctcgactctgagcgggctggcaaggcgcatagnnnnnnnnnnnnnnnnnnnnnnnnnnnnnnnnnnnnnn

SEQ ID NO: 130160 - DNA, 808 bp, Homo sapiens
  misc_feature: GYAE6OF02FM0IM.49.52.E08.1.454.CMB.1.raw
  modified_base (188)..(188): a, c, t, g, unknown or other
  misc_feature (188)..(188): n is a, c, g, or t
tcagagtcgagagacacgaccggtgctcgatttagtcgagctctcagagagaaagggggtgggtccaggaggcagaactctgggtgtctcaccatggcctggactccctctacttcctccccctctcactctctgcacagactctgacggcctcctagtgagtctagacacacgccctacccgtggtntctgtctccctgagacacggacggccagttactcctacgtcgcttcgtaggagtatcgactacgttcgaaccaacgactaaatagtcgttacttaccggtacgtaacacgataacggaacgtccgacggcccgaccggtacccgttgttcgtagtacttacttaagtttaaagtacgttacgttaggaccgggtaccggtccgtaccgggtacccggacctaggccggtacgttaccttccgggttaccgtccggtacctaccggtacgttcctacccgggacgtaacccgaaaccgtaacgtccggttaccgtacccgttacgaacccgtagttcgggtaacggggtcgtaccggggtccggaacgacgggaacgggtagacccgggttactacgggttacctttacgttacggtaccggtacttaaaccgggaccctaaggttcgaaaccgttgggttaacgtaccggtcgttaacctttaccgggttggttacccggtttcggttaacggggtcccggggtaacggtaacccggggtaaccgttacggtttacccgtacccggtttaccggggtaaccccgttaggggtaccccctacccgggaacccgttcccggg

SEQ ID NO: 130161 - DNA, 688 bp, Homo sapiens
  misc_feature: GYAE6OF02HM8F5.49.52.E08.1.454.CMB.1.raw
  modified_base (260)..(260): a, c, t, g, unknown or other
  misc_feature (260)..(260): n is a, c, g, or t
  modified_base (427)..(427): a, c, t, g, unknown or other
  misc_feature (427)..(427): n is a, c, g, or t
  modified_base (489)..(489): a, c, t, g, unknown or other
  misc_feature (489)..(489): n is a, c, g, or t
  modified_base (514)..(514): a, c, t, g, unknown or other
  misc_feature (514)..(514): n is a, c, g, or t
tcagagtcgagagacacgaccggtgctcgatttagtcgagctctcagagagaaagggggtgggtccaggaggcagaactctgggtgtctcaccatggcctggatccctctacttctccccctctcactctctgacacaggtcctctgacggtcctcctaatcgagtctggaaccacacgcccaccgtggtactcagtcgtcccaggactagacgccaggacacacgtgctcgtgtacgatcactacgttacgacaaacgnttagctattagtcgaaccagacacgacgccggacgtcgtccgtgtgtgtagtacttataagaaacgtccacgtaggaaccgtcggacccgtaggacgggtaaccttccgtagacgtaccgtacttcgtcgtacgtcgtaccgtacggcgtaagggaaccctacgtanaccgtagtttccgaacctagtcgtacggtaggtaccgtacgaacgggtacagggtaaccggngtaccgattacgttactgtttaacncgtaactaaccgtacaaaccgacgtaaccctaacggttaccgttagttaaacgttcctaaggttccgttaaaccgcgttacgaacccgggttaacaaccggttaccggtaccgttaacggtccggtacgaacccgttaacccggacggtaacccctacgttcgacggtttaccc

SEQ ID NO: 130162 - DNA, 789 bp, Homo sapiens
  misc_feature: GYAE6OF02GFGQN.49.52.E08.1.454.CMB.1.raw
  modified_base (137)..(137): a, c, t, g, unknown or other
  misc_feature (137)..(137): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggaccanacgggtcctcgggccagtctcgccctgactcagcctggcctccgtgtcgtgggtcctcgtggacagtcatccactatcgtccgtgacctactacgaaacctggaccagtagattaggttagggtaaactttaactttaaacccgttttccgtacgttacggtaaaccctaaacaaccaccccgtaaggaccaaaacccgtaacccccctaaaacttacaacgttacctaagttttaacgtacggaaccggttccgaactccgaaccgggttcccggtaccccgttcggtaacggggttcgtaaccgtaacgtcgtccgttaccttccgttaccggtcgtacccttaccgacggttactaccgggacgttacgacccggtaacccgttccccgtaacgtaacgtacgtaactaccgtcgtcggtacccgtaaccggtcggtacgggtaagggacgggtacgcgttaacggttatttacgttagttacgtgtttaggtactagttaacgtcggtcggttaaggtagttaacgggtggtaaaccggtagggttacgggtaccgggaggtaacggaacggttaacggtaccgtaccggtacggtacggtccgaacccgtacggtaaccggcggtaccccgtcccgtacgtacccgg

SEQ ID NO: 130163 - DNA, 727 bp, Homo sapiens
  misc_feature: GYAE6OF02H5J3G.49.52.E08.1.454.CMB.1.raw
  modified_base (204)..(204): a, c, t, g, unknown or other
  misc_feature (204)..(204): n is a, c, g, or t
  modified_base (538)..(538): a, c, t, g, unknown or other
  misc_feature (538)..(538): n is a, c, g, or t
tcagagtcgagagacacgaccggtgctcgatttagtcgagctctctcggcgggggggggtcacaagaggcagcgctctcgggacgtctccaccatggcctgggctctgctgctcctcactctcctcactcaggacacgacgggtcctgggcccagtctcgccctgactcacgcctgccctccgtgtctcgggtctccgtggacnggtcactccactacttctcctgacctacgtaacgaaaaccgacgacgtaggtgtagttacggttaagggtaaatttaccgtttaaccttttcctaccggtacgtaaccctaaaccgaaaccaacccggtaacggaaccaaacccgtaaccccctaaactacacttacttaagtttacgacggaccggtacctagaccgaccggtacccggtcccgtagggtccgggttctccgtacgttacctcgttcttcgacgtccgtccgtcgtaccgtgtcggcacggtaccgccgtccctaccgtacgtaactacgtcgtcgggtaccgtcgtaccggnggtccgggaaggaccggagtcgtaagtttagttctttagtcgtcgtattcgtaatttcgcggtacgtaggtacggtagggtcggaacggttagggtcggtacgggacgggtacgtaaggtacggtacccgtacgttaacgtcggaccgtacgaccggtacggtcccggtccccgtaccggtactacccg

SEQ ID NO: 130164 - DNA, 755 bp, Homo sapiens
  misc_feature: GYAE6OF02FX87L.49.52.E08.1.454.CMB.1.raw
  modified_base (172)..(172): a, c, t, g, unknown or other
  misc_feature (172)..(172): n is a, c, g, or t
  modified_base (220)..(220): a, c, t, g, unknown or other
  misc_feature (220)..(220): n is a, c, g, or t
  modified_base (235)..(235): a, c, t, g, unknown or other
  misc_feature (235)..(235): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacagggtcctgggcccaggtctgccctgactcagcctncctccgtgtcgtgggtctccgtggacagtcgaatcacctagtcctccngccacgtacgaaacngcagtgagttgttaggaattaacttaacctttctacctggtaccaaactaaccacccaggacctaaacgaccccaaacgtcaagtactactttagtcgaaccggtcaactacgacggaccggtccctacggtacggggttacctcgtagtaactccgtcgttcgtcgtacggtcctaccgtacgttcgacgtaccgaacgccgtaacccggtccctacccgtagtaacgtaacttccgtcggtccggtacgtaccgtagggaccggtacggggtaacggtacggtcgttaacgtagtttaacgttattcgtaccgttacgttacgtaacgttagcggttacccgggttagtaagttacgggtaccggtaaccgggttaacgggttacgggttaccgggacggggtaacgggtaaccgggttaacgggtaccggttaacccggttacccggtaacggttaccggaccggtaacccggtacgggtacccgttaccccgggtaccccggttacgggttaaccc

SEQ ID NO: 130165 - DNA, 716 bp, Homo sapiens
  misc_feature: GYAE6OF02I5CM2.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgacggcctcctatgagctgacacagcccacctggtcgtcagtcgtcccaggacagacggccaggatacacctgtcctcgtggagattcgactagttcgaacccgtaaaaccgtattacgtgttacctttaagtttacgggttaacccgaggtaccgaaagggaaccgggcccggggacccgtaaccggggtcccccttgggttcggttgggtacgagtttaggtaacgtaaaggtactagtaggaacgtacgggccctacggacgggtacctcccgtggacgcggttacttcgtcgtcggtcctaccgaggtacggacgggtaacctacggtaccgacgtacggttcggacctagtaccgaggtcgacggtccaagggtacagggaacggcgaacgtgacgttacttaatttgtagtacgtaatacgaactacgacctaacgttgttagttacgttactcgttacgtacgttaacgcgtaccgtaacgtaacggtccctaaccggttcccgttaccgggaactacccggaacccgaacccggtaccccaaccccgggtttatccggttaccc

SEQ ID NO: 130166 - DNA, 762 bp, Homo sapiens
  misc_feature: GYAE6OF02HFGCS.49.52.E08.1.454.CMB.1.raw
  modified_base (246)..(246): a, c, t, g, unknown or other
  misc_feature (246)..(246): n is a, c, g, or t
tcagagtcgagagacacgaccggtgctcgatttagtcgagctctctcggcgggggggggtccacaagaggcagcgctcgtcgggacgtctccaccatggcctgggctctgctgctcctcactctcctcactcaggacacgagggtcctgggcccagtctcgccctgactcagcctcgccttccgtgtccgttcgggtctccgtggacagtcgatccaacctattcctcctgactactacgaaaccngcagtgagttggttaggtaattaacttaccttttctaccgtacggtaaccaaccaaccgaccgaaggtaaccaaaccgacccctaaaactctaactacttaatttacgtacgtacggaccgtactacgaacggcccggtacccgtaggtacgggttctaccgtgtacgtccttcgttacgttccgtcggtcctaccgtacggttcgtagggacctacggcccgtacccggtaccctacccgtacaacgttcgttaccggtccggtacgtacccggtacggtacggggtaacgggtacggggaaccgtacgtacgttaagtttaacggttacttacggttcgttaccggtataccgttagtccggacggttacgggtacgtacgggttacgggtaccgggttacgggtacgggttccgggtacgggagggtaaacggtacgggtaacgttccggtaccgtaacggtaccgtaacggacgtaccggtccgtaccggtccccgtccggtacgttacccg

SEQ ID NO: 130167 - DNA, 664 bp, Homo sapiens
  misc_feature: GYAE6OF02HIKWO.49.52.E08.1.454.CMB.1.raw
  modified_base (203)..(203): a, c, t, g, unknown or other
  misc_feature (203)..(203): n is a, c, g, or t
  modified_base (232)..(232): a, c, t, g, unknown or other
  misc_feature (232)..(232): n is a, c, g, or t
  modified_base (260)..(260): a, c, t, g, unknown or other
  misc_feature (260)..(260): n is a, c, g, or t
  modified_base (299)..(299): a, c, t, g, unknown or other
  misc_feature (299)..(299): n is a, c, g, or t
  modified_base (371)..(371): a, c, t, g, unknown or other
  misc_feature (371)..(371): n is a, c, g, or t
  modified_base (503)..(503): a, c, t, g, unknown or other
  misc_feature (503)..(503): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacgagggtcctgggcccagtctcgccctggacctcagcctgccctcggtgtcgtgggtctccgtggacngtcgatcaccgatctctgcactagaaccngcagtgagtgtaggaattactactttcnctgacacacaccgagacaacgacccaatcatctattagngacggcatcgaggccggacctggtacgggtctcgtacgtacgtccgtatccgctcggtacctcctacgtcgnggacacgccgaccggtcccttccgtaggaacctacgttccgtacggtccgggtcctaccggtagggtaccggtaggggaccggtacgggtcttaacgttaagtttattacggttcgtaccggtttgttaacnggttaacgtcgggtaaccgtgttaacggttaccgggtaggggtaccggtaaggggttcggtccgggggtaacggaacgggtaacgtaacggggtccgtaccggtaaccgtacggtacgacgtacccgggtaagtccccgtcccggtaccgtccgttacccg

SEQ ID NO: 130168 - DNA, 804 bp, Homo sapiens
  misc_feature: GYAE6OF02II59N.49.52.E08.1.454.CMB.1.raw
  modified_base (237)..(237): a, c, t, g, unknown or other
  misc_feature (237)..(237): n is a, c, g, or t
  modified_base (248)..(248): a, c, t, g, unknown or other
  misc_feature (248)..(248): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacgagggtcctcgggcccagtctgccctgactcagcctgcctccgtgtcgtcggtcctcctggacagtcgactcaaccgatctcctgacctactacgaaaccngaccgtagttnagttggttacggtaaatttacttaaacccttttcgtccgtacggtaacccaaaacaacctacccgagaaccaaaaccgaccccccaaaactccaattaccttaattttacgaggaacggtaccgtaactcggacggacccggtcccgtacgggtacggggttccttacgtcgtaccgtcggtcctttactaccggtccgtccttaccgtacgttcgacggtaccgacgtacccggtcccgtcccctaccgtacggtaacctaaccgtttccgtaccggtccgggtacccgttaaccgggacggtccggggtacggggtaaccgggtagggtacgtttacgttaacgtttaacgtttaacgttcgttaccgttagttagttaacgttcggtaccggtaccggttagtaacgggtttgggtaccggggtaacggttacgggggttacggtaccggggtacgggtaaccgggtaaccggtacggttaccggtaccggttaccggtacgaccggtaccgaccggttaccggacccgtcccggttaccccggtaagtcccg

SEQ ID NO: 130169 - DNA, 689 bp, Homo sapiens
  misc_feature: GYAE6OF02I2N16.49.52.E08.1.454.CMB.1.raw
  modified_base (118)..(118): a, c, t, g, unknown or other
  misc_feature (118)..(118): n is a, c, g, or t
  modified_base (197)..(197): a, c, t, g, unknown or other
  misc_feature (197)..(197): n is a, c, g, or t
  modified_base (207)..(207): a, c, t, g, unknown or other
  misc_feature (207)..(207): n is a, c, g, or t
  modified_base (226)..(226): a, c, t, g, unknown or other
  misc_feature (226)..(226): n is a, c, g, or t
  modified_base (328)..(328): a, c, t, g, unknown or other
  misc_feature (328)..(328): n is a, c, g, or t
  modified_base (360)..(360): a, c, t, g, unknown or other
  misc_feature (360)..(360): n is a, c, g, or t
  modified_base (369)..(369): a, c, t, g, unknown or other
  misc_feature (369)..(369): n is a, c, g, or t
tcagagtcgagagacacgaccggtgctcgatttagtcgagctctctcggcgggggggggtcacaagaggcagcgctctcgggacgtctccaccatggcctgggctctgctgcctcctnactctcctcactcaggacacagggtcctgggccagtctcgccgtgactcagcctgcctcgtgtcgtggtctcgtggacngtcatcactntctctgcactacgaaccgncgagtgacgtggtaggtaattacttactttctcgtacggtaaccaaccgacaccgtaggaccaaaccgaccccaaactgaactatacttagtcgacggccgntaccgcgccgcccgtaggtcggtctcgtcgtntccgttctntcgtacgtcctacgcgttcgacggtacgcgacccggtccgtacccttcgacgtactacgtcgttcggtccgtacgtcggacggtcgggacgggtacgtacgggtcgttaagttagtttacttagtcgtttacgttcggtaacgttagttaacgtcggtaaccgggttagtcgggttacgggttaacgggtaccgggtaagggttcggtaccgggggacgggtaacgtaccgggttaacgggtacccggtaacggttccgtaacggtaccggacccggtaccggttccgtccggttacccggtcccggtacggttaccccg

SEQ ID NO: 130170 - DNA, 676 bp, Homo sapiens
  misc_feature: GYAE6OF02GXT07.49.52.E08.1.454.CMB.1.raw
  modified_base (208)..(208): a, c, t, g, unknown or other
  misc_feature (208)..(208): n is a, c, g, or t
  modified_base (214)..(214): a, c, t, g, unknown or other
  misc_feature (214)..(214): n is a, c, g, or t
  modified_base (227)..(227): a, c, t, g, unknown or other
  misc_feature (227)..(227): n is a, c, g, or t
  modified_base (307)..(307): a, c, t, g, unknown or other
  misc_feature (307)..(307): n is a, c, g, or t
  modified_base (342)..(342): a, c, t, g, unknown or other
  misc_feature (342)..(342): n is a, c, g, or t
  modified_base (632)..(632): a, c, t, g, unknown or other
  misc_feature (632)..(632): n is a, c, g, or t
tcagagtcgagagacacgaccggtgctcgatttagtcgagctctctcggcggggggggtcacaagaggcagcgctctcgggacgtctcaccatggcctgggctctgctgctcctcactctcctcactcaggtacacacggggtctgggccctagtctgccctgactcagcctgcctccgtgtctggtctctggacagtcgatccaccntcctcngcatacgaaaccngacagtgatggtaggaatttactaacctttctcgtacggaccaacaacaccgaggacaacgccccaaatcatctagttangagtccgatcgacgacgccgtagacgggtctcgtntacgtccgttccgttacgtcgtcggtccgtaccgttacggtcgttaccgggcctaccgggtccgtaaccgtccccgtcgtacgaacgtaacctcggttccgtacggtccgtacggacgggtacggtacgggtacggacgtcgtacgtttaggtttaacttacggttcgtattcgttaacgtattacggtcgttaccggtagtcgttaggtaacggggtacggtaagggttcgtacggggtggtaaccggtacggaacgggttaaccgtacgggtacccgtagggtacccncgggtacccgacggtacccgtacccggtccccgtaggtaccccg

SEQ ID NO: 130171 - DNA, 847 bp, Homo sapiens
  misc_feature: GYAE6OF02JT9OY.49.52.E08.1.454.CMB.1.raw
tcagagtcgagagacacgaccggtgctcgatttagtcgagctctctcggcgggggggtcacaagaggcagcgctctcgggacgtctccacatggcctgggctctgctgctcctcactctcctcactcaggacacagggtcctgggcccagtcctcgtccctgaccttcacgtcctcgtcccttccggtcggtccgttcgggttccttaccgtggactaggtccgtatccaacctagttcctcctcgactacgtacgaaaccaggaccaggttcgtagtcggttaggtaacttactttaaccgtttctaccgtaccggtaaaccaaccgtaaccctaaccggacggaaaccgtaaacccgtaacccccgtaaaccttacgtaccgttacgttaagtttaacggtacggtaaccggtaccgtacgttaaccgaccgggtcccggtacccggtaaccgggttaccgggttacgtaccgtacggtaccgttccgtcccgtttacgtccggtcggtaccctacggtccttacggtcggacacggtccgtacccggtcccgtaccgtacgtaacctacgttccgtcggttaccgaccgtcgggtacggggttacgtaaccgggggacgtacgtaccgttacggttaatttacggtaacttcgtacgtttacgttactacggttacgtccggttacggtaacgttcgttaacggggtcggttaaccgggtaaaggttccggggtacgggtacggacgggttaacccggtgggtaccggttaccggtacgtccggtaaccggtccggtaaccggtaccgggtccccttacccgggttaccccggtaggttacccc

SEQ ID NO: 130172 - DNA, 841 bp, Homo sapiens
  misc_feature: GYAE6OF02IUEBY.49.52.E08.1.454.CMB.1.raw
  modified_base (157)..(157): a, c, t, g, unknown or other
  misc_feature (157)..(157): n is a, c, g, or t
  modified_base (283)..(283): a, c, t, g, unknown or other
  misc_feature (283)..(283): n is a, c, g, or t
tcagagtcgagagacacgaccggtgctcgatttagtcgagctctcagagagaaagggggtgggtccaggaggcagaactcgtgggtgtctcaccatggcctggatccctctacttcctccccctctcactctctgcacaggctctgaggcctcctangagctagaacacacgcccacccgtcggtcgtctacggtccgtacccgaggacacggaccggccgaggactccgtactgtccgttcgtggactacgtcgactacgttaccgaacccgtaaaccggtnttaacgttacgttacctttaagttaaccggtaacctacggtaacgaaacggtaaccgggtccccgggaccgtacccgggtcccccgttaggttacgggttacgggtacggttaacgttaagggtaaacgtaacggtaaccgtacggtacggtaacgggtacccggtacccgtaacgggtaacggttaccgtaccgtaggtacggtaccgttacgttccgttcggtccggtaccgtaccggtacgggtacgggtaaccgggtaacgtaacggtaccgacggttacggtaccgaccgtaacgttcggtacggtaggtaccgacggacggacgaagggaccgggtacggacggttacgtacgttaagtttacgttacgttacgtaacctaacggactaacgtaacgtacctaacggtttgttaacgttacgtttacgttacgtaccgttaacgtacgtccggtaaccgttaccggtaacggttccgtaacccggttcggtaccggttacccgaccgggtaccctaacccgggtaccctacccggttaccgtaccgtacccg

SEQ ID NO: 130173 - DNA, 654 bp, Homo sapiens
  misc_feature: GYAE6OF02HXKIS.49.52.E08.1.454.CMB.1.raw
  modified_base (170)..(170): a, c, t, g, unknown or other
  misc_feature (170)..(170): n is a, c, g, or t
  modified_base (230)..(230): a, c, t, g, unknown or other
  misc_feature (230)..(230): n is a, c, g, or t
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgacgcctcctatcgagctgacacacncccacctcggtgtcagtcgcccaggacagaccggacaggactccaccgtgcctcgtgganatcgcattcgaccaaaccgattactgtctttattacgtaccgagtacagaacggcccgggaccgaccggtccccgttggtcggtttggtggtacgttaacgtaagtaaacgactacgtggaacggaccggtacccgtacgacgggtaccgtacccgtaggtaccgtacgtcttacgtcgtacggccgttaccgacgggtacgacgggtaaccgtacggtaccacgttacgtcggtacctagcgtagtcggtacgtacgagcgagtacggaggtacgctagtactatttacgtacgtacacgtacaactacgaactacgtttaatcgttaacttagtacgtacgtaccgtaatcggaacgtaccgtaaggtccgtaccgtcggtacggtaccaccgaaccgtaccaccccgacgtctcgtaaccg

SEQ ID NO: 130174 - DNA, 746 bp, Homo sapiens
  misc_feature: GYAE6OF02FS6RL.49.52.E08.1.454.CMB.1.raw
tcagagtcgagagacacgaccggtgctcgatttagtcgagctctcagagagaaagggggtgggtccaggaggcagaactctgggtgtctcaccatggcctggatccctctacttctccccctcctcactctctgcacaggctctgacggcctcctatgagctagacacacgcccacccgtcggtgtcgagttccgtacccccgaggacacggaccggccgaaggactccaccgtgcctacgtaggagatgctacgttcgaaccgaaaccgtatactcgtacttagttacggtaccgagacaacggaaccggcccgggaccgtaccggtccccgttggtcggttcggtaggtagttagtaaacgtaaacgacgtacgtaggacggaccggtaccctacggtaaccgggtaccttacccgtaggacgtaccgttactttccgtacgtcggtccgtaccgtacgggtaccggaacgggtaaccgtaaccggtactaacgtacggtaccgtaccgtaacttacggtagggtaacggtaccgtacccggaaggtacgtaaacgggaacgggaaccggtacggtacggtacgtaactttagtttacgtacgtaactaactaactaacgaacctaccgtactaaggtttacgtaacgtttctacgttacgttacggactcgaaccgtacgtaacgtacccgtaccgtcgtaccggtacaccgtacccgaaccgccctaaccgtctccgtaccg

SEQ ID NO: 130175 - DNA, 865 bp, Homo sapiens
  misc_feature: GYAE6OF02FRBOL.49.52.E08.1.454.CMB.1.raw
  modified_base (242)..(242): a, c, t, g, unknown or other
  misc_feature (242)..(242): n is a, c, g, or t
tcagagtcgagagacacgaccggtgctcgatttagtcgagctctcagagagaaagggggtgggtccaggaggcagaactctgggtgtctcaccatggcctggatccctctacttctccccctctcactctctgcacaggctctgaggccttcctatgagctgacacagcccaccgtcggtgccagtcgtccccgaggacctaaggaccggccaggactaccgaccctgtccgtctcgggaanagtcgcctaagttcgaacccaaaacgtatatggtactttaagttcggtaccgagtacctaacggaaccggtacccgggaccgtaccgggtcccccttaggttcggggtttacggtaggtaacttaggttaaaccgtaaaaagcccgtaaacggttaggtaaacggacggccccgttaacggacggggtacccttaccccgttagggacgtaccgttacgttacccgtttacggtacgggtaccctaccgggtacgggtaccgaaaccgggggttaaccctaaccgggttaccgaaacttaccgggttacgggtaacccgtcggtaaccgtaggttccgggtacggtaacgtacgggaaccggtagggtaaccgggaacggtacgggttaccgtaacggttaaccttaggtttactttaaggtaccgttaactaacggtaaacctacggtaaccgtaacccgttaggtttaaccgttacgttacgttcggtttaacgtacgggttactaccggaccgtaacggttaaccggtaccgttaccggttaccgggttccggttaacccgaccgggttaacccgtaaacccgggtaacccgaaccccggtttaccgtaccgttaacccg

SEQ ID NO: 130176 - DNA, 655 bp, Homo sapiens
  misc_feature: GYAE6OF02HIPMQ.49.52.E08.1.454.CMB.1.raw
  modified_base (490)..(490): a, c, t, g, unknown or other
  misc_feature (490)..(490): n is a, c, g, or t
  modified_base (647)..(647): a, c, t, g, unknown or other
  misc_feature (647)..(647): n is a, c, g, or t
tcagagtcgagagacacgaccggtgctcgatttagtcgagctctctcggcgggggggggtcacaagaggcagcgctctcgggacgtctccaccatggcctgggctctgctgctcctcactctcctcactcaggacacgagggtcctgggcccagtctcgccctgactcagcctgcctccgtgtcgtgggtcctccgtgacagtcgatccaccatctccgtgctactacgaaaccagcagtgagttggttaggaattacttaacctttctctacgtacaacaacaccaggacaaccgccccaactcactactatttacgacggacggtaccatacgcgtaccggtaccctcgggtacgggtccttacgtcgtacgtaccgttcttcgtcgtcgtccgtaccgtaccgtgtcggaccacggaccgtcccggtaccctccgtacactacttcgtacggtcggccgtcggcggtgggtacggggtacgacggtnttacggttattattacgtcgtcgttattagacgttgtcggtcgtagtacgttacggcgggtacggttaggtcgggttaggggccggtaagggtacggtacggtaccggtacgttcggacgttaccgacgtaccggacgtcccgtaccgttccccggngttacccg

SEQ ID NO: 130177 - DNA, 655 bp, Homo sapiens
  misc_feature: GYAE6OF02I3SYH.49.52.E08.1.454.CMB.1.raw
  modified_base (223)..(223): a, c, t, g, unknown or other
  misc_feature (223)..(223): n is a, c, g, or t
  modified_base (254)..(254): a, c, t, g, unknown or other
  misc_feature (254)..(254): n is a, c, g, or t
  modified_base (376)..(376): a, c, t, g, unknown or other
  misc_feature (376)..(376): n is a, c, g, or t
  modified_base (463)..(463): a, c, t, g, unknown or other
  misc_feature (463)..(463): n is a, c, g, or t
  modified_base (481)..(481): a, c, t, g, unknown or other
  misc_feature (481)..(481): n is a, c, g, or t
tcagagtcgagagacacgaccggtgctcgatttagtcgagctctctcggcgggggggtcacaagaggcagcgctctcgggactctccaccatggcctgggctctgctgcctcctcactctcctcactcgaggacacgtagggtcctcgggcccagtctcgcccgtgacctcacgtccttgccctccggtgttcgtggttcctccgtgacagtcgactcacctntcctcctcgactactacgaaacctgcaggtntagttggtgtattacttaccttctcgacgtaccaacaacaccgacggacaaacccgtacccaactctactctatttagacggacggcctagtacgacggccgtccgtggtacggtctagtcncttccgtcttcgtacgtcgtactcgtacgctacgctacgccgtaccgcctccagtactactcgtacgtcgcgtcgtcggcggtaggngcggtattagtacgtttnttatcgtagtttcgtataggttacggtcgtccggttaagtacgttacgggtcggttacgggtaacggttcggtacggggagttaccggaacgggttacggttaccggaacgttcggcggttaaccgaccggtcccggtacggttccccggaacccgttcccgggaccttacccg

SEQ ID NO: 130178 - DNA, 805 bp, Homo sapiens
  misc_feature: GYAE6OF02FLITQ.49.52.E08.1.454.CMB.1.raw
  modified_base (257)..(257): a, c, t, g, unknown or other
  misc_feature (257)..(257): n is a, c, g, or t
  modified_base (489)..(489): a, c, t, g, unknown or other
  misc_feature (489)..(489): n is a, c, g, or t
  modified_base (497)..(497): a, c, t, g, unknown or other
  misc_feature (497)..(497): n is a, c, g, or t
  modified_base (579)..(579): a, c, t, g, unknown or other
  misc_feature (579)..(579): n is a, c, g, or t
tcagagtcgagagacacgaccggtgctcgatttagtcgagctctctcggcgggggggggtcacaagaggcagcgctctcgggacgtctccaccatggcctgggctctgctgctcctcactctcctcactcaggacacgaggtcctgggcccagtctgccctgactcacgcctgcctcgtgtcgtcggggtctcccgtgggactagtcgacgtctaacccgtacttccgtccctagccctaacgtaacggaaaacccnggacctaggtagtagttaggtttaacgggtaaacttttaccttaacccgttttttaccgtcccgttaacggttaaaccccaaaactaaacccccgaaccccggtaacggtaacccgaaaacccgtacccccctaaaactcgtaaccttacgttaagtttacgtacggaacggaccgtataccggacgtccgggaccttacgggtacggtcctacgtgtacctcgttaccgtnttaccggnggaccctcgtaccgttagaccgtcgacggtcccgaccgttacccgtcccgtataacgtactcggtcgacgggtctacccggngggtcggaccgggtagggcgtacggttattatttacgttggtacgtatttacgtctggtaacgtcgggtagtaacggtaggtttaaccggacgggtaaccggttgggtacgggtacccgggtcgggaaaccgggttaggtaacgggtaccgtacccggtaacggttacggacccgtaccggtaccggtaccggtacccggtaccccgttcccggtacgttacccgg

SEQ ID NO: 130179 - DNA, 779 bp, Homo sapiens
  misc_feature: GYAE6OF02HMMO0.49.52.E08.1.454.CMB.1.raw
  modified_base (152)..(152): a, c, t, g, unknown or other
  misc_feature (152)..(152): n is a, c, g, or t
  modified_base (553)..(553): a, c, t, g, unknown or other
  misc_feature (553)..(553): n is a, c, g, or t
  modified_base (738)..(738): a, c, t, g, unknown or other
  misc_feature (738)..(738): n is a, c, g, or t
tcagagtcgagagacacgaccggtgctcgatttagtcgagctctcagagagaaagggggtgggtccaggaggcagaactctgggtgtctcaccatggccgtggtactccctctacttccctcccctctctactctctgacacgcgtcctcgngaccggtcctctagcgacgtcgtacaccacgaccgtcccctaccggtcggtagtccgacggttcccgacccggaacggacgaaacgggccggtaccggaacggttaccacctacgtccgtaccgtcggaggtaatcgtcggtacttacgttccgaaaccgtaaaccgtgttacgtcgtactttacggtacggacacggacgtaggaccggaccgtaccggaccggtccgttggtcggttgcgtaagttacgtaaacgtacgactacggcggaacggaccgtcgtacggacgtaccgcggtacgaccgtagttactcggtaccgtcggtaccgttacgcggtacgggacgaaccgtaacgtcgtagtacggtcccgtagaccgtagggcgttacgggaaccncggtacggacggtaacggaacgggtcggacggttacggtaacttaattcgtttaacggttaacgtacgttaaacggacccgaaactaacggaccctaacgggttactacggtttaactacgggtttacgaacgttacgacgtacgtaacctagggaacccttcgtaaccgggtaccgtcgggaanacccggttacgaccccgttaaccctacgccgtcgtaacccg

SEQ ID NO: 130180 - DNA, 755 bp, Homo sapiens
  misc_feature: GYAE6OF02HYY4A.49.52.E08.1.454.CMB.1.raw
tcagagtcgagagacacgaccggtgctcgatttagtcgagctctcagagagaaaggggggtgggtccagggaggcagaactctgggtgtctcaccatggcctggatccctctacttctccccctctcactctctgcacaggctctgaggcctcctatgagctgacacacgcccacctggtagtcagtcgtccccgaggaccagacggaccaggactccacctgcctcgtggagagtcgactagttaccgaccctaaaaccggtatagtagttacttacgttacgtaccagacgaggaacggccccggaccgacggtccccgtgttggttggtagtagttaggtaagtaaacgactacgtggacggaccggtcccgtaggacgggtactccgaggtacgtcgtacgttccgtcgtacggtccgtaccggtacggtacgaacggggaacctaacggtaccgaacttacggtccggacctacgtcggtaggtaccggtaccgaccggaggacgtaacgggacgggtaccggaggtaccttaacggacgtttaacgttagttacttaaccgtaaccgtaacgtaaaccgtaaaccgtaaaccgtttagtttaacggttaacgtttaccgtttacggttacgtaaccggttacgtacgacccggttaacgtaccgggaccttcccggtacggtaccggacccgtacggaccccgtaaccggtaccccgtaaccccggttatacccggtccttaaccccgg

SEQ ID NO: 130181 - DNA, 642 bp, Homo sapiens
  misc_feature: GYAE6OF02I8I43.49.52.E08.1.454.CMB.1.raw
  modified_base (231)..(231): a, c, t, g, unknown or other
  misc_feature (231)..(231): n is a, c, g, or t
  modified_base (442)..(442): a, c, t, g, unknown or other
  misc_feature (442)..(442): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcaggacacagggtcctgggcccagtctgccctgactcagcctgcctcgtgtctgggtcctccgtgacagtcgatcaccatcctcctgaccacgtacgaaaccngcaggtcgagtggttacggtaattacttacctttctccgtaggtaaccaacaacaccgagacaaccaccccaactcatacctattacgacgacggcctatcgcgaccggcctcggaggtcctcgtcgtactcgtcttctcgtcgacctcgtcgtcgtcgcgacgccgacgtcctccgatacctactcgtcgcggctcgacggtcggagggncgtacgttagtagttacttacgtcgtacgttctacgtactagtccgaacggtgtaacgtggtacggtacggtacgggttcgggtacgggaccgggtagggtaaccggtacgggttaccgggtaccggttacccggtaacggtaccgggacccggaacccgttaccgggcccgtcccggtaccccggttacgttacccccg

SEQ ID NO: 130182 - DNA, 685 bp, Homo sapiens
  misc_feature: GYAE6OF02HS1RY.49.52.E08.1.454.CMB.1.raw
  modified_base (412)..(412): a, c, t, g, unknown or other
  misc_feature (412)..(412): n is a, c, g, or t
  modified_base (561)..(561): a, c, t, g, unknown or other
  misc_feature (561)..(561): n is a, c, g, or t
tcagagtcgagagacacgaccggtgctcgatttagtcgagctctctcggcggggggggtcacaagaggcagcgctctcgggacgtctcaccatggcctgggctctgctgctcctcactctcctcactcgaggacacgacgggtcctgggccctagtctcgccctgactcgacgcctcgcctccgtgtcgtgggtctccgtaggacagtcgactaccacctactccgtcccgtactaccgtaacgaaacccgagtcgaggttagtacgttaggtagggtaacttaacgtttaacctttcggttcctacgtaaccaactaaccgaccgacgtaaccgaaactaaccccaactactataccttaagttacgtacggaacgtacgtctacgaccgaccgtccgttggacgggttcncgtacgtcttcgtcctttgacgtcgctaccgcgttacgcggctacgccgtaccgtcccttacgacactacgtcgtacgtccggcgtaaccgggacgttcggtacggggacgtacggtctagttactttaagtcgttacgcgttagtacncgttagtcgggtcgaggttcgtaacgggtcgacgggtaggttacgggtcggaagggtacgacggtacgggaccctcggttagccgttacgcggtacgcaccggttccgccgtacggttcacccg

SEQ ID NO: 130183 - DNA, 853 bp, Homo sapiens
  misc_feature: GYAE6OF02IA8HG.49.52.E08.1.454.CMB.1.raw
  modified_base (282)..(282): a, c, t, g, unknown or other
  misc_feature (282)..(282): n is a, c, g, or t
  modified_base (847)..(847): a, c, t, g, unknown or other
  misc_feature (847)..(847): n is a, c, g, or t
tcagagtcgagagacacgaccggtgctcgatttagtcgagctctctcggcgggggggggtcacaagaggcagcgctctcgggacgtctccacatggcctgggctctgctgctcctcactctcctcactcgacggaccacgtacgggtcccgtcgggcccctaggtcctcggtccctgacctcacgtcctcgccctccggtcgtcgtcgggttccttccggtacggaccgtaggtacgtactaccaacctacttcctccgtacgacctaacctacgaaaaccncgtacgagtagtaggttaggttaaggttaactttaacttttaacccgttttcctaccgtacggtaaccctaaaccaacccgtaacccgaacggaacccaaaccccgtaaccccctaaaacttcctaacttaactttaacgtttaaggtaccggaacggttaccgtacgtaccggaccgggtcccggtacccgtacgggtaacgggtccttacggtacgttacgtccgttacctttccgtccggtacggtacccttacccgtacgtccggtcgggtacctacggtcccgtacccggtaccctacccgtagtaacctcgttccgtaccgggttcggaccgttacgggccggggttacgggacggggaacgtcgggttacttgttttaacgtttagttctccggtttattccgttagttaacggtacgttccgggaaggtttacgaagggttacgggtcgggtaacgggttagggtccggggttacggacgggtaaggtacggtaacgggttcgtaccggtacggttacggaccgtaacgtccgacggttcccggcccgttacccggngtaccc

SEQ ID NO: 130184 - DNA, 714 bp, Homo sapiens
  misc_feature: GYAE6OF02F4BBM.49.52.E08.1.454.CMB.1.raw
  modified_base (108)..(108): a, c, t, g, unknown or other
  misc_feature (108)..(108): n is a, c, g, or t
  modified_base (209)..(209): a, c, t, g, unknown or other
  misc_feature (209)..(209): n is a, c, g, or t
  modified_base (223)..(223): a, c, t, g, unknown or other
  misc_feature (223)..(223): n is a, c, g, or t
  modified_base (227)..(227): a, c, t, g, unknown or other
  misc_feature (227)..(227): n is a, c, g, or t
tcagagtcgagagacacgaccggtgctcgatttagtcgagctctcagagagaaagggggtgggtccaggagcagaactctgggtgtctcaccatggcctggatccctntacttctccccctctcactctctgcacaggctctggacggcctcctatgagctgacacagcccaccctggttcagtcgtacccaggacagacggccaaggntccacctggctcgnggantgactatcgacccaaagttagtcgtattagttcgtaccagacagacggccggacacggtccctggttgttggtagtagtgtaagtaacgactacgtagacgaccggtcctacgagggtacctcccgtagcgcgttatcgtacgtcggtacctcgacggtacgacggacgtaaccggtcagtaccgttcgaccgtaacgtacgtacggtacggtacgttacggacggaacgtaacgggaacggttacgggacggttaccgttaacgacgttttaacgtttacgttacgtaacgtaaacttacgaaaaccggtagtaaccctaacggtttaacgtttaacggttactttaacgtacggtttaccggttaccggtaacttaccgggaccgttaaccggaaccgttacccgtacccgggtttccgaacgggttaaccgtacccggtaccccgtaccgaacccccgtaaccccgttcggtacccttaacccg

SEQ ID NO: 130185 - DNA, 718 bp, Homo sapiens
  misc_feature: GYAE6OF02JXNEQ.49.52.E08.1.454.CMB.1.raw
  modified_base (167)..(167): a, c, t, g, unknown or other
  misc_feature (167)..(167): n is a, c, g, or t
  modified_base (215)..(215): a, c, t, g, unknown or other
  misc_feature (215)..(215): n is a, c, g, or t
  modified_base (223)..(223): a, c, t, g, unknown or other
  misc_feature (223)..(223): n is a, c, g, or t
  modified_base (230)..(230): a, c, t, g, unknown or other
  misc_feature (230)..(230): n is a, c, g, or t
  modified_base (335)..(335): a, c, t, g, unknown or other
  misc_feature (335)..(335): n is a, c, g, or t
tcagagtcgagagacacgaccggtgctcgatttagtcgagctctctcggcgggggggggtcacaagaggcagcgctctcgggacgtctccaccatggcctgggctctgctgctcctcactctcctcactcaggacacgagggtccctgggcccagtctgccctgacnagcctgcctccgtgtctgggctccgtgacagtcgatccaccatctccngcacgtanaaaccgngacgagtgaagttgttaggtaactttaacttaaccttttcctacgtacggtaaccaaccgaaccgacccgagtaccgaaccacccctaaactccatactattaancggacgccgtataccgacgccggtacccgtacggtccggggttctacgttcggacttccggttcttcgtactcggacctaccgccttcgtcgacgacgtacccgacccggtaccctacccgtacgtaaccgtacgttccgtcgtccggtcgtaccgtcggggtacgggttacggggacggtacgtaccgttagtacgttttagttacgtagtttacccgttgtaacctttggtacttcgggtaccgggtatcgggtttacgggtcggtaccgggtaaggggttccgttacgggacgggtaccggagggtacggtaaccggttcggtaccggtacggttccgaaccggtcggacctccggtacccggtcccgtccgttacccgg

SEQ ID NO: 130186 - DNA, 774 bp, Homo sapiens
  misc_feature: GYAE6OF02HEH87.49.52.E08.1.454.CMB.1.raw
  modified_base (282)..(282): a, c, t, g, unknown or other
  misc_feature (282)..(282): n is a, c, g, or t
tcagagtcgagagacacgaccggtgctcgatttagtcgagctctcagagagaaagggggtgggtccaggaggcagaactctgggtgtctcaccatggcctggatccctctacttcctccccctcctcactctctgcacacggctctgacggtcctcctatgagtctgaacacacgcccacccgtggtctcgacggtccgtccccgaggaccgaggaccggccgaaggactccaccgtgccgtcgtaggacgtatcggactacttccgaacccgtaaaccgtntacgtcgtactttacgttacgggaaccagacgtaaggaaccggcccgggtaccgaccgggtccccgttggttcggttgggtacgtagttaacggtaaacgtaaacggaccgtaacgtacgggaacggaccggtacccgtacggacgggttacctacccggttaggaccggtacgttaacttccgtcgggtacggttcctaccgggacggggttaaccggaacggggtaaacctaaccggtactaaccgtcggtttaccggacctaacgtacggtagggtacggtacggtaccggacggacggacgggaacggtaccggacggtacgtaagtacctttagttacgttaacgtacgttaacgaaccgtaacgtaaccgtaaccgtaacgtacgtttaacggttacttcgtacgttacgtacgtagtaccgaccgtacgaacgtccgtcggtacgtaccggacaccggtaccaccgaccctaaccgtcgactccg

SEQ ID NO: 130187 - DNA, 779 bp, Homo sapiens
  misc_feature: GYAE6OF02FG0TN.49.52.E08.1.454.CMB.1.raw
  modified_base (187)..(187): a, c, t, g, unknown or other
  misc_feature (187)..(187): n is a, c, g, or t
  modified_base (192)..(192): a, c, t, g, unknown or other
  misc_feature (192)..(192): n is a, c, g, or t
  modified_base (210)..(210): a, c, t, g, unknown or other
  misc_feature (210)..(210): n is a, c, g, or t
  modified_base (223)..(223): a, c, t, g, unknown or other
  misc_feature (223)..(223): n is a, c, g, or t
  modified_base (295)..(295): a, c, t, g, unknown or other
  misc_feature (295)..(295): n is a, c, g, or t
tcagagtcgagagacacgaccggtgctcgatttagtcgagctctctcggcggggggggtcacaagaggcagcgctctcgggacgtctccaccatggcctggctctgctgctctcactctctcactcaggacacgagggtcctgggcccagtctgcctgactcagcctgcctcgtgtcgtggtctccnggacngtcgatcaccatcctccngcactagaaaccngctagtgatggttaggaacttactaacctttctcgtacgtacaaacacaccgagaccaaacgacccctaacnctatactattagcgacgcgaactgacgccggtccgtacgacgggttctacgtcgacttccgtacgttccgtcgtaccggtcccgtaccgtaccggttcgacgggtaccgaacgtccccgaccgggttcccgtacccgtaacgtaccgtaatccgttcggacgggtacccgtaccggtagggtcccggtacgggggaccgacgggttacgttaagtacggttttaacttacgttcgttccgtttacgtttaactacgttaccgggttcggtacccgggttaagttacggggttaaccgggtaccggttaaaccgggggttaacgggttttaccggggggtacgggggtaacggggtaacggaaacggggtttaaaccgggtacggttaacccccgggtacgggttaacgggtaccccggaaaccgttccccgggtaacggtacccggttaaccccccggtccccgggttaccggttttaaccccg

SEQ ID NO: 130188 - DNA, 656 bp, Homo sapiens
  misc_feature: GYAE6OF02IFFB3.49.52.E08.1.454.CMB.1.raw
  modified_base (184)..(184): a, c, t, g, unknown or other
  misc_feature (184)..(184): n is a, c, g, or t
  modified_base (197)..(197): a, c, t, g, unknown or other
  misc_feature (197)..(197): n is a, c, g, or t
  modified_base (399)..(399): a, c, t, g, unknown or other
  misc_feature (399)..(399): n is a, c, g, or t
  modified_base (409)..(409): a, c, t, g, unknown or other
  misc_feature (409)..(409): n is a, c, g, or t
  modified_base (440)..(440): a, c, t, g, unknown or other
  misc_feature (440)..(440): n is a, c, g, or t
  modified_base (456)..(456): a, c, t, g, unknown or other
  misc_feature (456)..(456): n is a, c, g, or t
tcagagtcgagagacacgaccggtgctcgatttagtcgagctctctcggcggggggggtcacgaagaggcagcgctcgtcgggacgtctccaccatggcctgggctctgctgactcctcactcgtcctcactcgaggactcgagggtcctggcccagtctcgccctgactcaagcctgcctcgngtcgtggtctcgnggactagtcgatccgacctgtcctcacgaccacgtacgaaaccgtcgcaggttgattgggttacgaattacttacctttcgtcgtacgtaccaaactacgaccaggaccaaacgacccaactacacgttacacgtttagcgacgaccggtacacgccgccggccgtagtacgggtaccttagcggtactcggcttagtcggngtccctacgnttcgtacgactacgccgccggtacctcgacncgtactctcgtcgacncggtagcgggacggtacgcggtactgttaacgttacgttgtagtcgtacgttatacgtacgttagacgtagaacgtttggaacggtacgtacgggtccgttagggacggggtaaggtaccggtaaagggtccggttaaccggtaccgttaccggtacgaccggttacgaccgttacccggtccgcccggttacgtaccgg

SEQ ID NO: 130189 - DNA, 727 bp, Homo sapiens
  misc_feature: GYAE6OF02FKVXF.49.52.E08.1.454.CMB.1.raw
  modified_base (183)..(183): a, c, t, g, unknown or other
  misc_feature (183)..(183): n is a, c, g, or t
  modified_base (232)..(232): a, c, t, g, unknown or other
  misc_feature (232)..(232): n is a, c, g, or t
  modified_base (237)..(237): a, c, t, g, unknown or other
  misc_feature (237)..(237): n is a, c, g, or t
  modified_base (261)..(261): a, c, t, g, unknown or other
  misc_feature (261)..(261): n is a, c, g, or t
tcagagtcgagagacacgaccggtgctcgatttagtcgagctctcaggagagaaaggggtgggtccaggaggcagaactctggtgtctcaccatggcctggatccctctacttctcccctcctcactctcctgcacaggtctctgaggcctcgtactgagctgacacacgccacccgtcggtntccagtcgtccccaggaccagacggtcaggactcgacctgtctctgganactgnaacttgaaccctaacggttatgtntattggtaccagcaacgtaacgcggccaacggccccgtagtcggtagtacgtacgtagtacgtaaaacgcgtactagacgtacgccgttacgaacggtcttacccgtggacgtacgttaacttccgtcgttcgtcgtacccgtggtaccgtaagggaaccgaaccggttcccgaaagttacgttacgggacccgttaagttaccgtacggttaccgggttaacgtaaccggtacggaccggttaaggaaccgggaacgggaccggtaaccctagggtaaactttaacggttagttcgtaacccagtttaacacggacgtacctaccgtaagttcggttaagtacttacggtacgttaaccgtacgttacgaccgacccggtaaacgttaccctaccgggttacctccggggttaccctacggccccgtaaaccggcccctaaaccccggtccgtacgtttaacccg

SEQ ID NO: 130190 - DNA, 731 bp, Homo sapiens
  misc_feature: GYAE6OF02GNAJQ.49.52.E08.1.454.CMB.1.raw
  modified_base (184)..(184): a, c, t, g, unknown or other
  misc_feature (184)..(184): n is a, c, g, or t
  modified_base (283)..(283): a, c, t, g, unknown or other
  misc_feature (283)..(283): n is a, c, g, or t
  modified_base (360)..(360): a, c, t, g, unknown or other
  misc_feature (360)..(360): n is a, c, g, or t
  modified_base (404)..(404): a, c, t, g, unknown or other
  misc_feature (404)..(404): n is a, c, g, or t
  modified_base (426)..(426): a, c, t, g, unknown or other
  misc_feature (426)..(426): n is a, c, g, or t
  modified_base (434)..(434): a, c, t, g, unknown or other
  misc_feature (434)..(434): n is a, c, g, or t
  modified_base (439)..(439): a, c, t, g, unknown or other
  misc_feature (439)..(439): n is a, c, g, or t
  modified_base (519)..(519): a, c, t, g, unknown or other
  misc_feature (519)..(519): n is a, c, g, or t
tcagagtcgagagacacgaccggtgctcgatttagtcgagctctcagagagaaaggggggtgggtccagggaggcagaacttctgggtgtctcaccatggcctggactccctctacttcctccccctctcactctctcgcactaggctctggacggtccctcctagtggacgtctagaaccacnccgacccgtacccgttcgggtctacgacggtccgtccccgaaggaaccgacggaccggaccgagggactccgaccgttgccgtcggtagggaacgttancggaccttacgtccgaacccgaaaacgtatacgtgtacttacggttacgaccagaccaacggaccgggcccggaccncggtccgtggtcggttgagtatagtaaactaacgcagtaggacncggtacccaggtacggcctcgngacgtctnttcgngtccggtctacggcgtacggaacggtaccgtaacggtcgtagtacggttccgacaaggtcgaaggtccggaactacgggnacgagggacgcggtagacgtagtacgttactagtacgtaaacaccaacgtaacgacctaactacggtttaattaccggtttaagttccgttaacggttaccggttacgaacgttccggtaaaccgttaccggtaaaccggttcccgtacggttcccgtacgggtaacaccccggaccgtaaccggacccctacccggacgttacgtaccccg

SEQ ID NO: 130191 - DNA, 732 bp, Homo sapiens
  misc_feature: GYAE6OF02HA5KN.49.52.E08.1.454.CMB.1.raw
  modified_base (169)..(169): a, c, t, g, unknown or other
  misc_feature (169)..(169): n is a, c, g, or t
  modified_base (240)..(240): a, c, t, g, unknown or other
  misc_feature (240)..(240): n is a, c, g, or t
tcagagtcgagagacacgaccggtgctcgatttagtcgagctctctcggcggggggggtcacaagaggcagcgctctcgggacgtctccaccatggcctgggctctgctgctcctcactctcctcactcagacacgagggtcctgggcccagtctcgccctgacctacncgcctcgccttccgtgtcgtggtctcgtggactggtcatccacctagtcctcctgacctactacgaaaccngctacgtgagttggttaaggttaaactttacttaaccttttctaccggttaacgtaacctaaaccaacctaacccgaacgaaccgaaaccacccctaaaactctacgtacttaagtttagacggcgtaccgacgtacgaccggtccgtaccctggtacggtctacgtcgtactccgtacttctcgtccgtacctaccgtacgttagcggaaccgtcggtaaccggtacccgtccctacccgtaagtaacccgtattcccggtacggttcggtacccgtccgggaggtccggtacggggacgtagtacgttattaagtttattacgttcgtactttacgtacttagtacgttccgagggtacttacggtacgtccggggtaacttagggggttgtaccgggtacggaaacggtacggtaacggtccggtacccggtacggtacgaccgttaccgtcccggaaggtttcccctacccggtccggaccccttcgg

SEQ ID NO: 130192 - DNA, 542 bp, Homo sapiens
  misc_feature: GYAE6OF01B6ZTD.22.36.D03.1.454.CMB.1.raw
  modified_base (513)..(513): a, c, t, g, unknown or other
  misc_feature (513)..(513): n is a, c, g, or t
tcagacatacgcgtcacgaccggtgctcgatttagctgcgtcacggatctctcgttggggggtctcaggaggcagcgctctcgggacgtctccaccatggcctgggctctgctattcctcaccttcctcactcagggtcacagggtcctgggccctagtctgccctgtacccagcctgcctccgtgtctggatcatctggacaggtcgatcagcatttcctgcactgggaccaacagtgacattgggtcttttgactctgtctcctggtaccaacaacgacccaggccaaacccccccaactcgaactccattttactggtgtcaacgtcgtcgggacccttcgaggagttctctcatcgcttctcaggctaccaagtctggcaacacggcctcccgtaacactctctcgggctcccagtttgagacgagtctaacttattactgtctagtttcctttaaatcggacgccaacttctcgttggtttcgcggagcaccgagtgaccgtctgtcngccaaggctagcccctggtcactcgtccg

SEQ ID NO: 130193 - DNA, 542 bp, Homo sapiens
  misc_feature: GYAE6OF01DN54F.22.36.D03.1.454.CMB.1.raw
  modified_base (216)..(216): a, c, t, g, unknown or other
  misc_feature (216)..(216): n is a, c, g, or t
  modified_base (366)..(366): a, c, t, g, unknown or other
  misc_feature (366)..(366): n is a, c, g, or t
  modified_base (506)..(506): a, c, t, g, unknown or other
  misc_feature (506)..(506): n is a, c, g, or t
  modified_base (532)..(532): a, c, t, g, unknown or other
  misc_feature (532)..(532): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacagtgacattgggtcttttgactctgtctcctggtaccaacaacacccaggccaaaccccccaactcatcatttatggtgtcactcgtcggccctcaggagtctctcatcgcttctcaggctccaagtctggcaacncggccctccctaaccatctctgggctcctagtttgaggtacgagtcttacttattactgctagtttacctttaaattcggctcctacttcgtcgttcggttttcggcggtaggccaccgtaagtcgaccgtcctcggtcncgcccaaggcctcgccccctggtccncgtcgtcccg

SEQ ID NO: 130194 - DNA, 510 bp, Homo sapiens
  misc_feature: GYAE6OF01CTAM7.22.36.D03.1.454.CMB.1.raw
tcagacatacgcgtcacgaccggtgctcgatttagctgcgtcacgatctctcttgggggtctcaggaggcagcgctctcgggacgtctccaccatggcctgggctctgctattcctcagcctcctcactcagggcacagggtcctgggcccagtctgtcctgactcagcctccctccgcgtccgggtctcctggacagtcagtcaccatctcctgcactggaaccagcagtgacgttggtggttacaagtatgtctcctggtaccaacaccacccaggcacagcccccaaaactcatgatttatgaggtcactaagcgggcctcaggggtccctgatcgcttctctggctccaagtctggcgacacggcctccctgaccgtctctgggctccaggctgaggatgaggctgattattactgctactcatatgcaggcgcaacgtcttgggtgttcgggcggagggaccgaagctggaccgtcctaggtcagcccaaggcctcgcccctcgg

SEQ ID NO: 130195 - DNA, 537 bp, Homo sapiens
  misc_feature: GYAE6OF01ERQY9.22.36.D03.1.454.CMB.1.raw
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtctttgactctgtctcctggtaccaacaacacccaggcaaaccccccaactcatcattatggtgtcactcgtcggccctcaggacgtctctcatcgcttctcaggctccaagtctggcaacacggcctccctaaccatctctggctcctagtttgaggacgagtctaacttattactgtctagtttcctttaaattcggcgtcctacgttctcggttggttttcggcggtaggcaccgtaagtcgtaccgtcctcggtcacgcccaaggcctcgccccctcggtctacctctccg

SEQ ID NO: 130196 - DNA, 587 bp, Homo sapiens
  misc_feature: GYAE6OF01CAQ1A.22.36.D03.1.454.CMB.1.raw
  modified_base (365)..(365): a, c, t, g, unknown or other
  misc_feature (365)..(365): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattggtctttgactctgtctcctggtaccaacaacacccaggccaaaccccccaactcatcatttatggtgtcactcgtcggccctcaggagtctctcatcgcttctcaggctccaagtctggcaacncggcctccctaaccatctcgtcggctccgtagtttgaggacgtagtcttacttattactgtctagtttacctttaaagttaggccgtacctacttcgttccggtttcgggttttccgggacgggtacggtccgtaccggtaacggttcggtacccgttccgtcgggtaccacggaccccgaagggcctccggcccccgttcgggtccaccgttcgttacccg

SEQ ID NO: 130197 - DNA, 516 bp, Homo sapiens
  misc_feature: GYAE6OF01DCGF0.22.36.D03.1.454.CMB.1.raw
  modified_base (484)..(484): a, c, t, g, unknown or other
  misc_feature (484)..(484): n is a, c, g, or t
  modified_base (509)..(509): a, c, t, g, unknown or other
  misc_feature (509)..(509): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaaccccccaatcatcatttatggtgtcactcgtcggccctcaggagtctctcatcgcttctcaggctccaagtctggcaacacggcctccctaaccatctctgggctccagtttgaggacgagtctacttattactgcagtttcctttaattaggcgacactctcgtggttttcggcggagcacgagtgaccgtctcggtcncgcccaaggcctcgccccctggtcnctctccg

SEQ ID NO: 130198 - DNA, 716 bp, Homo sapiens
  misc_feature: GYAE6OF01CHNEB.22.36.D03.1.454.CMB.1.raw
  modified_base (242)..(242): a, c, t, g, unknown or other
  misc_feature (242)..(242): n is a, c, g, or t
tcagacatacgcgtcacgaccggtgctcgatttagctgcgtcacggatctctcttgggggggtctcacggaggcgaagcgctctccgggacgtctccaccatggcctgggctctgctattcctcaccttcctcactcagggcactagggtcctgggcccagtctcgccctgacccagcctgtcctccgtgtcgtaggatcactctggacagtcgatcagcatttcctgcactgggaccaacngtcgacagttacggtcttttgacgtctgtctcctcggtaccaacaacaccaggaccaaaccccccaactcactacatttactggtgtcactccgtcggccctcgaggagtcgtctcatcgcttctcgacggctaccaagtctcggacaacacggcctaccctaaccatcctccgtgggtacctcccgttaaggtttacgaacgggtacgtacggttaccttaacgttaacttaccgtacgtacgttacgttttaacccgtttttaaaggttaccggtacccgtacccttaccgttaccgtttcggggtttcggggttttacccggggcggggtaaccgggtaccggaaccggtaaacggtaccggtaaccccggttcccgttaccgggtacccgtaccggaaccccgaacgggtcccgttacccggtccccccgttacccgggttcccttaaccgttcccggttttccccccgg

SEQ ID NO: 130199 - DNA, 551 bp, Homo sapiens
  misc_feature: GYAE6OF01CW02H.22.36.D03.1.454.CMB.1.raw
  modified_base (372)..(372): a, c, t, g, unknown or other
  misc_feature (372)..(372): n is a, c, g, or t
  modified_base (379)..(379): a, c, t, g, unknown or other
  misc_feature (379)..(379): n is a, c, g, or t
  modified_base (511)..(511): a, c, t, g, unknown or other
  misc_feature (511)..(511): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcacgtgggaaccaacagtgactagttgggtcttttgacttctgtctcctggtaccaacaacacccaggccaaaacccccccaactccactcatttatggtgtcactcgtccggccctcaggacgtctctcatcgcttctcaggtctcaagtcnggcaacncgcctcctaaccatctctcgggctcctagtttgaggtacgagtctacttattactgtctagtttacctttaattacggctcctactcttcgttggttttcggcggtagcaccgagtcgaccgtccgtcgacncgacccgaaggcctcgccccttggtctacgtcgttcccgg

SEQ ID NO: 130200 - DNA, 537 bp, Homo sapiens
  misc_feature: GYAE6OF01BAYZL.22.36.D03.1.454.CMB.1.raw
  modified_base (358)..(358): a, c, t, g, unknown or other
  misc_feature (358)..(358): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattggtcttttgactctgtctcctggtaccacaacaccaggcaaaccccccactcatcattatggtgtcactcgtcggccctcaggagtctctcatcgcttctcaggctcaagtctgcaacncggcctccctaacatctctggctccagtttgagacgagtctacttattactgctagttcctttaaattacggcgtcccacttccttcggttggtttttccggcggtacggccaccggtaagtcgacccgttcctcggtcacgcccaaggcctcgcccccctggtccacgtccgttcccg

SEQ ID NO: 130201 - DNA, 609 bp, Homo sapiens
  misc_feature: GYAE6OF01APIF6.22.36.D03.1.454.CMB.1.raw
  modified_base (217)..(217): a, c, t, g, unknown or other
  misc_feature (217)..(217): n is a, c, g, or t
  modified_base (315)..(315): a, c, t, g, unknown or other
  misc_feature (315)..(315): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcacgtgggaccaacagtgacagttgggtctttgactctgtctctgtaccaacacaccagaccaacccccatcatcattatgtgtcactcgtcgcctnaggagtctctctatcgtcttctcacggtcctaccaagtctaggaccaaccgaccggcccttacccctaacctacttccgtccgtcgggtccttaccgtaggtttcggaacggtacgtacgttaccttaacgtttacgttacgtcgtacttacgtttacctttaaacgtacggaccgtacctacgttcgttacggttcgggtttcggacggtacggtcgaccggtagtcgtacccgtccgtacggtcacgacccgaaggtcccgtccgcccccgttcggtcctccgtcgttcccg

SEQ ID NO: 130202 - DNA, 735 bp, Homo sapiens
  misc_feature: GYAE6OF01DD8ZM.22.36.D03.1.454.CMB.1.raw
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacaccaggaccaaaccccccactcatcatttatggtgtcactcgtcggccctcaggctctctcatcgtcttctcacggctccaagtcctggaccaacgaccggcccttacccctaaaccacttacctccgttcggggccttacccgtaggttttcggaacgggtacgtacgttccttaacgtttactttaccgtcgtaccgttaacgttttacccttttaaaagtttacgggtacccgtacccctaaccgtttccgttaccgggttttcggggttttttacccgggaccgggtaacgggtacccgtaacccgggtaaacgggtttccgggaaaccccgggtttcccgttacccggggttaccctaacccggggtacccccgtaaacggggttccccgtacccggttccccccccccggttagggttaccccgttaaccccgtttcccggttttaccccccggg

SEQ ID NO: 130203 - DNA, 667 bp, Homo sapiens
  misc_feature: GYAE6OF01BHBX7.22.36.D03.1.454.CMB.1.raw
  modified_base (230)..(230): a, c, t, g, unknown or other
  misc_feature (230)..(230): n is a, c, g, or t
  modified_base (301)..(301): a, c, t, g, unknown or other
  misc_feature (301)..(301): n is a, c, g, or t
  modified_base (319)..(319): a, c, t, g, unknown or other
  misc_feature (319)..(319): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaanagtgacattgggtcttttgactctgtctctggtaccaacaacaccaggccaacccccatcatcattatgtntcactcgtcgcctcaggngtctctcatcgcttctcaggtctaccaagtcctggacaaccgaccggtccctaccctaaccacttcctcgtacgggtccttacccgtacggttttacggacggtaccgtacgttacttaaccgtttatttaccgttcgaccttacgttttaccctttaaagtttacgggacctaccctaccgttccgtttacggttcggttttccgggaccggtacggtccgtaaccggtaacggttcggtaccccggttcccgttaccgggttaccgaacccggtaccccgtaaacgggtcccgttccgggtacccccccccgttagggttaccccaaccgttcccgtttaccccgg

SEQ ID NO: 130204 - DNA, 566 bp, Homo sapiens
  misc_feature: GYAE6OF01COB7X.22.36.D03.1.454.CMB.1.raw
  modified_base (552)..(552): a, c, t, g, unknown or other
  misc_feature (552)..(552): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctctggtaccaacaacacccaggcaaaccccccaactcatcatttatgtgtcactcgtcggccctcaggacgtctctcatcgcttctcagctcaagtctggcaacacggcctccctaaccatctctggcctcctagtttgaacggtacgagtctaacgttatactgtctagtttacctttaaagttacggacgtcctaacgttccgtacggttggtttttccggcggtacggctaaccggagtcgacccgttccgtcggtacctcgacccgtaaggcctccgccccctcgggtccnccgttccgttcccg

SEQ ID NO: 130205 - DNA, 606 bp, Homo sapiens
  misc_feature: GYAE6OF01D7K8Y.22.36.D03.1.454.CMB.1.raw
  modified_base (308)..(308): a, c, t, g, unknown or other
  misc_feature (308)..(308): n is a, c, g, or t
  modified_base (341)..(341): a, c, t, g, unknown or other
  misc_feature (341)..(341): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcacgtgggaccaacagtgactagttgggtcttttgactctgtctcctgtaccaacacaccagaccaaacccccatcatctattatggtntcactcgtcgcctcaggatctctcatcgcttcncagctaccaagtctcggacaacgaccggtccctaccctaaccacttcctcgtcgggtccttccgtaggtttcgacggtacgtagttccttaactttattacgtgtcttagtttacctttaaagtcggacctactacttcgttcggtttcgggttttccggcgggtacggccgtaccggtagtccggtacccgttccgtacggtaccgacggaccccgtaaggtcccttcccggcccccgttaggtccctaccgtccgttccccgg

SEQ ID NO: 130206 - DNA, 609 bp, Homo sapiens
  misc_feature: GYAE6OF01DAC66.22.36.D03.1.454.CMB.1.raw
  modified_base (313)..(313): a, c, t, g, unknown or other
  misc_feature (313)..(313): n is a, c, g, or t
tcagacatacgcgtcacgaccggtgctcgatttagctgcgtcacgatctctcgttggggggggtctcaggaggcagcgctctcaggacgtcaccaccatggcctgggctctgctcctcctcagcctcctcactcagggcacgagggtcctgggcccagtctgccctgactcagccctcctccgcgtccggtctcctggacagtcagtcacctatctcctgcactggaccagcagtgacgttggagttacaagtatgtctcgtaggtaccaacaccaccgaggcaacgacgacccccaaatcatacgtatttangacggtacaacgtaaggccggtacctagacgggtccctggacttcgactttcgcgtggacctcgtaagtcgtacggacgacgaccgcctacccgtgacccgtctcgtcggctacgaggctaggacgatgaggcttagtattactactgtacttacgtacaattagtcgacgtacgggcgactaacgttcggtttaggggtccgttacggggaggtacggggaacctaagggccttacgggtacccgtaccggttaacggctaccggaaccccgacgggtccctccgggtccccccg

SEQ ID NO: 130207 - DNA, 518 bp, Homo sapiens
  misc_feature: GYAE6OF01AZF8X.22.36.D03.1.454.CMB.1.raw
  modified_base (381)..(381): a, c, t, g, unknown or other
  misc_feature (381)..(381): n is a, c, g, or t
  modified_base (440)..(440): a, c, t, g, unknown or other
  misc_feature (440)..(440): n is a, c, g, or t
  modified_base (510)..(510): a, c, t, g, unknown or other
  misc_feature (510)..(510): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggcttttgactctgtctcctggtaccaacaacaccccaggcaaacccccccaactcatcatttatggtgtcactcgtcggccctcaggagtctctcatcgcttctcaggctccaagtctggcaacacggcctccctaaccntctctgggctccagtttgaggacgagtctacttattactgctagttcctttaattggcnccactctcgtggtttcggcggtaggcacgagtgaccgtcgtcggtcacgcccaaggctgccccctggccnctctcccg

SEQ ID NO: 130208 - DNA, 543 bp, Homo sapiens
  misc_feature: GYAE6OF01BM2WH.22.36.D03.1.454.CMB.1.raw
  modified_base (499)..(499): a, c, t, g, unknown or other
  misc_feature (499)..(499): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacacacccaggcaaaccccccaactcatcatttatggtgtcactcgtcggccctcaggagtctctcatcgcttctcaggctccaagtctggcaacacggcctccctaacactctcgtgggcctccagtttgaggacgagtctacttattactgctagttcctttaaattgcgccacttctcggttcggtttcggcggtacggcgaccgtagtcgtacccgtccgtcggtcncgcccaaggccgtacgccccccgtggtcctaccgtcgttcccgg

SEQ ID NO: 130209 - DNA, 685 bp, Homo sapiens
  misc_feature: GYAE6OF01ALELK.22.36.D03.1.454.CMB.1.raw
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccgacgaccccaaacccccactcactactatttagtggtctctacgtcgccgtccctacgaggtctctcctctactcgtcttcctacgacggtcctacgtaacgtcgtacgacctaaccgccggtaccctaccctaactactcctcgtcgggtcctaccgttaggtttcggaacggtacgtacgttacctttaacttacttacgtcgtacttaacgtttaaccgtttaaagttccggacccgtacctaccgttccgttacgggtttcgggtttccgggacggtacggtaccgtaaccggtacggtaccggtaccccggttccggtaccggttaccgacccggtaccccgtaacggtcccgtccccggtaccccccgttacgggtaccctcccgttccggtttaccccccg

SEQ ID NO: 130210 - DNA, 591 bp, Homo sapiens
  misc_feature: GYAE6OF01CCC7T.22.36.D03.1.454.CMB.1.raw
  modified_base (365)..(365): a, c, t, g, unknown or other
  misc_feature (365)..(365): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccagccaaaccccccaactcatcatttatggtgtcactcgtcggccctcaggagtctctcatcgcttctcaggctccaagtctggcaacncggcctaccctaaccatctctcggctcctagtttgaggacgagtcttacttacttactgtctagtttacctttaaagttacggtaccgtcctacttccgttcggttcgggttttccggcgggtacggtccgtaccggtacggtacggtacccggtccgttcgggtccgtacggccccgaaaggccgttacggtcccccttcgggttccctaccgttccgttcccgg

SEQ ID NO: 130211 - DNA, 708 bp, Homo sapiens
  misc_feature: GYAE6OF01D00NZ.22.36.D03.1.454.CMB.1.raw
  modified_base (217)..(217): a, c, t, g, unknown or other
  misc_feature (217)..(217): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacagtgacagttgggtcttttgactctgtctcctgtaccaacacaccagaccaaacccccatcatctattatggtgtcactcgtcgcctgagagtctctcatcgcttctcgacggtctacctaagtctacggaccaaaccgaccggtacccttacccctaaacctacttcccgttaccgttcggggtcccttacccgttacggttttacgggaacgggtaaccgtacgtttacctttaactttacgtttaccgttaggtacctttaacgttttaacccttttaaaggttacgggtcccgttacccgtaccgttccgtttcgggtttacgggttttccggggacgggtacgggtaccctaaccggtaacggttccggtaacccggttcccgttaccgggtaccgtaccggtaccccgtaacgggtcccgttcccggtacccccccgttcgggttaccctacccgtttccgttacccccgg

SEQ ID NO: 130212 - DNA, 522 bp, Homo sapiens
  misc_feature: GYAE6OF01BKCL3.22.36.D03.1.454.CMB.1.raw
  modified_base (493)..(493): a, c, t, g, unknown or other
  misc_feature (493)..(493): n is a, c, g, or t
  modified_base (514)..(514): a, c, t, g, unknown or other
  misc_feature (514)..(514): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtctttgactctgtctctggtaccaacaacaccaggcaaaccccccactcatcatttatggtgtcactcgtcggccctcaggagtctctcatcgcttctcaggctccaagtctggcaacacggcctccctaacatctctgggctccagtttgaggacgagtctacttattactgctagtttcctttaaattacggctaccacttcttcggttggttttcggcggtaggcaccgagtcgaccgtcctcggtcncgcccaagctcgccccgtgcncgtctccg

SEQ ID NO: 130213 - DNA, 618 bp, Homo sapiens
  misc_feature: GYAE6OF01BP4PN.22.36.D03.1.454.CMB.1.raw
  modified_base (347)..(347): a, c, t, g, unknown or other
  misc_feature (347)..(347): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacagttgggtcttttgactctgtctcctggtaccaacaaccacccaggaccaaaccccccactcatctatttatggtgtcactcgtcgcctcaggtatctctcatcgcttcncgtaggcctacgaagtcgtacggacaaaccgtaccggtccctacccgtaacctactcctcgtcgggtaccttccgtaggtttcgaacggtaccgtacgttccttaactttacttactgtacttaacgtttacctttaaattcggacctacctacttccgttcggttcgggtttacggcgggtacgccgtaaccggtacgtcggtaccgtccgtcggtccacggacccgaacggccgtccgacccccgttgggtcctaccgtccgttacccg

SEQ ID NO: 130214 - DNA, 589 bp, Homo sapiens
  misc_feature: GYAE6OF01AJZAP.22.36.D03.1.454.CMB.1.raw
  modified_base (233)..(233): a, c, t, g, unknown or other
  misc_feature (233)..(233): n is a, c, g, or t
  modified_base (349)..(349): a, c, t, g, unknown or other
  misc_feature (349)..(349): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcacgtgggaccaacngtgactagttgggtcttttgactctgtctcctggtaccaacaacacccaggccaaaccccccaactcatcatttatggtgtcactcgtcggccctcaggagtctctcatcgcttcncacggctccagtctggcaacaccggcctaccctaaccactcctcgtcgggccttccgtagtttcgacggtacgagttccttacttacttacgtcgtacttacgtttacctttaaagttcggacctccctacctcgttccgttcggttttcgggcggtacggtccaaccggtagtcgtacccgttccgtcggtcacgacccgaaggccgtccgcccccgtcggtcctccgtcgttccccgg

SEQ ID NO: 130215 - DNA, 743 bp, Homo sapiens
  misc_feature: GYAE6OF01CNTOU.22.36.D03.1.454.CMB.1.raw
tcagacatacgcgtcacgaccggtgctcgatttagctgcgtcacgatctctcttggggggggtctcaggaggcagcgctctcgggacgtctccaccatggcctgggctctgctattcctcaccttcctcactcgagggcacgacgggtcctgggcccagtctcgccctcgacccagcctgcctccgtgtctggatcatctggacagtcgatcagctatttcctgcactgggaccaacagtgactagttgggttctttgactctgtctctcgtaccaacaacaccacgaccaaacccccaactcactctatttatcgtgtcactcgtcggcctcgagtacgtctctcacgtcgtcttctacgacggtctaccgaagttcgtacggacctaaccgaccggtaccccttaccccgtaacctacgttcccgttccggtcgggtacccttacccgttaaggtttacggaacgggtaccgtacggttacctttaaccgtttactttaccgtcggtaccttaacggtttttaacccttttaaacggtttacggcccgtacccgttaaccgttccgttccgggtttacgggtttttccgggacgggtacggtacccggtaaccggaacggttaccggtaaccccggttccgtccgggttaccgtaacccgggtaccccgtaaacgggtccccgttaccccggttccccccggtaccggtttaccccgtacccgtttcccgtttacccccgg

SEQ ID NO: 130216 - DNA, 569 bp, Homo sapiens
  misc_feature: GYAE6OF01APZFJ.22.36.D03.1.454.CMB.1.raw
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggccaaaccccccaactcactcatttatggtgtcactcgtccggccctcaggacgtctctcatcgtcttctcaggctccaagtctgcaacacggcctcctaacatctctggctcctagtttgacggtacgacgtcttacgttattactgtctacgtttacctttaaagttcggactaccctacttcgttcggtttggttttcggcggagtccgtaccgagtcggtaccgttccgtcggttcacggacccgtaaggcctccgcccccgttcggtcctaccgttcgttcccgg

SEQ ID NO: 130217 - DNA, 704 bp, Homo sapiens
  misc_feature: GYAE6OF01C0ZEN.22.36.D03.1.454.CMB.1.raw
  modified_base (198)..(198): a, c, t, g, unknown or other
  misc_feature (198)..(198): n is a, c, g, or t
tcagacatacgcgtcacgaccggtgctcgatttagctgcgtcacgtagtctctcgttgggggggtctcacggaggcagcgctctcgggacgtctccaccatggcctgggctctgctattcctcaccttcctcactcagggcacgagggtcctgggcccagtctcgcctgacccagcctgcctcgtgtctggatcatcnggacaggtcatcagctatttccgagcacgtcgggaccaacgtgtcgactagttcggtcttttcgactctgtctccgtacggtaccaacacaccgacgaccaaaccccccatccatctaattacgtggtctcactcgtaccgcctacgaaggtctctctcactccgtcttcacgacggtccttaccgaagtcgtacggaccaaccgtaccggtacccctaacccgtaaccacgttaccgtccgtgggtccctacccggtttagtttacggaacggtaaccggttacgttacctttaacgttaacgtttacgttacggtacctttaacggtttaacccttttaaagggtaccgtaccgttaccttaacgttccgttacggttcggggttttaccggacgggtaaccgtacgtaccgggtaaacggttcgaacccggttccggtacggtccaccgtcccgtaacggttcccaccggttccccgtacggtaccctgtccccgttccccgg

SEQ ID NO: 130218 - DNA, 576 bp, Homo sapiens
  misc_feature: GYAE6OF01DALVX.22.36.D03.1.454.CMB.1.raw
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacaccaggccaaacccccatcatcattatggtgtcactcgtcggccctcaggagtctctcatcgcttctcaggctcaagtctggcaacacggcctcctaaccatcctcgtcggctcctagtttgaggacgagttctactttattactgtactagtttacctttaaagttacggccgtacctacttcgttcggttcgggtttttccgggcggtacggcctaaccggtaagtcgacccggttccgtcgggtccacggaccccgaaggcctccggccccccgttggtcccaccgttccgttccccgg

SEQ ID NO: 130219 - DNA, 628 bp, Homo sapiens
  misc_feature: GYAE6OF01DY0DU.22.36.D03.1.454.CMB.1.raw
  modified_base (133)..(133): a, c, t, g, unknown or other
  misc_feature (133)..(133): n is a, c, g, or t
  modified_base (330)..(330): a, c, t, g, unknown or other
  misc_feature (330)..(330): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcacctttttttccncactcagggcacagggtcctgggcccagtctgccctgacccagcctgcctccgtgtctggatcatctggacagtcgatcagctatttcctgcactgggaccaacagtgacattgggtcttttgactctgtctcctgtaccaacaacaccagccaaacccccatcatctattatggtgtcactcgtcggccctcaggntctctcatcgcttctcaggtcctccaagtctcggaccaacgaccggtcccctaccctaacctacttcctcgtcgggtccttacccgtagtttacggaggtaccgtagttccttaactttatttactgtcttacgtttaccttttaaagtacggtccgacctacttcgttcggttcgggttttacgggcgggtacggccgtaaccgagttacggacccggttccgtccggttacacggacccgtaacgggaccgtccggtccccccgttaccgggttccctaccgttccgttaccccgg

SEQ ID NO: 130220 - DNA, 606 bp, Homo sapiens
  misc_feature: GYAE6OF01DI5V7.22.36.D03.1.454.CMB.1.raw
  modified_base (233)..(233): a, c, t, g, unknown or other
  misc_feature (233)..(233): n is a, c, g, or t
tcagacatacgcgtcacgaccggtgctcgatttagctgcgtcacgatctctcgttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacngtgactagttgggtctttgactctgtctcctgtaccaacaacaccgacgaccaaacccccatcatctattatcggtgtcactcgtccggccctcgaaggctctctcatcgtcttactcgagcctacgagtctcggacaacgaccgtccctacctaaccactctcgtggtcctcgtagttacgacggacgtacgtcgttaacttacgttactgtactacgtttacttaaagtcgaccgtacctacgttacttcggttcggtttcggacgggtacgaccgtaccggtaacgtcggacccgttccgtcggtacgaccgtaccccgaaggtcccgtacccggtcccccttccggtaccgttccgtcccgttaccccg

SEQ ID NO: 130221 - DNA, 537 bp, Homo sapiens
  misc_feature: GYAE6OF01CNG8O.22.36.D03.1.454.CMB.1.raw
  modified_base (300)..(300): a, c, t, g, unknown or other
  misc_feature (300)..(300): n is a, c, g, or t
tcagacatacgcgtcacgaccggtgctcgatttagctgcgtcacgatctctcttgggggggtctcaggaggcagcgctctcaggacgtcaccaccatggcctgggctctgctcctcctcagcctcctcactcagggcacagggtcctgggcccagtctgccctgactcagcctccctccgcgtccggtctcctggacagtcagtcaccatctcctgcactggaaccagcagtgacgttggtgttataactatgtctctgtaccaacaacacccaggcaaagcccccaaatcatgatttangaggtcactaagcgacctcgagggtccctgactcgcttctctgctcaagtctaggcaacacggcctaccctgaccgtctcgtgggcctcgaggctaggaggatggagtctgtattattactgcagctacatagtgggagcaggcaacgtaagtttgggtagtccgggcgggagggaaccaaggcttacggacccggttcgtacggtccaacggcccgaagggccttcggtccccccg

SEQ ID NO: 130222 - DNA, 528 bp, Homo sapiens
  misc_feature: GYAE6OF01A9HHG.22.36.D03.1.454.CMB.1.raw
  modified_base (306)..(306): a, c, t, g, unknown or other
  misc_feature (306)..(306): n is a, c, g, or t
  modified_base (361)..(361): a, c, t, g, unknown or other
  misc_feature (361)..(361): n is a, c, g, or t
  modified_base (519)..(519): a, c, t, g, unknown or other
  misc_feature (519)..(519): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacaccaggcaaaccccccactcatcattatggtntcactcgtcgccctcaggagtctctcatcgcttctcagctccaagtctggcaacncggcctcctaaccatctctggctcagttgagacgagtctacttattactgctacgttactttaaattacgcgtcctacttcttcgttggttttcggcggtacggcgaccgaagtcgaccgtccgtcggtcacgcccaaggcctacgcccctcggtccncgtcgtccg

SEQ ID NO: 130223 - DNA, 572 bp, Homo sapiens
  misc_feature: GYAE6OF01EVZR1.22.36.D03.1.454.CMB.1.raw
  modified_base (310)..(310): a, c, t, g, unknown or other
  misc_feature (310)..(310): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtctttgactctgtctcctggtaccaacaacacccaggaccaaaccccccaactcatcatttatggtntcactcgtccggccctcaggacgtctctcatcgcttctcaggcctccaagtctggaccaacgaccggccctaccctaaccactcctcgtcgggctccgtagtttcgaggtacgtagtacttacttattactgtactacgtttacctttaaagtcggtcgtacctacgtcgttcgttggttttccggacggtacggcaccggtagtcgtaccgtcctaggtcacgcccgtaaggcctcgccccctggtcctcgtccgttcccg

SEQ ID NO: 130224 - DNA, 563 bp, Homo sapiens
  misc_feature: GYAE6OF01A5H9G.22.36.D03.1.454.CMB.1.raw
  modified_base (216)..(216): a, c, t, g, unknown or other
  misc_feature (216)..(216): n is a, c, g, or t
  modified_base (458)..(458): a, c, t, g, unknown or other
  misc_feature (458)..(458): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcacgtgggaccaacagtgactagtttggtcttttgactctgtctctgtaccaacaacacccagaccaaaccccccatcatcatttatgtgtcactcgtcggccctcagagtctctcatcgcttctcacgctccaagtctaggactaacaccggtccctccctaactactcctcgtcgggacctccgtagtttcgacggacgtatacttacttattactgtctaagtttaccttaatcgacncctacttcgttcgttggtttcggcggagtcaccgagtcgacccgtcgtcggtccgacgccccgaaggtccctcggtcccccgtaggtccctacgttccgttcccg

SEQ ID NO: 130225 - DNA, 608 bp, Homo sapiens
  misc_feature: GYAE6OF01AY543.22.36.D03.1.454.CMB.1.raw
  modified_base (304)..(304): a, c, t, g, unknown or other
  misc_feature (304)..(304): n is a, c, g, or t
  modified_base (359)..(359): a, c, t, g, unknown or other
  misc_feature (359)..(359): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacagttgggtcttttgactctgtctctggtaccaacaacacccagccaaacccccatcatcattatggtntcactcgtcgcctcaggatctctcatcgtcttctcaggctccaagtctggcaacnccggcctacccaactactctctcgggccttacgtagtttcgaggtaacgacgttactacttattactgtaccgttagtttacctttaaacgtcggtaccgacctaccgttcgttcggttcgggtttacgggaccggtacggtacccgtaaccggtagtaccggtacccgttcccggtacggtacccacggtaccccgaagggtccctcggacccccccgttacggtccctaccgttcccgttaccccgg

SEQ ID NO: 130226 - DNA, 684 bp, Homo sapiens
  misc_feature: GYAE6OF01DBUEL.22.36.D03.1.454.CMB.1.raw
  modified_base (232)..(232): a, c, t, g, unknown or other
  misc_feature (232)..(232): n is a, c, g, or t
  modified_base (304)..(304): a, c, t, g, unknown or other
  misc_feature (304)..(304): n is a, c, g, or t
  modified_base (328)..(328): a, c, t, g, unknown or other
  misc_feature (328)..(328): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctcgtgtctggatcatctggacagtcgatcagctatttcctgcactcgggaccaanagtgactagttggttctttgactctgtctctgtacaacacaccacgaccaacccccatcatcatttatggtntcactcgtcgcctcaggcgtctcnctatcgtcttctcgacggccaaccaagtccgtacggaccaaccgcccggtacccttaccctaaccacttccgtaccgtcgggtacctccgtaggtttaggacggtacgtacgttcgttaactttacttactacgtacttacgtttaacctttaagttaccggtccgtaccctaacgttccgttacggtttcgggttttaccgggacgggtaccggtaccgtaaccgggtaacggttcccggtaaccccggttcccggtacccgggttaccgtacccggtaccccgtaaccgggtcccgttcccggtacccccccgttaccggggttaccctacccggtttcccgtttacccccggg

SEQ ID NO: 130227 - DNA, 710 bp, Homo sapiens
  misc_feature: GYAE6OF01D7VKW.22.36.D03.1.454.CMB.1.raw
  modified_base (288)..(288): a, c, t, g, unknown or other
  misc_feature (288)..(288): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcacgtgggaccaacagtgactattgggtctttgactctgtctctgtacaacacaccagccaaacccccancatctattatggtgtcactcgtcgcctcgaggagtctctcatccgtcttctcgaggtcctaccgtaagtcgtggaccaaaccgaccggtacccttaccccgtaaaccctacttacctccgtggggtcccttccgtaacggtttaggaacgggtaccgtacgtttaccttaacgtttaacgttaccgttcggtacttaacggtttaccttttaaaagttacgggtccgtaccctaccgtttccgttaccgggtttcggggtttttaccgggccggggtaacgtacccgtaaacccgggtaacggttcggtaaccccggtttcccggtaccgggttacccgtaccggaacccccggtaaaggggtccccttacccgggtccccccccgttacgggttaccctacccgtttcccgttaccccggg

SEQ ID NO: 130228 - DNA, 630 bp, Homo sapiens
  misc_feature: GYAE6OF01C5FCJ.22.36.D03.1.454.CMB.1.raw
  modified_base (217)..(217): a, c, t, g, unknown or other
  misc_feature (217)..(217): n is a, c, g, or t
  modified_base (231)..(231): a, c, t, g, unknown or other
  misc_feature (231)..(231): n is a, c, g, or t
  modified_base (302)..(302): a, c, t, g, unknown or other
  misc_feature (302)..(302): n is a, c, g, or t
  modified_base (319)..(319): a, c, t, g, unknown or other
  misc_feature (319)..(319): n is a, c, g, or t
tcagacatacgcgtcacgaccggtgctcgatttagctgcgtcacgatctctcgttgggggggtctcaggaggcagcgctctcgggacgtctccaccatggcctgggctctgctattcctcaccttcctcactcagggcacagggtcctgggcccagtctgccctgacccagcctgcctcgtgtctggatcatctggacagtcgatcagctatttccngcactggaccaacngtgactattgggtcttttgactctgtctcctggtaaccaacaacaccagaccaaaccccatcatcatttangtgtcactcgtcgcctnaggctctctcactcgcttctcgacggtcctacgaagtcgtaggccaaacgaccggtcccttaccctaacctactccgttcgtacgggtccttcccgtaggttttcggaacggtacggtacgttacgttaacctttagttaactcggtacttacgttttaacctttaaagttcggacctccgtacgtttcgttcggtttcgggttttcggacggtaggtaccctaacggtacggtccgtaccgttcccgtacggtctaccggaccctaacggtcccgtaccgtcccccgtaggtacctccgttcctacccgg

SEQ ID NO: 130229 - DNA, 546 bp, Homo sapiens
  misc_feature: GYAE6OF01DBKR9.22.36.D03.1.454.CMB.1.raw
  modified_base (216)..(216): a, c, t, g, unknown or other
  misc_feature (216)..(216): n is a, c, g, or t
  modified_base (364)..(364): a, c, t, g, unknown or other
  misc_feature (364)..(364): n is a, c, g, or t
  modified_base (534)..(534): a, c, t, g, unknown or other
  misc_feature (534)..(534): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacagtgacattgggtcttttgactctgtctcctgtaccaacaacaccaggccaaacccccaactcatcatttatggtgtcactcgtcggccctcacggagtctctcatcgcttctcaggctccaagtctggcaacnccggcctccctaaccactcctctgggctccgtagtttgaggacgtagtctactttatactcgctagtttacctttaatagtcgcctacttcgttcgttcggttttcggcggacggtcgaccgagtcgaccgtccgtcggtcgcgacccgaaggcctcgcccccgtggtcnccgtcgttcccg

SEQ ID NO: 130230 - DNA, 633 bp, Homo sapiens
  misc_feature: GYAE6OF01CTYYT.22.36.D03.1.454.CMB.1.raw
  modified_base (372)..(372): a, c, t, g, unknown or other
  misc_feature (372)..(372): n is a, c, g, or t
  modified_base (585)..(585): a, c, t, g, unknown or other
  misc_feature (585)..(585): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctcgtgtctggatcatctggacagtcgatcagctatttcctgcacgtgggaaccaacagtagactagtttgggtcttttgacttcgtgtctccgtaggtaaccaacaaccacccacggacccaaaaccccccaataccatctatttatggtatcacttcgtaccggcctcgaggtacgtctcctacatcgtcttcncagcctacaagtctggacaacgaccgcctaccctaacgacttctcgtacggtctaccgtagtttacggaacggacgtacgttacttaaccgtttatacgtcggtacttaacgttttaccctttaaagttacggcccttacctaccgttcgtaccggtttggtttcgggaccggtaggacctaaccggtagtccgtacccgtccgtcggtaccncggacccaaggtccgcccgtccccgtacggtctaccgtccgttacccg

SEQ ID NO: 130231 - DNA, 684 bp, Homo sapiens
  misc_feature: GYAE6OF01A0ZS8.22.36.D03.1.454.CMB.1.raw
  modified_base (309)..(309): a, c, t, g, unknown or other
  misc_feature (309)..(309): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtctttgactctgtctcctggtaccaacaacacccaggaccaaaccccccatcactcatttatggtntcactcgtcggccctcagagtctctcatcgtcttctcacggcctaccgaagttcgtggaccaaaccgaccggcccttacccctaaccacttcctcgtcgggacctacccgtaggtttacgaacgggtaccgtacgttccttaactttacgtttaccgttgtaccttacgtttaaccttttaaagttacgggaccgtaccctaaccttccgttaccggtttcgggttttaccgggcgggtacggtacccgtaaccggtaacggttccggtaaccccggttccggttaccgggtacccgtaccggtaccccggtaaacgggtcccgttcccggtacccccccgttacgggtaccctacccgttcccgtttacccccg

SEQ ID NO: 130232 - DNA, 566 bp, Homo sapiens
  misc_feature: GYAE6OF01CEHJO.22.36.D03.1.454.CMB.1.raw
  modified_base (232)..(232): a, c, t, g, unknown or other
  misc_feature (232)..(232): n is a, c, g, or t
  modified_base (310)..(310): a, c, t, g, unknown or other
  misc_feature (310)..(310): n is a, c, g, or t
  modified_base (523)..(523): a, c, t, g, unknown or other
  misc_feature (523)..(523): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacngtgacattgggtcttttgactctgtctcctggtaccaacaacacccaggccaaaccccccaactcatcatttatggtntcactcgtcggccctcaggacgtctctcatcgcttctcacggctccaagtctggcaacgaccggccctaccctaaccatctcgtggctctagttgaggacgagtcttacttattactgtactacgtttacctttaagttacggccgtacctacttcgttcggttcggtttcggcgggtacggccgtaccgtagtcgtacccgtccgtcggtcncgcccgaaggccgtccgcccccgtcggtcctccgtcgttcccg

SEQ ID NO: 130233 - DNA, 632 bp, Homo sapiens
  misc_feature: GYAE6OF01EEOU9.22.36.D03.1.454.CMB.1.raw
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcacgtgggaccaacgagtgactagtttgggtcttttgactctgtctcctgtaccaacaacaccagaccaaacccccatcatctattatgtgtcactcgtcgcctcagtatctctcactcgtcttctcgacggtcctaccgaacgttcgtcggaccaaaccgaccggtccctacccctaaccgtactccgttccgtcgggtacccttccgtacggtttaggacggtacgtacgttaccttaactttacttacgtgtacttaacgttttacctttaaagtcgggtacctacccgtacttccgttcgggtttcggttttacgggcggtacggccgtaacggtacgtcgtacccggttcgttcggtacctacgacccgtaaggccttcggcccccgtaggtcctccgtcgttacccg

SEQ ID NO: 130234 - DNA, 714 bp, Homo sapiens
  misc_feature: GYAE6OF01C71VH.22.36.D03.1.454.CMB.1.raw
  modified_base (148)..(148): a, c, t, g, unknown or other
  misc_feature (148)..(148): n is a, c, g, or t
  modified_base (232)..(232): a, c, t, g, unknown or other
  misc_feature (232)..(232): n is a, c, g, or t
  modified_base (699)..(699): a, c, t, g, unknown or other
  misc_feature (699)..(699): n is a, c, g, or t
tcagacatacgcgtcacgaccggtgctcgatttagctgcgtcacgatctctcggttggggggggtctcaggaggcagcgctcgtcgggacgtctccaccatggcctgggctctgcttattcctctaccttcctcactcgagggcacgngggtcctgggcccagtctcgccctgacccagcctcgccctccgtgtctggatcatcgtggacagtcgatcgagcttatttccgngcacgtcgggaaccaacgtgtgactagttggttcttttgacttctgttcctcgtacggtaaccaacaaccaccgacgaccccaaaacccccataccatctaagtttagtcggtcgtcacgttccgtccggcctcgaaggtctctctacgtctccgtcttccacgacggtcctaccgtaacgtcgtacggacctaaccgacccggtcccctttaccctaaacctcgttccgttccggttcgggccctttacccggttaaggtttcgggaaacggtccggttaacgttaccttaacttttaacgtactcggtactttaacgttttaaccttttaaagttcggccctaccgttacgttcgttcgggtttacgggtttcgggccgggtaggtaccctaacggtacggtcgtaccccgttcgtaggtcaacccggacccctagggtcctccccggtaccccgttggtacccnccgttcgttaccccg

SEQ ID NO: 130235 - DNA, 645 bp, Homo sapiens
  misc_feature: GYAE6OF01BHP29.22.36.D03.1.454.CMB.1.raw
tcagacatacgcgtcacgaccggtgctcgatttagctgcgtcacgatctctcttgggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttacaagtatgtctctggtaccaacaccaccaggcacacgcccccaaactcatgatttatgaggtcactaagcggcctcgagggtccctgactcgcttctcgtcggctccaagtctggcaacgcggccctcctgaccattcctcgtcgggcctcccgaggtctaggaagagtggacggtcgttagtaattttattaccgtgtcttggtccttacgtagttttcggaccgtacgggtcccgtacccgttaacgtaccggtttcgggggttcgggttacccggggacggggtaacggggtaaccccgaaagggtccccgttacgggtaacccccggtttacccggttaacgggttacccgaacccgggtacccccgtaaacggggttccccgttaccccccggg

SEQ ID NO: 130236 - DNA, 579 bp, Homo sapiens
  misc_feature: GYAE6OF01CTHSU.22.36.D03.1.454.CMB.1.raw
  modified_base (216)..(216): a, c, t, g, unknown or other
  misc_feature (216)..(216): n is a, c, g, or t
  modified_base (298)..(298): a, c, t, g, unknown or other
  misc_feature (298)..(298): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacagtgactattgggtcttttgactctgtctctgtaccaacaacaccagccaaacccccatcatcattanggtgtcactcgtccggcctcaggatctctcatcgtcttctcagtctacaagtctaggcaaccgacggccctaccctaaccactcctacgtcgggctccgtagtttcgaggtacgtagtcttaacttattacgtgtactacgtttacctttaaagttcggacgtcctacttcgttcggttcggtttcggcggtacggtccgtaccgtaaggtccgaccggttcccgtacggtcgacgtaccgaacggccgtccgcccccgttcggtcctccgttcgtcccgg

SEQ ID NO: 130237 - DNA, 595 bp, Homo sapiens
  misc_feature: GYAE6OF01ERNNE.22.36.D03.1.454.CMB.1.raw
  modified_base (302)..(302): a, c, t, g, unknown or other
  misc_feature (302)..(302): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattggtctttgactctgtctcctgtaccaacaacaccagccaaaccccccatcatcattatggtntcactcgtcggccctcagacgtctctcatcgcttctcaggcctaccaagtcctggaccaacgaccggccctaccctaaccgacttcctacgtcgggtcctccgtaggtttgaacggaccgtagttcgttaactttacgtactcgtctaacgtttacctttaaagttcggcctcctacttcgttcggttcggttttccgggacggtaggtccgaaccgtagtcggacccgttccgtacggtccacgacccgaaggcctccggccccccttaggtccctaccgtccgttccccgg

SEQ ID NO: 130238 - DNA, 515 bp, Homo sapiens
  misc_feature: GYAE6OF01DWY07.22.36.D03.1.454.CMB.1.raw
  modified_base (216)..(216): a, c, t, g, unknown or other
  misc_feature (216)..(216): n is a, c, g, or t
  modified_base (231)..(231): a, c, t, g, unknown or other
  misc_feature (231)..(231): n is a, c, g, or t
  modified_base (360)..(360): a, c, t, g, unknown or other
  misc_feature (360)..(360): n is a, c, g, or t
  modified_base (506)..(506): a, c, t, g, unknown or other
  misc_feature (506)..(506): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacngtgacattgggtcttttgactctgtctcctggtaccaacaacaccaggcaaacccccatcatcatttatggtgtcactcgtcggccctcaggagtctctcatcgcttctcaggctcaagtctggcaacncggcctcctaacatctctggctcagttgagacgagtctacttatactgctagttcctttaaatcgcgtcctactcttcggttggttttcggcggtaggcacgagtcgaccgtccgtcggtcacgcccaaggcctcgcccctggtcncgtctcccg

SEQ ID NO: 130239 - DNA, 689 bp, Homo sapiens
  misc_feature: GYAE6OF01CCLL0.22.36.D03.1.454.CMB.1.raw
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacagttgggtcttttgactctgtctcctggtaccaacaacaccagaccaaacccccatcatcattatggtgtcactcgtcgcctcaggacgtctctcatcgtcttctcacggctaccaagtctggacaacgccggtcctaccctaaccactcctccgtcgggtcctacccgtaggttttcggaacgggtacggtacgttccttaactttactttacgtacgtacttaagttttaacccttttaaagttacggtacctacccgtaaccgttccgtttacgggtttcgggtttttaccgggcgggtaacgggtccgtaacccggtaacggttaccggtaaccccggttcccggtttacccgggtacccgtaaccggtacccccggtaaaccgggttcccgttcccggtaccccccccgttacggggttccctaacccgtttcccgtttcccccggg

SEQ ID NO: 130240 - DNA, 640 bp, Homo sapiens
  misc_feature: GYAE6OF01ETFBA.22.36.D03.1.454.CMB.1.raw
  modified_base (232)..(232): a, c, t, g, unknown or other
  misc_feature (232)..(232): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacngtgacagttggtctttgactctgtctctgtacaacaacaccagccaacccccatcatcattatggtgtcactcgtcggcctcaggagtctctcatcgcttctcacggctaccaagtcctaggaccaacgaccggtccctacccgtaaccacttcctcgtcgggaccttccgtaaggtttgaacgggtaccgtagttcctaactttaacttactgtacttacgtttacctttaaaagttcggaccgtaccctaacgttccgttccggtttcgggtttttccgggacggtacgggtaccgaaccggtaaaggtaccggtacccggttcccgttacgggtacctacggaccccgtaaaggtccgttaacccggccccccgttagggtccctaccgttcccgtttaccccgg

SEQ ID NO: 130241 - DNA, 610 bp, Homo sapiens
  misc_feature: GYAE6OF01DTRYU.22.36.D03.1.454.CMB.1.raw
  modified_base (253)..(253): a, c, t, g, unknown or other
  misc_feature (253)..(253): n is a, c, g, or t
  modified_base (296)..(296): a, c, t, g, unknown or other
  misc_feature (296)..(296): n is a, c, g, or t
  modified_base (316)..(316): a, c, t, g, unknown or other
  misc_feature (316)..(316): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcacgtggaccaacagtgacagttggtctttgactntgtctctgtaccaacacaccagaccaacccccatcatcattangtgtcactcgtcgcctgagntctctcatcgcttctacgaggtcctcgaagtcgtacgacaacaccggtaccctaccctaacctactactccgtcggtctccgtagtttcggacggtacgtacgtcttaactttattaccttcgtacgttacgtttaccgtttaagttacggtaccgtaccgtaacttccgtttacgtttcgggtttcggtcgggtacgtaccgaccggtacgtaccggtacccgtccgttcgggtaccacggtacccgaacggtcctacccggtccccgtacgtccctaccgttccgttccccg

SEQ ID NO: 130242 - DNA, 542 bp, Homo sapiens
  misc_feature: GYAE6OF01ANYKP.22.36.D03.1.454.CMB.1.raw
  modified_base (302)..(302): a, c, t, g, unknown or other
  misc_feature (302)..(302): n is a, c, g, or t
  modified_base (373)..(373): a, c, t, g, unknown or other
  misc_feature (373)..(373): n is a, c, g, or t
  modified_base (495)..(495): a, c, t, g, unknown or other
  misc_feature (495)..(495): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccacaacacccaggccaaaccccccatcatcatttangtgtcactcgtccggccctcaggagtctctcatcgcttctcaggctcaagtctgcacacgcctccctaacntctcgtggctcagttcgagacgagtcttacgttattactgctagtttacctttaagtacgcgtaccacttctcgttcggtttcgacggtacgtcaccgtagtcgtacccgtccgtccggacncggacccgaaggtccctcgcccccgttcggcctaccgttcgttcccg

SEQ ID NO: 130243 - DNA, 593 bp, Homo sapiens
  misc_feature: GYAE6OF01DKR2G.22.36.D03.1.454.CMB.1.raw
  modified_base (219)..(219): a, c, t, g, unknown or other
  misc_feature (219)..(219): n is a, c, g, or t
  modified_base (304)..(304): a, c, t, g, unknown or other
  misc_feature (304)..(304): n is a, c, g, or t
tcagacatacgcgtcacgaccggtgctcgatttagctgcgtcacgatctctcgttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcacgtgggaccaacagtgacagttgggtcttttgactctgtctctggtaccaacaacaccagccaaacccccatcatctattanggtgtcactcgtcgcctcaggtacgtctctcatcgcttctcacggctccgaagtcgtggccaacgaccggtccctaccctaacctacttcctacgtcgggccttcccgtagttttcggaacggtacgtacgtctttaacttattacctagtctaacgtttaccttttaaagtcggtacctaccctacttcgttcggtttcggtttcgggcggtaggaccctacggagtcgacccgtccgtcggtccacgacccgtaaggcctccgccccctggtcctccgtccttcccg

SEQ ID NO: 130244 - DNA, 633 bp, Homo sapiens
  misc_feature: GYAE6OF01DI5TK.22.36.D03.1.454.CMB.1.raw
  modified_base (218)..(218): a, c, t, g, unknown or other
  misc_feature (218)..(218): n is a, c, g, or t
  modified_base (304)..(304): a, c, t, g, unknown or other
  misc_feature (304)..(304): n is a, c, g, or t
  modified_base (349)..(349): a, c, t, g, unknown or other
  misc_feature (349)..(349): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcacgtgggaccaacagtgactagttggttctttgactctgtctctgtaccaacacaccacgaccaacccccatcatctatttagnggtctcacgtcgtccgcctacgaggtactctctcactcgtcttcncgacgcctacagtctgacaccgaccgcccttaccctaacctctcctccgtcggtcctacgtagtttcggaggtacgtacgttcttacttattacgtacgtacgttattttacctttaagttcggtaccgtacctaccgttcgttccgggtttggttttaccggacgggtaacggtccgtaaccggtacggtaccgtacccggttccgtaccggtaccgacccggtacccgtaacggtcccgtacccgtcccccgttaccggtccctaccgttcccgttccccgg

SEQ ID NO: 130245 - DNA, 636 bp, Homo sapiens
  misc_feature: GYAE6OF01B8JPF.22.36.D03.1.454.CMB.1.raw
  modified_base (303)..(303): a, c, t, g, unknown or other
  misc_feature (303)..(303): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctcgtgtctggatcatctggacagtcgatcagcatttcctgcactgggaccaacagtgactagttgggttcttttgactctgtctcctgtaccaacaacaccagaccaaacccccatcatcatttangtcgtcactcgtcggcctcgaggagtctctcatcgtcttactcgacggcctacctaagtctacggcaaaccgcggtccccttaccctaacctacttcctcgtcgggccttccgtagtttggaacggacgtacgttccttaactttattaacgtgtacttacgttttacctttaaagttcggccgtaccctaccgttcgttcggttttcgggttttcccgggacgggtacggtaccgtaaccggtagttaccgtaccccggttccggttccggaccgtaccggaccccgaaggtccgtcccggacccccgttcggtacctccgttccttccccg

SEQ ID NO: 130246 - DNA, 688 bp, Homo sapiens
  misc_feature: GYAE6OF01DT1OZ.22.36.D03.1.454.CMB.1.raw
tcagacatacgcgtcacgaccggtgctcgatttagctgcgtcacgatctctcttgggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcacgtcgggaccaacagtgactagttgggttctttgactctgtctctgtaccaacacaccacgaccaaacccccatcatctattatggtctcactcgtcgcctgaggactctctcactcgtcttctcgacggtcctaccgtaacgtctcggaacaaccgtacccggtccccttacccctaacctactccgttccgtacgggtcccttaccgttaggtttacggaacggtaccgtacgttaccttaactttactttactcggtacttaacgttttaaccgtttaaagttcggaccgttaccctaccgttcgttacggtttcgggtttccgggaccgggtaccggtaccgtaccggtaaacggtccggtaaccccggttccgttacgggtaccgtacccggacccggtaaacggtccccgttcccggtccccccgttacggtccccttaccggttcccgtttccccccgg

SEQ ID NO: 130247 - DNA, 713 bp, Homo sapiens
  misc_feature: GYAE6OF01BV8KG.22.36.D03.1.454.CMB.1.raw
  modified_base (231)..(231): a, c, t, g, unknown or other
  misc_feature (231)..(231): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacngtgacattgggtcttttgactctgtctctgtacaacaacacccaggcaaacccccaatcatcatttatgtgtcactcgtcggccctcaggagtctctcactcgtcttctcaggctccaagtctgctaacgacggcctacccgtaaccacttctcgtcgggcctccgtaacgtttcgaacggtaacgtacggttccttaacgtttaactttaccgttacggtcctaaggttttacccttttaaaacgtttacggtaccgttaccccgtaaaccgtttccgtttacccggttttcggggttttttacccgggacggggttaaccgggtaccggtaaacccgggtaaacggttacgggtaacccccggtttccccggttaccggggttacccaaccgggttacccccgtaaaacggggtcccgtttaccccggaccccccccgttacccgggttccctaaccccgtttcccggtttaacccccgg

SEQ ID NO: 130248 - DNA, 754 bp, Homo sapiens
  misc_feature: GYAE6OF01BSR2T.22.36.D03.1.454.CMB.1.raw
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcacgtgggaccaacagtgacagttgggtcttttgactctgtctcctgtaccaacacaccagccaacccccatcatcattatgtgtcactcgtcgccctgagagtctctcactcgcttctcacggtcctaccgtaagtccgtacggaccaaaccgacccgggtccccttaccccgttaaacccacgttcccttccgtcggggtacccttacccgttaacgggtttttacggaacgggtaaccggttaacggtttacccttttaaacctttaacgttttaaccgttcggtaccctttaacggtttttaaccctttttaaaaacggttacgggtacccgttaccccgtaaccgtttcccgtttaccggggttttacgggggttttttccgggacggggtaacgggtcccgtaaacccggtaaggttccggtaaccccggttcccgttaccgggttaccgtacccggaccccgtaaagggttccccgtacccggtcccccccgttacgggtccccttaacccgttcccgtttacccccgg

SEQ ID NO: 130249 - DNA, 650 bp, Homo sapiens
  misc_feature: GYAE6OF01D79M6.22.36.D03.1.454.CMB.1.raw
  modified_base (218)..(218): a, c, t, g, unknown or other
  misc_feature (218)..(218): n is a, c, g, or t
  modified_base (330)..(330): a, c, t, g, unknown or other
  misc_feature (330)..(330): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcacgtcgggaccaacagtgactagtttgggttcttttgacttcttgtcctccgtcggtaaccaacaaccacccgacggaccccaaaccccccatcactctatttagtggtntcactcgtccgccctcgaggtcgtcctctctactcgtcttctcgacggtcctaccgaagtctacggaccaacgacccggtacccttaccctaacctctccgtacgtcgggtccttaccgtaggttacgacgggtacgtacgttacttaactttacgttactcgtacttacgtttacctttaaacgtcggtacctaccgtacgttcgttcggttcggtttcggacggtacggacgaccggtagtccgtacccgttccgtacggtcgtaccgacccgtacggtccctcccggccccgttcggtcctcccgttcgttcccccg

SEQ ID NO: 130250 - DNA, 590 bp, Homo sapiens
  misc_feature: GYAE6OF01AGA1A.22.36.D03.1.454.CMB.1.raw
  modified_base (303)..(303): a, c, t, g, unknown or other
  misc_feature (303)..(303): n is a, c, g, or t
  modified_base (528)..(528): a, c, t, g, unknown or other
  misc_feature (528)..(528): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacaccaggccaaaccccccactcatcatttanggtgtcactcgtcggccctcaggagtctctcatcgcttctcaggctcaagtctggcaacacggcctccctaacatctctggctcctagtttcgaggtacgacgtcttaacttattactcgctagtttacctttaaagttcggaccgtcctacgttccgttcggttgggttttccgggacgggtacggtcctaccggtaagttcggacccggttccgtcgggtacnccggaccccgtaagggcccgttccggccccccgttacgggtccctccgttccgttaccccgg

SEQ ID NO: 130251 - DNA, 565 bp, Homo sapiens
  misc_feature: GYAE6OF01EVW94.22.36.D03.1.454.CMB.1.raw
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggccaaaccccccaatcatcatttatggtgtcactcgtcggccctcaggagtctctcatcgcttctcaggcctccaagtcctggcaacgaccggccctaccctaaccacttcctcgtgggccttcctagtttgaggtacgagttcttactttattactgtactacgtttacctttaaagttcggacgtccctacttcttcgttggttttccggcggtaggcaccggtaagtcgtaccgtccgtcggtcacgcccgaaggcctcgccccgtgtctaccgtcgtcccg

SEQ ID NO: 130252 - DNA, 876 bp, Homo sapiens
  misc_feature: GYAE6OF01BP6KZ.22.36.D03.1.454.CMB.1.raw
tcagacatacgcgtcacgaccggtgctcgatttagctgcgtcacgatctctcgttgggggggtctcaggaggcagcgctctcgggacgtctccaccatggcctgggctctgctattcctcaccttcctcactcagggcacagggtcctgggcccagtctcgccctgacccagcctgcctccgtgtctggatcatctggacagtcgatcagctatttcctgccacgtcggggaaccaacgagtgactagtttgggttcttttgacttctcgttctccgtacggtaaccaacaaccacccgacggaccccaaaccccccaactccactctatttagtcggtctcacgtcgtccggccctcgacggtacgtctctctactccgtcttccgtacgtacggtcctaccgtaacgttcgtacgggacctaaaccgacccggtacccttaaccccgtaacctacttccgttaccggtccgggtaccctttacccgttaacgggttttacgggaaaccgggttaaccggtaacggtttacctttaaaccgttttaaccgtttaaccgtttaccggttacccgtttaaacggttttttaaccccgtttttaaaaacggtttaccggggtaccccttaccccgtttaaccgtttccgggttttaccgggtttttccggggtttttaccggggtaccgggtaacgggtacccggtaacccgggttaaacggttacccgggttaccccggtttccccggttacccgggttaacccggtaaccccgggttacccccgggtaaaccggggttccccgtttacccccggggtacccccccgtttacccggggttaccccttaaccccgtttccccggtttcccccccgggg

SEQ ID NO: 130253 - DNA, 606 bp, Homo sapiens
  misc_feature: GYAE6OF01C2FVB.22.36.D03.1.454.CMB.1.raw
  modified_base (386)..(386): a, c, t, g, unknown or other
  misc_feature (386)..(386): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgactattgggttcttttgactctgtctcctggtaccaacaacacccaggccaaacccccaactcatctatttatggtgtcactcgtcggccctcgaggagtctctctactcgcttctcaggctccaagtctgcaacacggccctccctaacnctctcgtcggctctagtttgaggacgagtcttacttatactgactacgtttacctttaaagttcggactaccctacttcgttccggtttcgggttttaccggcgggtaggtccgtaaccggtaacggttaccgtacccggttccgtaccgggtaccaccggtccccgaaacggcccttacccggccccccgttcgggtccctaccgttccgttacccccg

SEQ ID NO: 130254 - DNA, 633 bp, Homo sapiens
  misc_feature: GYAE6OF01C2VT5.22.36.D03.1.454.CMB.1.raw
  modified_base (218)..(218): a, c, t, g, unknown or other
  misc_feature (218)..(218): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggccccagtctgccctgacccagcctgcctccgtgtctggatcatctggacagtcgatcagctatttccngcacgtgggaccaactgtgactagttggttcttttgactctgtcctctggtaaccaacaaccaccacggacccaaacccccatcatctattatggtctcactcgtcgcctacgagtagtctctcatccgtctctcacgcctactaagtcctcggaccaaccgacccggtccctacccgtaacctctaccgttcgtcgggtaccttcccgtaaggtttcgacggtacgtacggttacttaactttattacgtacgtactacttttaacctttaagttacggtactacctacgttcgttcggtttcggtttccgggcggtacgaccgtaccggacggtcgacccgttccgtacggtacgtaccgaccccgaacggtccgtacccgtcccccgtagttccctacttcccgttaccccg

SEQ ID NO: 130255 - DNA, 616 bp, Homo sapiens
  misc_feature: GYAE6OF01EK6LM.22.36.D03.1.454.CMB.1.raw
  modified_base (217)..(217): a, c, t, g, unknown or other
  misc_feature (217)..(217): n is a, c, g, or t
  modified_base (238)..(238): a, c, t, g, unknown or other
  misc_feature (238)..(238): n is a, c, g, or t
  modified_base (302)..(302): a, c, t, g, unknown or other
  misc_feature (302)..(302): n is a, c, g, or t
  modified_base (319)..(319): a, c, t, g, unknown or other
  misc_feature (319)..(319): n is a, c, g, or t
  modified_base (334)..(334): a, c, t, g, unknown or other
  misc_feature (334)..(334): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacagtgacngttggtctttgactctgtctcctgtaccaacacaccacgaccaacccccatcatcattatggtntcactcgcgcctcgagntctctcatcgcttcncacgctcagtctgcacgccgcctacctaaccatcctcgtcggtccttccgtaggtttcgaggtaccgtagtttccttacgtttacttactcgtacgttaacgtttacctttaaagttcggtaccgtccctacgtttccgttcgggtttcggtttcgggacggtacgggtccctaaccggtacggtaccggtaccccggttccgttccgggtaccgacccggccccgtaaacgggcccttcccggtccccccgttacgggtccctaaccgttccttcccccgg

SEQ ID NO: 130256 - DNA, 682 bp, Homo sapiens
  misc_feature: GYAE6OF01CFD53.22.36.D03.1.454.CMB.1.raw
  modified_base (220)..(220): a, c, t, g, unknown or other
  misc_feature (220)..(220): n is a, c, g, or t
  modified_base (275)..(275): a, c, t, g, unknown or other
  misc_feature (275)..(275): n is a, c, g, or t
  modified_base (301)..(301): a, c, t, g, unknown or other
  misc_feature (301)..(301): n is a, c, g, or t
  modified_base (304)..(304): a, c, t, g, unknown or other
  misc_feature (304)..(304): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacgagggtcctgggcccagtctcgccctgacccagcctgcctccgtgtctggatcatctggacagtcgatcagctatttccngcacgtgggaaccaacagtgactagttggttctttgactctgtctctgacacacnccagaccaaccccatcatctattagngtntcactcgtccgcctgagtacgtctcgtcacgtcgtcttctacgtacgtcctaccgaagtcctacggaccaaccgtccggtacccttaccctaactactcctcgtacggtccttaccgtaggtttacggaacgtacggttacttccttaaactttacgttaacgtcgtaccgtttaacgttttaaccctttaaaggtcggtaccctacccgttaccgtttccgttacggtttcgggtttaccgggacgggtaacggtcccgtaaacgggtacggtaccggttaccccgttccggtacccggtacgtacccggtaaccccgtacgggtcccttacccggttccccccgtaggttaccctacccgttcccgtttaccccgg

SEQ ID NO: 130257 - DNA, 684 bp, Homo sapiens
  misc_feature: GYAE6OF01BK8EZ.22.36.D03.1.454.CMB.1.raw
  modified_base (219)..(219): a, c, t, g, unknown or other
  misc_feature (219)..(219): n is a, c, g, or t
  modified_base (339)..(339): a, c, t, g, unknown or other
  misc_feature (339)..(339): n is a, c, g, or t
  modified_base (637)..(637): a, c, t, g, unknown or other
  misc_feature (637)..(637): n is a, c, g, or t
tcagacatacgcgtcacgaccggtgctcgatttagctgcgtcacgatctctcgttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcacgtcgggaaccaacagtgactagttgggttcttttgacttcttcgtcctccgtacggtaccaacaaccacccgacggaccccaaaccccccctaatcacttactactttagtcggtntctaccgtcgtccggtccctacgaggtactctctactactccgtcttctcgacggtcctaccgaacggttcgtacggtaccaacccgtaccggtacccttaccctaaccgtcttaccgttcgttcgggccttccgtaaggtttcggaacggtaccgtacgttccttaacgtttacttacgtcgtaccttacgtttaacctttaaagtccggtactaccgtacgtttccgttcggtttcggtttcgggaccggtacggtcctaaccggtacgtccggtacccgttcccggtcggtaccnccgacccgacggtcccgtccgaccccgtcgcccttcctcccgtcccg

SEQ ID NO: 130258 - DNA, 580 bp, Homo sapiens
  misc_feature: GYAE6OF01CFGFF.22.36.D03.1.454.CMB.1.raw
  modified_base (217)..(217): a, c, t, g, unknown or other
  misc_feature (217)..(217): n is a, c, g, or t
tcagacatacgcgtcacgaccggtgctcgatttagctgcgtcacgatctctcgttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcatcagcatttccgngcacgtggaccaagagtgactgttggttcttgactcgtgtctcgtacgtaaccaacaaccaccacgacccaaacccctatcatctattagtcgtctacacgtcgtccgcctagacgtactctctactactctctctacgacgtctacgtagtcgtacgaccaacgaccgtccctacctaactcgtcgtcgtcggtctacgtagttacgacggtactacgttacttaacttatactacgtactacttaacttaagtcgacgtctacttcgtcgttcggttcggacgacgtaccgacgtacgtcgaccgtccgtacgtacgaccgaccgaacgccgtacccgtcccgtacgtcctcgtccgtccg

SEQ ID NO: 130259 - DNA, 674 bp, Homo sapiens
  misc_feature: GYAE6OF01D39UK.22.36.D03.1.454.CMB.1.raw
  modified_base (316)..(316): a, c, t, g, unknown or other
  misc_feature (316)..(316): n is a, c, g, or t
  modified_base (337)..(337): a, c, t, g, unknown or other
  misc_feature (337)..(337): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcacgtgggaccaacagtgactagttgggtctttgactctgtctcctgtaccaacaaccaccgacgacccaaaccccccaatcatctatttagtggtntctactcgtccgcctcgaggntctctcatcgtcttctcacggtcctaccgaacgtctacggaccaacgtccggtaccctaccctaacctactccgtcgtcgggtaccttcccgttaaggtttacggaacgggtaccgtacgtttaccgtttaacctttaagttaccgttagtacctttaacggttttaaccttttaaaacggtacggtcccgtacccgttaccgtttccgtttcgggttttcgggtttcgggacggtacggtacccgtaacggtacgtaccggtacccggttccgtacggttacgaccgtacccgaacggtcctcccgtaccccgttggtcctccgttccttccccgg

SEQ ID NO: 130260 - DNA, 548 bp, Homo sapiens
  misc_feature: GYAE6OF01BMU62.22.36.D03.1.454.CMB.1.raw
  modified_base (269)..(269): a, c, t, g, unknown or other
  misc_feature (269)..(269): n is a, c, g, or t
  modified_base (298)..(298): a, c, t, g, unknown or other
  misc_feature (298)..(298): n is a, c, g, or t
  modified_base (301)..(301): a, c, t, g, unknown or other
  misc_feature (301)..(301): n is a, c, g, or t
  modified_base (315)..(315): a, c, t, g, unknown or other
  misc_feature (315)..(315): n is a, c, g, or t
  modified_base (333)..(333): a, c, t, g, unknown or other
  misc_feature (333)..(333): n is a, c, g, or t
  modified_base (352)..(352): a, c, t, g, unknown or other
  misc_feature (352)..(352): n is a, c, g, or t
  modified_base (366)..(366): a, c, t, g, unknown or other
  misc_feature (366)..(366): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacagttggtctttgactctgtctctggtaccaanaacaccagccaaacccccatcatcattangtntcactcgtcgcctnagatctctcatcgcttcncagctacaagtctgcaacncgcctaccctaacntctctggctcagttgagacgagtctacttatactgctacgttacttaaagtcgctaccacttcgtcgttcggtttcggacggtacggtaccgaccgtaacgtacgacccgttccgtaccggtcgacgtaccccgaaggtccctaccggcccccgttacggtaccctccgttccgttccccgg

SEQ ID NO: 130261 - DNA, 775 bp, Homo sapiens
  misc_feature: GYAE6OF01C6B2U.22.36.D03.1.454.CMB.1.raw
  modified_base (221)..(221): a, c, t, g, unknown or other
  misc_feature (221)..(221): n is a, c, g, or t
tcagacatacgcgtcacgaccggtgctcgatttagctgcgtcacgatctctcgttggggggggtctcaggaggcagcgctctcgggacgtctccaccatggcctgggctctgctattcctcaccttcctcactcagggcacgagggtcctgggcccagtctcgccctgacccagcctgcctccgtgtctggatcatctggacagtcgatcagctatttccngcacgtgggaccaacagtgactagtttgggttcttttgacttctgtcctccgtggtaaccaacaaccacccgaggacccaaaccccccaactcaactctatttatggtgtcactcgtcggccctcgaggtctctctcactcgtcttctcgacggtcctacgtaacgtctacggaccaaaccgtacccggtccccttaaccctaaccctacttcccgttccggtcgggtacccttaccgttaaggttttacgggaaaccggttacggtacgtttacctttaacctttaagtttaccgtcggtaacctttaacggtttttacccgtttaaaagttccgggtacccgttaccccgttaacgtttccggtttaccgggttttcggggtttttacccgggacgggtaaccgggtaacccgtaacccgggtaacggtcccggtaacccggttccccggttaccgggttacccgtaacccgggtaccccggtaacgggtcccccgttcccgggtacccccccggtttggtacccctacccgtttcccggttaccccccggg

SEQ ID NO: 130262 - DNA, 666 bp, Homo sapiens
  misc_feature: GYAE6OF01CI65S.22.36.D03.1.454.CMB.1.raw
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgactagttgggtcttttgactctgtctcctacggtaccaacaaccacccacggaccccaaaaccccccaactccactctatttactgtcgtcactccgtccgccctcgagtacgtctctcactcgtcttctcaggcctacctaacgtcgtcggaccaaccgtaccggacccttaccccgtaacctacttcccgtcgtcgggtccttacccgttaggtttacggaacggtacgtaacgttacctttaactttactttactcgttacttacgttttaacctttaaagttccggacctacccgtacttccgttcgggtttcggtttcgggcggacggtccgtaaccggtaacgtcggtacccgttccgtacggtaccgaccgacccgaaggtcccgtaccggtccccctcggtaccctccgttccgttcccccgg

SEQ ID NO: 130263 - DNA, 756 bp, Homo sapiens
  misc_feature: GYAE6OF01DJ24I.22.36.D03.1.454.CMB.1.raw
  modified_base (218)..(218): a, c, t, g, unknown or other
  misc_feature (218)..(218): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcactgggaccaacgagtgactagttgggttctttttgacttctgttcctccgttcggtaaccaacaaccacccacggaccccaaaacccccccaactacctaatcctaatttacgtcggtactctaccgttccgtccggcccctcgaacggtcgtctctacattccgtacttctccaggtcctaccgtaacgtcgtacggaccaaaccgtccggaccccttaccctaaacctacttccttaccggttcgggtaccttacccgttaggtttacgggaacgggtaccgttaacgttccttaaccgttttaactttaccgttacggttacttaaccggttttaaccttttaaacgttaccggtacccgtaacccgttaaccgtttccgtttacgggtttccggggtttttaccgggacgggtaacgggtacccgtaaccggtaaccggttcggtaaccccgttccgtccggtacgtaccgacccggtaacgtacccggtcccgtaccccggttccggtacctcccgttcgttacccccgg

SEQ ID NO: 130264 - DNA, 681 bp, Homo sapiens
  misc_feature: GYAE6OF01CMCGU.22.36.D03.1.454.CMB.1.raw
  modified_base (642)..(642): a, c, t, g, unknown or other
  misc_feature (642)..(642): n is a, c, g, or t
tcagacatacgcgtcacgaccggtgctcgatttagctgcgtcacgatctctcttgggggggggtctcaggaggcagcgctctcgggacgtctccaccatggcctgggctctgctattcctcaccttcctcactcagggcacgagggtcctgggcccagtctcgccctcgacccagcctgcctccgtgtctggatcatctggacagtcgatcagctactttcctgccacgtcggggaaccaacgtaggtagactagtttgggttctttttcgacttcgtcgttacctccgttacggtaaccaaaccaaccacccgaacggaccccaaaacccccccataccattcctaatttagtggttcgtcctacgttccggtcccggcccgttacgacggtacgtccttcctcgtacttcgtaccttccgtacggacgtacctacgtaacgtccgtaacgaaccgtaaccggtcccgtaccccttaaccctaaccgtcttccgtacggtcggtacctacgttggttacggacggtacgtacgtactttaacttacgtcgtacgtacttacgttttaaccttaagtcgtacctactacgtcgttcggttacggttaggccggagctacgtagtccgtaccgtcggtcgacncgaccgacggctcccgacccttggcctctcccgttcccg

SEQ ID NO: 130265 - DNA, 691 bp, Homo sapiens
  misc_feature: GYAE6OF01ADLN3.22.36.D03.1.454.CMB.1.raw
  modified_base (218)..(218): a, c, t, g, unknown or other
  misc_feature (218)..(218): n is a, c, g, or t
  modified_base (308)..(308): a, c, t, g, unknown or other
  misc_feature (308)..(308): n is a, c, g, or t
tcagacatacgcgtcacgaccggtgctcgatttagctgcgtcacgatctctcgttggggggggtctcaggaggcagcgctctcgggacgtctccaccatggcctgggctctgctattcctcaccttcctcactcagggcacagggtcctgggcccagtctgccctgacccagcctgactccgtgtctggatcatctggacagtcgatcagcatttccngcactgggaaccaacagtgacagttgggtcttttgactctgtctcctgtaccaacacaccagaccaaacccccaatcatctattatggtntcactcgtccggccctgaggatctctcatcgcttctcagcctacaagtctcggaccaacgaccggccctaccctaaccactccgtcgtacgggccttacccgtaaggtttcggaacgggtaacgtaacggttaccttaactttacttaacgttcgaccttaacgttttaaccttttaaaagttacgggtacccgtacctaaccgtttcgtcggttttacgggttttccgggaccgggtaacggtacccgtaaccggtaaacggttccggtaacccggttcccgttaccgggttaccgaaccgggtacccccgtaaacgggtcccgttaccccgggtacccccccgttaccgggttaccctaacccggttcccgtttcccccgg

SEQ ID NO: 130266 - DNA, 526 bp, Homo sapiens
  misc_feature: GYAE6OF01BMWFP.22.36.D03.1.454.CMB.1.raw
  modified_base (328)..(328): a, c, t, g, unknown or other
  misc_feature (328)..(328): n is a, c, g, or t
  modified_base (343)..(343): a, c, t, g, unknown or other
  misc_feature (343)..(343): n is a, c, g, or t
  modified_base (356)..(356): a, c, t, g, unknown or other
  misc_feature (356)..(356): n is a, c, g, or t
  modified_base (362)..(362): a, c, t, g, unknown or other
  misc_feature (362)..(362): n is a, c, g, or t
  modified_base (373)..(373): a, c, t, g, unknown or other
  misc_feature (373)..(373): n is a, c, g, or t
  modified_base (407)..(407): a, c, t, g, unknown or other
  misc_feature (407)..(407): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggccaaaccccccatcactcatttatggtgtcactcgtcggccctcaggntctctcatcgcttcncaggctcaagtcnggcacncgcctcctacntctctggctcagttgagtcgatctacttattctntctagttcctttaagtcggctccacgttctcggttggtttcggcggtagcctaccgacgtcgtacccgtccgtcggtcacgcccgaaggcctcgcccccttggtccctacgtcgtcccg

SEQ ID NO: 130267 - DNA, 647 bp, Homo sapiens
  misc_feature: GYAE6OF01CFNUV.22.36.D03.1.454.CMB.1.raw
  modified_base (171)..(171): a, c, t, g, unknown or other
  misc_feature (171)..(171): n is a, c, g, or t
  modified_base (219)..(219): a, c, t, g, unknown or other
  misc_feature (219)..(219): n is a, c, g, or t
  modified_base (312)..(312): a, c, t, g, unknown or other
  misc_feature (312)..(312): n is a, c, g, or t
  modified_base (348)..(348): a, c, t, g, unknown or other
  misc_feature (348)..(348): n is a, c, g, or t
tcagacatacgcgtcacgaccggtgctcgatttagctgcgtcacgatctctcgttggggggggtctcaggaggcagcgctctcgggacgtctccaccatggcctgggctctgctattcctcaccttcctcactcagggcacagggtcctgggcccagtctgccctgacccngcctgcctccgtgtctggatcatctggacagtcgatcagctatttccngcacgtcgggaccaacgagtgactagttggttcttttgactctgtctcgtagtaccaacaacaccgacgaccaaacccccatcatctattagngtgtcacgtcgcgcctgagtgtctctcatcgcttcncagctacgtagtctgacaacgcgtaccctacctaacactccgtcgtacggtctacgtagttacggaacggtacgtagtacttaacttacttacgtacgtacttaacgttttacttaaacgtcgacccgtctaccgttcgtttacggtttcgggtttaccgggacggtacggtaccgtaaccgggtacgttaccggtaccccgttccggttaccgtaccgtacccggtaccccgtaaacgggttccccgttacccggtaccccccggttggttaaccctcccgttccccggttacccccg

SEQ ID NO: 130268 - DNA, 238 bp, Homo sapiens
  misc_feature: GYAE6OF01CB4HS.22.36.D03.1.454.CMB.1.raw
  modified_base (235)..(238): a, c, t, g, unknown or other
  misc_feature (235)..(238): n is a, c, g, or t
tcagacatacgcgtcacgaccggtgctcgatttagctgcgtcacgatctctctgggctccagtttgaggacgagtctacttattactgcagttcctttaaattaggcgccactctcgtggttttcggcggaggcaccgaagtgaccgtcctcggtcagcccaaggctgccccctcggtcactctgttcccaccctcctcacgcgtatgtctgagcgggctggcaaggcgcatagnnnn

SEQ ID NO: 130269 - DNA, 675 bp, Homo sapiens
  misc_feature: GYAE6OF01CHAUE.22.36.D03.1.454.CMB.1.raw
  modified_base (221)..(221): a, c, t, g, unknown or other
  misc_feature (221)..(221): n is a, c, g, or t
tcagacatacgcgtcacgaccggtgctcgatttagctgcgtcacgatctctcgttgggggggtctcaggaggcagcgctcgtcgggacgtctccaccatggcctgggctctgctattcctcaccttcctcactcagggcacgagggtcctgggcccagtctcgccctgacccagcctgcctccgtgtctggatcatctggacagtcgatcagctatttccngcacgtggaacaacagtgactagttggtcttttgacttctgtctctcggtaccaacacaccacgaccaaacccccatcatcattactggtctcactcgtacggtccctgagtcgtctcgtacacgtcgtcttctccgaggtcctcctaaacgtcgtacggaccaaccgaccggtccctaccctaacctattcctcgtcgggtacctcgtaggtttagacggtaactagttactacgtttaactcgtacgtacttacgtttaacgtttaactacggcctaccttaccgtacgttcgggtttcgggtttaccggacgggtaccgtaccgtaaccgggtaaagttccggtaccccgttccggttacggtacccgtaaccgggaccccggtaaacgggtcccgttccccggtaccccccgttacggggttacctaacccgtttccgtttaccccccgg

SEQ ID NO: 130270 - DNA, 676 bp, Homo sapiens
  misc_feature: GYAE6OF01DNFS5.22.36.D03.1.454.CMB.1.raw
  modified_base (221)..(221): a, c, t, g, unknown or other
  misc_feature (221)..(221): n is a, c, g, or t
  modified_base (239)..(239): a, c, t, g, unknown or other
  misc_feature (239)..(239): n is a, c, g, or t
  modified_base (261)..(261): a, c, t, g, unknown or other
  misc_feature (261)..(261): n is a, c, g, or t
  modified_base (282)..(282): a, c, t, g, unknown or other
  misc_feature (282)..(282): n is a, c, g, or t
tcagacatacgcgtcacgaccggtgctcgatttagctgcgtcacgatctctcgttggggggggtctcaggaggcagcgctctcgggacgtctccaccatggcctgggctctgctattcctcaccttcctcactcagggcacgagggtcctgggcccagtctcgccctgacccagcctgcctccgtgtctggatcatctggacagtcgatcagctatttccngctacgtgggaaccaacngtgactgttggttctttgactntgtctcctcgtaccaacaacnccacgaccaaaccccccatcatctattatggtctcactcgccggtccctagagtacgtctctactactcgtaccttctccgacggtaccttacccgtaagtcgtacgggacaaaccgaccggtacccctaccctaactactccgtcgtcggtcctaccgtaggttcgacgtacgtacgtcttaacgttaacgtactcgtactaacgtttactttaaagtcggtcctacccttacttcgttaccgggtttgggttttaccggccggtaacggtcccgtaaaccgggtaacgttcccgggttaacccgttcccgttacgggtcccgaacggttccccggaacgttcccgtcccgtacccccggttacgggcccttaacccttcccgtttcccccgg

SEQ ID NO: 130271 - DNA, 692 bp, Homo sapiens
  misc_feature: GYAE6OF01CBRJN.22.36.D03.1.454.CMB.1.raw
  modified_base (217)..(217): a, c, t, g, unknown or other
  misc_feature (217)..(217): n is a, c, g, or t
  modified_base (233)..(233): a, c, t, g, unknown or other
  misc_feature (233)..(233): n is a, c, g, or t
  modified_base (301)..(301): a, c, t, g, unknown or other
  misc_feature (301)..(301): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcacgtgggaccaacngtgactagttggtctttgactctgtctcctgtaccaacacaccacgccaacccccactcatcatttangtgtcactcgtcgccctcgagacgtctctcatcgcttctcacggcctaccgtaagtccgttaggaccaaaccgtacccgggtccccttaccccgttaaaccctacgttcccgttaccggttcgggtcccttaccctagggttttcggaacgggtaacggtacgttcctttaaccgtttatttaccgtcgtaccttacgtttaacccttttaaagttacggtaccgtaccctaccgttccgtttaccggtttcgggttttccgggtaccgggtacgggtccgtaaccggtaacgttccggtaccccggtccgtaccgggtaccgaccggtaccccgaaagggtccctacccggtccccccgttaccgggtccttacccgtccgttcccccgg

SEQ ID NO: 130272 - DNA, 724 bp, Homo sapiens
  misc_feature: GYAE6OF01A5BVY.22.36.D03.1.454.CMB.1.raw
  modified_base (217)..(217): a, c, t, g, unknown or other
  misc_feature (217)..(217): n is a, c, g, or t
tcagacatacgcgtcacgaccggtgctcgatttagctgcgtcacgatcgtctcttgggggggtctcaggaggcagcgctctcgggacgtctccaccatggcctgggctctgctattcctcaccttcctcactcagggcacagggtcctgggcccagtctgccctgacccagcctgcctcgtgtctggatcatctggacagtcgatcagctatttccngcacgtgggaccaacgagtgactagttcgggtctttgactctcgtctccgtgtaccaacaaccacccagaccaaacccccatccatcattagtcggtcgtcactccgtcggccctgacggtatctctcacgtcgtcttcgtcgacggtcctacctaacgtctcggaccaaccgaccggtccctaccctaacctacgttccgtaccgtcgggtaccttacccgtaggtttacggaacgggtaccgtacgttaccttaacgtttacttaccgtagtacttacggttttaacctttaaagttaccggtacccgtacccgttaccgtttaccgtttaccgggtttacgggttttcccgggaccgggtaaccggtacccgtaaccggtaacggttaccggtaaccccggttcccggttaccggttacccgaccggtaccccggtaaacgggtccccgttacccggtaccccccgttcgggttaccctaccccgtttccggttaccccccggg

SEQ ID NO: 130273 - DNA, 648 bp, Homo sapiens
  misc_feature: GYAE6OF01DFWZ7.22.36.D03.1.454.CMB.1.raw
  modified_base (218)..(218): a, c, t, g, unknown or other
  misc_feature (218)..(218): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcactgggaccaacagtgacagttggtctttgactctgtctcctggtaccaacacaccagaccaaaccccccactcatctattatggcgtcacgtcgtcgccctcaggtacgtctctcatcgcttctcgacggtcctccgtaagtccgtaggaccaacgaccggtacccttaccctaaccacttctaccgtcgggaccttccgtaggtttacgacgggtacgtacgttacttaactttattacttgtaccttagtttacctttaaagttccgaccgttccctaacgttccgttacggtttcgggttttccgggacggtacggtacctaaccgggtacgttacgtacccggttccgtaccgggttaccacggtaccccgtaaggtcccgtacccggtcccccgtaggttccctaccgttccgttacccccg

SEQ ID NO: 130274 - DNA, 573 bp, Homo sapiens
  misc_feature: GYAE6OF01BWQFI.22.36.D03.1.454.CMB.1.raw
  modified_base (298)..(298): a, c, t, g, unknown or other
  misc_feature (298)..(298): n is a, c, g, or t
  modified_base (303)..(303): a, c, t, g, unknown or other
  misc_feature (303)..(303): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcactgggaccaacagtgacattgggtcttttgactctgtctcctgtaccacaacaccagccaacccccactcatcattntggtntcactcgtcgccctcaggatctctcatcgcttctcaggctccaagtctggccaacgaccggcctaccctaaccactcctctacggctcctagttggaggacgtagtcttaacttattactgtactagtttcctttaaagttacgtaccgtcctacgttccttcgtttgggtttcggcggtacggcgaccgtacggtcgtaccgtccgtaccggtcgtacgccccgtaagggcctccggcccccgttccggtcctaccgtccgttaccccg

SEQ ID NO: 130275 - DNA, 657 bp, Homo sapiens
  misc_feature: GYAE6OF01AOCTO.22.36.D03.1.454.CMB.1.raw
  modified_base (219)..(219): a, c, t, g, unknown or other
  misc_feature (219)..(219): n is a, c, g, or t
  modified_base (302)..(302): a, c, t, g, unknown or other
  misc_feature (302)..(302): n is a, c, g, or t
  modified_base (320)..(320): a, c, t, g, unknown or other
  misc_feature (320)..(320): n is a, c, g, or t
  modified_base (395)..(395): a, c, t, g, unknown or other
  misc_feature (395)..(395): n is a, c, g, or t
tcagacatacgcgtcacgaccggtgctcgatttagctgcgtcacgatctctcgttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcacgtgggaccaacgagtgactagttggtctttgactctgtctctgtaccaacacaccagccaaacccccatcatcatttangtgtcactcgtcgccctnaggacgtctctcactcgtcttcgtcaggcctaccgaagtcgtcggaccaaccgaccggtcccttacccgtaaccncttccgtacgtcgggtccttaccgtaggtttacggacggtacgtacgttacttaacttacgttacgtcgtacttacgttttaaccgtttaaagttcggaccgtacctacgttccgttcggtttacgggttttccggacggtaccggtaccgaaccggttacggttccgtaacccggttcccgttacgggtaccgaccgtacccggtaacgttcccgtacccgggtaccccccttagggtcccttccgttcccgttacccccg

SEQ ID NO: 130276 - DNA, 718 bp, Homo sapiens
  misc_feature: GYAE6OF01DUWH6.22.36.D03.1.454.CMB.1.raw
tcagacatacgcgtcacgaccggtgctcgatttagctgcgtcacgatctctcgttgggggggtctcaggaggcagcgctcgtcgggacgtctccaccatggcctgggctctgctattcctcaccttcctcactcgagggcacgacgggtcctcgggcccagtctcgccctgacccagcctcgcctccgtgtctggatcatcgtggactaggtcgatcgagtctactttcctgactacgtacggaaccaacgtagtacgactagtttcgggttctttacggtactcgtcgtcctccgtacgtaaccaacaaccacccgacgaaccccaaaccccctatcactactattacgtcgtacgtacctacgtccgtccggtcctacggaacggtctctccgtacacgttcgtccttacgtacgacggtacctaccgtaacggtcgtacggaacctaaacccggtcccgtacccctaaccctaaccgcgttaccgtcgttacggaccttacggttaggttacgggaagtacgttacgtactttaacttacgttactcggtacctttacgttaacgtttaagccggtacctaccgtcgttacggttcgggtttccgggttcggacggacgtccgtaaccggtacgtacgtacccgttcgtacggtcacccggtaccgacgttcccgtacccgttccccgtaggtccttacccgtccggttaccccc

SEQ ID NO: 130277 - DNA, 675 bp, Homo sapiens
  misc_feature: GYAE6OF01CO776.22.36.D03.1.454.CMB.1.raw
  modified_base (218)..(218): a, c, t, g, unknown or other
  misc_feature (218)..(218): n is a, c, g, or t
  modified_base (232)..(232): a, c, t, g, unknown or other
  misc_feature (232)..(232): n is a, c, g, or t
  modified_base (306)..(306): a, c, t, g, unknown or other
  misc_feature (306)..(306): n is a, c, g, or t
tcagacatacgcgtcacgaccggtgctcgatttagctgcgtcacgatctctcgttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaanagtgactagttggtcttttgactctgtctctggtaccaacaacacccaggaccaaaccccccatcatcatttanggtgtcactcgtccggcctcgaggacgtctctcatcgcttctcaggtcctcgaagtcgtggacaacgaccggccctaccctaaccactcctcgtgggccttaccgtagtttagacggtacgacgttacttaactttattaccttgtacgtttaacgttttaacccgttttaaagttaccggtaccgtaccctaaccgtttccgttccgggtttcgggtttttaccgggccgggtaaacggtcccgtaaccggaaacggttccggtaaccccggtttccccgttacgggttcccaaaccggtcccccgtaaagggtcccttccccgggtaccccccgttcgggtaccctcccgttcccgtttacccccgg

SEQ ID NO: 130278 - DNA, 569 bp, Homo sapiens
  misc_feature: GYAE6OF01C42IA.22.36.D03.1.454.CMB.1.raw
  modified_base (217)..(217): a, c, t, g, unknown or other
  misc_feature (217)..(217): n is a, c, g, or t
  modified_base (531)..(531): a, c, t, g, unknown or other
  misc_feature (531)..(531): n is a, c, g, or t
  modified_base (559)..(559): a, c, t, g, unknown or other
  misc_feature (559)..(559): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaaacagtgactagttgggtcttttgactctgtctcctggtaccaacaacaccaggccaaaccccccaactccatctatttatggtgtcactcgtcggccctcaggagtctctcatcgcttctcaggctccaagtctggcaacacggcctaccctaaccatcctcgtcgggccttcccgtagttttgaacggacgtagtccttaactttacttacttcgtactacgtttaccttttaaagttacgccgtaccacttcttcgttggttttcggcggaggtccacgaagtgaccgtccgtcggtcncgcccgtaagcctcgccccctggtcccnttccgtccgg

SEQ ID NO: 130279 - DNA, 650 bp, Homo sapiens
  misc_feature: GYAE6OF01B4LW2.22.36.D03.1.454.CMB.1.raw
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgactagttgggtcttttgactctgtctctgtaccaacaacacccagaccaaaccccccaactcatctattatgtcgtcactcgtcgcctcgagacgtctctcatcgtcttctcgacgtctaccaagtcgtacggacaaccgtaccggccctaccctaaccactcctccgtcgggcccttaccgtagtttacggaacggtacgtacgttaccttactttacttactggtaccttacgttttacctttaaagttcggaccgtacctaccgttaccgttcggtttcgggttttccggacgggtacggtccgtaccggtaacgtaccggtacccggttccgttccgggtaccgaccggtaccccggaacggtcccgtcccggtccccccgttacggttccctaccgttccgttacccccg

SEQ ID NO: 130280 - DNA, 645 bp, Homo sapiens
  misc_feature: GYAE6OF01AMSZX.22.36.D03.1.454.CMB.1.raw
tcagacatacgcgtcacgaccggtgctcgatttagctgcgtcacgatctctcttggggggggtctcaggaggcagcgctctcgggacgtctccaccatggcctgggctcagctattcctcaccttcctcactcagggcacagggtcctgggcccagtctgccctgacccagcctgcctccgtgtctggatcatctggacagtcgatcagcatttcctgcactgggaccaacagtgacattgggttctttgactctgtctcctggtaccaacaacaccacgaccaaacccccactcatcattatggtcgtcactcgtcgccctcgaggactctctcatcgtcttctcaggtcctaccgaacgtctacgggaccaaaccgaccgggtccccttaccctaacctacttccgtcgttacgggcccttacccgtaggtttacggaacggtacggtacgttacttaactttagttaccgtgtccgtttaacgtttaccgtttaaagttcggaccgtaccctacgttccgttacggtttcgggtttcggaccgggtagtccgaccggtaagtccggtaccgtccgttacgggtcaccggacccgtaacggtcccgtcccggacccccggtcgtcctccgtccgtttaccccg

SEQ ID NO: 130281 - DNA, 635 bp, Homo sapiens
  misc_feature: GYAE6OF01BL3GX.22.36.D03.1.454.CMB.1.raw
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcacgtgggaccaacagtgactagttggtctttgactctgtctcctgtaccaacaacaccacgaccaaaccccccatcatctatttatggtcgtcactcgtccggccctacgaggtagtcctctcactcgtcttctcacggtcctacctaagtcctggaccaacgaccggccctaccctaacctacttccgtccgtacgggtccttccgtaaggtttcgaaggtaccgtacgttccttaactttacttacctgtcttacgtttacctttaaacgtcggacctacctaccgttccgttcggtttggtttccggcgggtacggtccgaccggtacgtcggacccgttcccgtcggtacgccggacccgaagggtccctcccggtacccccgtccgggttacctaccgttccgttacccccg

SEQ ID NO: 130282 - DNA, 797 bp, Homo sapiens
  misc_feature: GYAE6OF01CWBLI.22.36.D03.1.454.CMB.1.raw
  modified_base (221)..(221): a, c, t, g, unknown or other
  misc_feature (221)..(221): n is a, c, g, or t
tcagacatacgcgtcacgaccggtgctcgatttagctgcgtcacgatctctcgttggggggggtctcaggaggcagcgctctcgggacgtctccaccatggcctgggctctgctattcctcaccttcctcactcgagggcacgagggtcctgggcccagtctgccctgacccagcctgcctccgtgtctggatcatctggacagtcgatcagctatttccngcacgtacgggaccaacagtgactagttcgggttcttttgacttcgtgtcctcgtacggtaaccaacaaccacccaacggacccaaaccccccatcaatactatttatggtagtccacgtccggttaccggaccttagacggtactcttaccactagtccgtctttccacgtacggtcctaccgaagttcgtacgggaacctaaccgtcccggtaccccttaacccgtaaacctacgttcccgttccgtaccggggttaccttacccggttaacgggtttaacgggaaccgggttaacgttaaccgtttaacgtttaaaccgtttaaccgttttaaccgttacgtaacccgttttaacgtttttaacccgttttaaaaaggttcccggggtaccctaccccttaaccggtttccgtttacggggtttacgggtttaccgggtaccggaacgggtacccgtaaccggtaaacggtcgtaccccggttcgtaccgggtaaccgccgttacccgggaacgtccccggttaccccggtcccccgttaagttccccgtaccgtttcccgtttacccccggg

SEQ ID NO: 130283 - DNA, 611 bp, Homo sapiens
  misc_feature: GYAE6OF01EOAH7.22.36.D03.1.454.CMB.1.raw
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgactattgggtcttttgactctgtctcctggtaccaacaacacccaggccaaacccccatcatctattatggtgtcactcgtcgccctcaggagtctctcatcgcttctcgaggtcctacctaagtctcggacaaaccgccggtaccctacccctaaccacttcctcgtcgggtccttccctaggtttcggacggtacgtagtcttaacttattactgtcttaacgtttacctttaaaagtcggcctaccctacgttccgttcggtttcggttttacgggcggtacggtccaaccggtaacggtcgtacccggtccgtacggtcgaccgcccgaacggtcccttccggcccccttggtcctaccgttccgttcccgg

SEQ ID NO: 130284 - DNA, 752 bp, Homo sapiens
  misc_feature: GYAE6OF01B2ZD3.22.36.D03.1.454.CMB.1.raw
  modified_base (222)..(222): a, c, t, g, unknown or other
  misc_feature (222)..(222): n is a, c, g, or t
  modified_base (238)..(238): a, c, t, g, unknown or other
  misc_feature (238)..(238): n is a, c, g, or t
  modified_base (326)..(326): a, c, t, g, unknown or other
  misc_feature (326)..(326): n is a, c, g, or t
  modified_base (374)..(374): a, c, t, g, unknown or other
  misc_feature (374)..(374): n is a, c, g, or t
tcagacatacgcgtcacgaccggtgctcgatttagctgcgtcacgagtctctcgttggggggggtctcaggaggcagcgctctcgggacgtctccaccatggcctgggctctgctattcctcaccttcctcactcagggcacgagggtcctgggcccagtctgccctgacccagcctgcctccgtgtctggatcatctggacagtcgatcagctactttccngcacgtcgggaccaangtgactagttggtctttgacttctgtctccgtaggtaaccaacaaccaccgacggaccccaaaccccccatcactctatttagtggtntacacgtcgtccgccctacgacggtacgttcctctcacgtcgtcttcncgacgtcctacgtagtcgtacggaccaaccgtaccggtcccttaacccgtaacctacttcccgtacgttcgggacccttaccgtaaggtttcggaaccgggtacgtacgtttacttaacgtttacttacgtcgtaccgtttaagtttaaccctttaaaggtccggaccctacctaccgtttccggttttcgggtttacgggttttaccgggacgggtaccggtacccgtaaaccgggttacggtacccggttaccccgggttaccggttccggggttaaacccgacccgggttacccggtaaaccgggttccccgttaccccgggtaccccccgggttaacgggttacccccttaccgttcccggtttaccccccggg

SEQ ID NO: 130285 - DNA, 710 bp, Homo sapiens
  misc_feature: GYAE6OF01BTDLA.22.36.D03.1.454.CMB.1.raw
  modified_base (233)..(233): a, c, t, g, unknown or other
  misc_feature (233)..(233): n is a, c, g, or t
  modified_base (353)..(353): a, c, t, g, unknown or other
  misc_feature (353)..(353): n is a, c, g, or t
tcagacatacgcgtcacgaccggtgctcgatttagctgcgtcacgatctctcttgggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacngtgactagttgggtctttgactctgtctcctggtaccaacaacaccacggacccaaaccccccatccatctatttatggtctcactccgtcgccctcgaggactctctcactcgtcttcncacggtcctaccgaagtccgtacggaccaaccgtaccggtaccccttaccctaacctacgttcccttccgttacggggtcccttacccggtacggttttacggaacgggtaaccgtaacgtttcctttaaaccgtttaactttaccgtacgtaccgtttaacgttttaaccgttttaaacgttccgggtacccgtaccccgttacgttcccggtttacggtttcggggttttccgggaccgggtacggaccgtaaccggtaacggtcggtaccccggttccgttcgggtacccgacggaccccgtaacggtcccgtcccggtacccccgttacggtcctcccgttccgttcccccgg

SEQ ID NO: 130286 - DNA, 650 bp, Homo sapiens
  misc_feature: GYAE6OF01EXOYO.22.36.D03.1.454.CMB.1.raw
  modified_base (438)..(438): a, c, t, g, unknown or other
  misc_feature (438)..(438): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtctttgactctgtctcctggtaccaacaacacccaggaaccccaaacccccaactcactacttattagtggtctctacgtcggtccgcctacgagtctctctactactcgtcttctcgacgtctacgtacgtcgtcgacaaccgaccgtccctaccctaacctactctcgtcgtctcgtagagttacgaggtacntacgttacttacttacgtacctacgttaccttaagttaccgttaacgttaccgtaccgttcccgttaccgttacggtttaccgggtcgggtttacgggtaccggtaaccgggacgtaccggtaacccggttaccggttacccgggttcccgtaccgggtacccgtaacgggtaccccgtaacccggtcccccgttccggtcccccgtcccgg

SEQ ID NO: 130287 - DNA, 835 bp, Homo sapiens
  misc_feature: GYAE6OF01CQAZ1.22.36.D03.1.454.CMB.1.raw
  modified_base (233)..(233): a, c, t, g, unknown or other
  misc_feature (233)..(233): n is a, c, g, or t
tcagacatacgcgtcacgaccggtgctcgatttagctgcgtcacgatctctcttggggggggtctcaggaggctagcgctctcgggacgtctccaccatggcctgggctctgctattcctccaccttccgtcactcagggcacagggtcctgggcccagtctgccctgacccagcctgcctccgtgtctggatcatctggacagtcgatcagcattcctagcacgtggaccanagtgactagttggttcttttagacttcgtagttacctcctaggtaacccaaacaacccgtacccgacgggaaccccaaaaccccccccgtaactcctaatcctaagttttactacggttccgttaccaaccttcccggtccggtacccccttgtaacgggtaccgttcctaaccttcctaaacgttccgtaccgtttcctaccgtacggtaccctacccgtaaacgtcccgttacgggaacccttaaaaccggtaccggtacccccttacccccgtaaacccttaaccgttccgtttacccggttccgggttacccttacccgttacggtttacggtaacgggtaacggttacgttacctttacgtttaacgttaccgtcgttaccgtacgtttaaccgtttaagttaccggtacgtacccgtaacgttccgttacggtttccggttttccgggtaccggtaccggtacccgtaacccggtaaccggttaccggtaaccccggtacccggttccggttacccggtccgtacccccggtaacggtccccgttaccccggtacccccgttcccggtacccgtacccgttcccgtttacccccgg

SEQ ID NO: 130288 - DNA, 701 bp, Homo sapiens
  misc_feature: GYAE6OF01A9HA8.22.36.D03.1.454.CMB.1.raw
  modified_base (216)..(216): a, c, t, g, unknown or other
  misc_feature (216)..(216): n is a, c, g, or t
  modified_base (333)..(333): a, c, t, g, unknown or other
  misc_feature (333)..(333): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcattccngcactgggaccacagtgactattggtctttgactctgtctcctggtaccaacaacacccaggacccaaaccccccaactcatctattatggtatcactccgtccgtccctcagggtntctctcactcgtcttcgtacgacggtcctaccaaggttccgtcgggaccaaaccgtaccgggtaccccttaccccgttaaacccgtacttcccgttacgttcgggtccccttccggttaacgtttcgggaacgggtaccgtacgtttaccttaacgtttacttaaccgttcgtcgttaacgtttaccttttaaacgttacgggtccctaccgtacctttccggttaccggtttacgggttttccgggacggtacgggtacccgtaaccggtacgtaccggtaacccggttccgtccggtaccgaccggtcccgaacggtcccgtacccggtcccccgtaccggttccctaaccgttccgttaccccgg

SEQ ID NO: 130289 - DNA, 658 bp, Homo sapiens
  misc_feature: GYAE6OF01DCRXW.22.36.D03.1.454.CMB.1.raw
  modified_base (218)..(218): a, c, t, g, unknown or other
  misc_feature (218)..(218): n is a, c, g, or t
  modified_base (232)..(232): a, c, t, g, unknown or other
  misc_feature (232)..(232): n is a, c, g, or t
  modified_base (254)..(254): a, c, t, g, unknown or other
  misc_feature (254)..(254): n is a, c, g, or t
tcagacatacgcgtcacgaccggtgctcgatttagctgcgtcacgatcgtctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcccngcactgggaccaangtgacattggtcttttgacttntgtctcctgtaccaacaacacccaggaccaacccccatccatcattatgtgtcactcgtcgcctcaggacgtctctgactcgcttctcaggtcctccaagtcgtaggccaacgacggcctaccctaacctacgtcctaccgtgggccttaccgtagtttacgaacggtacgtacgtcctaacttacgttactaggtcctaagttttaccccgttaaaatttacggtaccgtaccctaaccgttccgttaccggtttagggtttttaccgggacggttacgggtaccctaaccgggtaacgttaccggtacccggtcccgttaccggggtaccacgggtaccccgtaaagggtcccttacccggtaccccccggttcggtacccgtaccgttccggttaccccgg

SEQ ID NO: 130290 - DNA, 635 bp, Homo sapiens
  misc_feature: GYAE6OF01CCQ4T.22.36.D03.1.454.CMB.1.raw
  modified_base (221)..(221): a, c, t, g, unknown or other
  misc_feature (221)..(221): n is a, c, g, or t
  modified_base (238)..(238): a, c, t, g, unknown or other
  misc_feature (238)..(238): n is a, c, g, or t
  modified_base (241)..(241): a, c, t, g, unknown or other
  misc_feature (241)..(241): n is a, c, g, or t
  modified_base (309)..(309): a, c, t, g, unknown or other
  misc_feature (309)..(309): n is a, c, g, or t
  modified_base (583)..(583): a, c, t, g, unknown or other
  misc_feature (583)..(583): n is a, c, g, or t
tcagacatacgcgtcacgaccggtgctcgatttagctgcgtcacgatctctcgttggggggggtctcaggaggcagcgctctcgggacgtctccaccatggcctgggctctgctattcctcaccttcctcactcgagggcacagggtcctgggcccagtctgccctgacccagcctgcctccgtgtctggatcatcgtggacagtcgatcagctatttccngcactcgggaaccaagngtnactagttggtctttgactctgtctctcggtaccaacacaccacgaccaaaccccatcactctattagngtctcactcgcgtcctgaggtactctctctatccgtcttctacgacgtcctacctaaggtcgtacggacaaccgtaccggtccctacccgtaacctactctaccgtcgggccttacggtagtttaggaacggtacgtacgttaccttaactttagtactcgttacgttacgttttaacgtttaagtacgtaccgtaccgtatttccggtcggtttacgggtttcgggacggacggtccgaaccggtacgtccgggtacccgtccgttggtaccncggtacccgacggtcccttaccggcccccgttcgtactccttccgttccccg

SEQ ID NO: 130291 - DNA, 594 bp, Homo sapiens
  misc_feature: GYAE6OF01BQQUY.22.36.D03.1.454.CMB.1.raw
  modified_base (307)..(307): a, c, t, g, unknown or other
  misc_feature (307)..(307): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacaccaggccaaaccccccactcatcatttatggtntcactcgtcgccctcaggagtctctcatcgcttctcaggctacaagtctggcaacacggcctcctaaccatctctggctcagttgacgacgagtcttacttattactgtctacgtttacctttaaagtcggacctaccctacgttccgttacggtttcggttttccgggacggtaggccgtaaccggtaagttccggtacccggttcccgtaccgggtccaccggtaccccgtaaaggtccctacccggtccccccgttaccgggtccctacccgtccgttccccgg

SEQ ID NO: 130292 - DNA, 701 bp, Homo sapiens
  misc_feature: GYAE6OF01BXSH0.22.36.D03.1.454.CMB.1.raw
  modified_base (309)..(309): a, c, t, g, unknown or other
  misc_feature (309)..(309): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcactggggaaccaacagtgactattgggtctttgactctgtctcctgtaccaacaacacccagccaaacccccatcatctattactggtntcactcgtcggcctcgagagtctctcgatcgtcttcctcgacggtctaccaagtccgtaggaccaaccgaccggtccctacccgtaactactccgtcgtcggtccttaccgtaggtttgacggtacgtacgttaccttacttacgtttactcgtacttacgtttacctttaagtcgtaccgtacctacgttaccgttccggtttacgggttttccgggacgggtacgggtacccgtaaccgggtaacggttacccggtaccccggttcccgttacccggggttaccctaacccgggtccccggtaaacggggttcccccgtttacccccgggtaccccccccggtttaccgggttccccgtaaccccggttttccccgtttcccccccgggg

SEQ ID NO: 130293 - DNA, 884 bp, Homo sapiens
  misc_feature: GYAE6OF01DIMLB.22.36.D03.1.454.CMB.1.raw
  modified_base (219)..(219): a, c, t, g, unknown or other
  misc_feature (219)..(219): n is a, c, g, or t
  modified_base (235)..(235): a, c, t, g, unknown or other
  misc_feature (235)..(235): n is a, c, g, or t
tcagacatacgcgtcacgaccggtgctcgatttagctgcgtcacgatctctcttgggggggtctcaggaggcagcgctcgtcgggacgtctccaccatggcctgggctctgctattcctcaccttcctcactcaggcacagggtcctgggcccagtctgccctgacccagcctgcctccgtgtcgtaggatcatctggacagtcgatcagctatttccngcacgtgggaaccaangtgactagttggtcttttgacttcgtgttctcctacggtaaccaacaaacctacccgaaggacccctaaaacccccccaacttccaacgttccaaatttttagcgggtttagtccctaaccgttccggttacccgggccccttcgtaaacgggtagttccttaccgttacctaacgttcccgtctttcccttaccgaaacgggtccctttaaccccgtaaaaggttcccgtttacggggaccctaaaacccgtacccgggtacccctttaacccccgtaaaccctaacgttacccgttccgttaccggggttccttaccccggttaaggttttacgggaacgggtaaccgttaacggttacccgtttaacgtttaactttaaccgttacggtacctttaaggttttaacccttttaaaacgtttacgggtacccgttacccgttaaccgttaccgtttccgggtttaccgggtttttaccggggtacccggttaacgggtacccgtaacccggggtaaaagttacccgggtaaaccccggtttccccggttaccgggttaacccgtaaccggtacccccggtaaaaggtccccgttaacccggttccccccggttacggtccccgttaacccgttccgtttcccccggg

SEQ ID NO: 130294 - DNA, 734 bp, Homo sapiens
  misc_feature: GYAE6OF01BAZXU.22.36.D03.1.454.CMB.1.raw
  modified_base (254)..(254): a, c, t, g, unknown or other
  misc_feature (254)..(254): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcacgtgggaccaacagtgacagttggtctttgactntgtctctgtacacaacaccagccaaacccccatcatcattatgtgtcactcgtcggcctcaggagtctctcatcgtacttctcaggtctccaagtctcggacaaccaccggccctaccctaaccacttcctcgtacggggtcttaccctaggttttacggaacgggtaccgttaacgggtttacccttaaaccgttttaaactttaccgttcgtaacgttaaccgtttttaacccgtttttaaaagttaaccggtacccggtacccgtaacccttttccggttacgggttttaccgggtttttcccggggacggggttaaccggggtacctaaacccgggtaaacggttacccggtaaccccgggttccccggttaccggggtacccgttaaacccggaccccggtaaaaccgggtcccttcccggggtacccccccccgttttacgggaccccttaacccggttccgtttccccccggg

SEQ ID NO: 130295 - DNA, 692 bp, Homo sapiens
  misc_feature: GYAE6OF01CYJ89.22.36.D03.1.454.CMB.1.raw
  modified_base (218)..(218): a, c, t, g, unknown or other
  misc_feature (218)..(218): n is a, c, g, or t
  modified_base (237)..(237): a, c, t, g, unknown or other
  misc_feature (237)..(237): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcacgtgggaccaacagtnactagttgggttcttttgactctgtctccgtaggtaccaacaaccacccacggaccccaaaccccccaactaccatctatttagtggtcgtcacctcgtccgccctgaggtagtctctcacttcgtcttctacgacggtctacctaagtcgtaggaccaaccgtaccggtaccctaccctaacctactcctaccgtcggtcctacccgtagtttacggaacgggtacgtacgttacctttaacgtttaacgttacgtacgtacgttacgttttaacctttaaagtttaccggcgtacccttacgttccgttacgggtttcgggttttacgggcggtacggaccgtaaccgacggttaccgtacccggttcccgttaccgggtacacccggtaccccgtaacggtccccgttcccggtaccccccgttaggttcccttcgtttcccgttacccccg

SEQ ID NO: 130296 - DNA, 622 bp, Homo sapiens
  misc_feature: GYAE6OF01AWDO9.22.36.D03.1.454.CMB.1.raw
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgccctccgtgtctggatcatctggacattcgatcagctatttcctgcactgggaaccaacagtgactagtttgggtcttttgacttctgtctccgtcggtaccaacaaccacccacggaccaaaaccccccaactcatgatttatgagtcactaacgcggccctcgacgggtccctgactcgtcttctctggctcagtctgaccaacaccggtccctcctacgtaccgtctcgtcggcctccgaggtcgtggaggtagtggacgtcgttagtaactttacgttacgtcgacacgtactacgtaagttaggtaggtacggacgacgtacggacttaagggtttcggtagggttccgggaacggggtacgggaccgtaacggccgttaccggaccccgttaccggtacggtaccgaccggacccgacggtcccgtcccgtaccccccggg

SEQ ID NO: 130297 - DNA, 647 bp, Homo sapiens
  misc_feature: GYAE6OF01CBS0P.22.36.D03.1.454.CMB.1.raw
  modified_base (220)..(220): a, c, t, g, unknown or other
  misc_feature (220)..(220): n is a, c, g, or t
  modified_base (243)..(243): a, c, t, g, unknown or other
  misc_feature (243)..(243): n is a, c, g, or t
  modified_base (361)..(361): a, c, t, g, unknown or other
  misc_feature (361)..(361): n is a, c, g, or t
  modified_base (597)..(597): a, c, t, g, unknown or other
  misc_feature (597)..(597): n is a, c, g, or t
tcagacatacgcgtcacgaccggtgctcgatttagctgcgtcacgatctctcgttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagtctatttccngcacgtcgggaaccaacaggtanactagttcggttcttttgacttctgtcctccgtagtaaccaacaaccacccacggacccaaacccccatcatctattatggtctcactcgtccggcctgagtctctctcatcgtctcncgtacgtcctacgagtcgtacggacaaccgtaccgtcccttaccgtaacctcttccgtacgtcggtccttaccgtaggtttacggacggtacgtacgtttacttaacctttattacgttcgtacgttaacttttaacctttaaaggtccgtaccgtacctacggtttcgttacgggttcggtttacgggaccggtagtacccgacggtacgttccgtacccgttccgtacggtacnccggacccgtacggccgtcccgtccccgtagtcctacgttcccgttcccg

SEQ ID NO: 130298 - DNA, 738 bp, Homo sapiens
  misc_feature: GYAE6OF01DM11Z.22.36.D03.1.454.CMB.1.raw
  modified_base (221)..(221): a, c, t, g, unknown or other
  misc_feature (221)..(221): n is a, c, g, or t
  modified_base (240)..(240): a, c, t, g, unknown or other
  misc_feature (240)..(240): n is a, c, g, or t
  modified_base (320)..(320): a, c, t, g, unknown or other
  misc_feature (320)..(320): n is a, c, g, or t
tcagacatacgcgtcacgaccggtgctcgatttagctgcgtcacgatctctcgttggggggggtctcaggaggcagcgctctcgggacgtctccaccatggcctgggctctgctattcctcaccttcctcactcgagggcacagggtcctgggcccagtctgccctgacccagcctgcctccgtgtctggatcatctggacagtcgatcagctatttccgngcacgtggaaccaagagtnactagttggtcttttgactctgtctcctcgtaccaacaaccaccacggacccaaacccccaactacactctattatggtntcactcgtccgcctcgacggtgtctctcacgtcgtcttcgtcacggcctaccgaacgtccgtacgaccaaaccgtaccggtaccccttacccgtaaacccgtacgttcccgttaccggtcgggttaccttaccccgttaagggtttacggaacgggtaccggtaacgtttaccgttaaaccgtttacttaccgttcgtacgttaccgttttaaccgttttaaaagttaccggtacccgtacccgttaacgtttccgttacgggtttcggtttttaccggggacggtacggtaaccgtaccggtaagtccggtacccgttcccggtaccgggtaccgtacccgtaccccggtaagggtccccgttacccgggtaccccccgttaccgggttaccctacccgttcccgttcccccccggg

SEQ ID NO: 130299 - DNA, 752 bp, Homo sapiens
  misc_feature: GYAE6OF01A4D2I.22.36.D03.1.454.CMB.1.raw
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattggtcttttgactctgtctctgtaccaacaacacccaggaccaaaccccccaactcatcatttatggtgtcactcgtccggccctacgaggacgtctctcatcgtcttactcaggtcctacctaagtcctggacctaaaccgaccgggccccttacccctaaacccactaccttccgtacggggtccttaccccgtaacgttttacggaacgggtaaccgtacgttaccgttaacgttttaactttaaccgttacgtacgtacgttttacccgttttaaaacgtttacgggtacccgtacccgtaacccttccgtttaccgggtttcgggtttttaccgggtccggggtaaccgggtccggtaacccggtaaacggttaccgggttaaccccggttccccggttacccgggttacccggaacccggtaacccccgtaaaccggggttcccgttaccccgggtccccccccggtttacccgggtacccgttacccgttcccgtttaccccccggg

SEQ ID NO: 130300 - DNA, 607 bp, Homo sapiens
  misc_feature: GYAE6OF01DKQ4Z.22.36.D03.1.454.CMB.1.raw
  modified_base (217)..(217): a, c, t, g, unknown or other
  misc_feature (217)..(217): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcacgtgggaccaacagtgactagttgggttctttgactctgtctcctcggtaccaacaacaccacggaccaaaccccccaactcatctatttatggtcgtcactcgtcgccctcaggtactctctcatcgtcttctcgacgtctaccgaacgtctacggaccaacgaccggtccctaccctaaccatccgtcgtcggtcctcgtagtttgacggtacgtagtccttacttatactgtacgtactttacctttaagttcggcctacctacgttcgttacggtttcgggtttcggcggtacggactaccggtaaggtccgacccggttcgtccggtacgaccgacccgaaggtccctccggtacccccgtggtaccctcgtccgttacccg

SEQ ID NO: 130301 - DNA, 570 bp, Homo sapiens
  misc_feature: GYAE6OF01CG7TC.22.36.D03.1.454.CMB.1.raw
  modified_base (218)..(218): a, c, t, g, unknown or other
  misc_feature (218)..(218): n is a, c, g, or t
  modified_base (233)..(233): a, c, t, g, unknown or other
  misc_feature (233)..(233): n is a, c, g, or t
  modified_base (303)..(303): a, c, t, g, unknown or other
  misc_feature (303)..(303): n is a, c, g, or t
  modified_base (357)..(357): a, c, t, g, unknown or other
  misc_feature (357)..(357): n is a, c, g, or t
  modified_base (380)..(380): a, c, t, g, unknown or other
  misc_feature (380)..(380): n is a, c, g, or t
  modified_base (492)..(492): a, c, t, g, unknown or other
  misc_feature (492)..(492): n is a, c, g, or t
tcagacatacgcgtcacgaccggtgctcgatttagctgcgtcacgatctctcgttgggggggtctcaggaggcagcgctctcgggacgtctccaccatggcctgggctctgctattcctcaccttcctcactcaggcacagggtcctgggcccagtctcgccctgacccagcctgcctccgtgtctggatcatctggacagtcgatcagctatttccngcacgtggaccaacngtgactagttggtctttgactctgtctctcgtacacaacaccacgaccaaacccccatcactctattagngtcgtcactcgtcgcctgagtacgtctctcatcgtctctcacgctcgaagttcncggacaacgacgcctaccaactntacctcgtcggctacgtagtttcgacgacgtactcgttaacttacttactgtacgttagttaaccctttaaagttcgtaccaccttacgtcgtttacgttgggtttaccggngtacgcgtaaccggagtcgaccgtccgtacggtcaccgccgtaacgtcgtccgtcccctagtcaccgttcgtacccgg

SEQ ID NO: 130302 - DNA, 675 bp, Homo sapiens
  misc_feature: GYAE6OF01BBOS3.22.36.D03.1.454.CMB.1.raw
  modified_base (218)..(218): a, c, t, g, unknown or other
  misc_feature (218)..(218): n is a, c, g, or t
  modified_base (369)..(369): a, c, t, g, unknown or other
  misc_feature (369)..(369): n is a, c, g, or t
tcagacatacgcgtcacgaccggtgctcgatttagctgcgtcacgatctctcttgggggtggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcacgtgggaaccaacagtgactagttgggttcttttgactctgtctcctaggtaccaaacaaccacccgacggacccaaaacccccccataccatcctatttatcggtctcacgtcgtccggccctcgaggtacgtctctcatcgcttcncacggtctacaagtctggaccaacgaccggtcccttacccaacctactctaccgtggtcctccgtaggttgacggtacgtacgttaccgttaactttacttaaccgtcgtaccttaacgttttaaccttttaaaaggttaccggtaccgtacccgtacgttccgtttcgggtttaccgggtttccgggaccggtacggtccgtaaaccggtaaggtcccggtaaccccgttcgtaccgggtaccgaccggtaaccccgtaacgggtccctacccggtcccccgtcgggtacctaccggttccccgg

SEQ ID NO: 130303 - DNA, 589 bp, Homo sapiens
  misc_feature: GYAE6OF01DRYC0.22.36.D03.1.454.CMB.1.raw
  modified_base (219)..(219): a, c, t, g, unknown or other
  misc_feature (219)..(219): n is a, c, g, or t
  modified_base (381)..(381): a, c, t, g, unknown or other
  misc_feature (381)..(381): n is a, c, g, or t
  modified_base (401)..(401): a, c, t, g, unknown or other
  misc_feature (401)..(401): n is a, c, g, or t
tcagacatacgcgtcacgaccggtgctcgatttagctgcgtcacgatctctcgttggggggggtctcaggaggcagcgctctcgggacgtctccaccatggcctgggctctgctattcctcaccttcctcactcagggcacgagggtcctgggcccagtctgccctgacccagcctgcctccgtgtctggatcatctggacagtcgatcagcatttccngcactgggaaccaacagtgacattgggtcttttgacttcgtgtctcctagtaaccaaacaacacccaggacctaaaccccccaatcatctatttatggtgtcactcgtcgccctacgaggactctctcatcgtcttctcacggctacaagtctcggcaaacncggaccctacctaacactcncgtgggctctagttgacggtacgagtcttacgttatactgactagtttaaccttaagttcgccgtcctacttactcggttggtttcggcggtacggccaaccggtagtcggtacccgtccggttacgtacacggtacccgaacggtcctcccggtacccccgtaggttccaccgttccgttaccccgg

SEQ ID NO: 130304 - DNA, 683 bp, Homo sapiens
  misc_feature: GYAE6OF01CHNH0.22.36.D03.1.454.CMB.1.raw
  modified_base (225)..(225): a, c, t, g, unknown or other
  misc_feature (225)..(225): n is a, c, g, or t
  modified_base (509)..(509): a, c, t, g, unknown or other
  misc_feature (509)..(509): n is a, c, g, or t
tcagacatacgcgtcacgaccggtgctcgatttagctgcgtcacgatctctcgttggggggggtctcaggaggcagcgctctcgggacgtctccaccatggcctgggctctgctattcctcaccttcctcactcgagggcacgagggtcctcgggcccagtctcgccctgacccagcctgcctccgtgtctggatcatcgtggacaggtcatcagctatttccgngcacgtcggaaccaagtaggtcgacttaggtttcgggttcttttgaccttcgtcgtccttaccgtacgtaaccaaacaaccacccgaaccgaaccccaaaacccccctatcattactactttagtcggtctcctacgtccgtccgcctacgaggtactctctctactccgtcttcgcgacgtctacgtacgttcgcgaacctaaccgccgtaccctaaccctaactctccgtcgtcggtcctacgttagttacggacggtactacgttacttacttacgttacncgtacgtttattttaaccgttaagccggtacctaccgtacgtttcgttacgggtttcggttacgggacggtaacgtacgtaaccggtaaggtccgtaacccgtcggtcgtacgaaccgtcccggtacgtcccgttcccggaaccccgttgccccttaccgttccgtttccccgg

SEQ ID NO: 130305 - DNA, 652 bp, Homo sapiens
  misc_feature: GYAE6OF01ASVAB.22.36.D03.1.454.CMB.1.raw
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattggtctttgactctgtctctgtaccaacaacaccaggccaaacccccactcatcatttatgtgtcactcgtcggccctcaggagtctctcactcgcttctcacggtctaccaagtcgtcggtaccaacaccggcctacccctaaccactccttcgtcgggtctacccgtaggtttcgaacgggtacgtacgtcgttaactttactttaacgtgtacttaagtttacccttttaaaagttacggtaccgtaccctacgttaccgttccggtttcggttttaccgggcgggtacggtccgaaccggtaacggtcggttaacccggtcccgttaccgggtaccgtaccggtaccccgaaagggtcccttaccggtaccccccgttccgggcccttaaccgttcccgtttaccccggg

SEQ ID NO: 130306 - DNA, 806 bp, Homo sapiens
  misc_feature: GYAE6OF01EK1NE.22.36.D03.1.454.CMB.1.raw
  modified_base (220)..(220): a, c, t, g, unknown or other
  misc_feature (220)..(220): n is a, c, g, or t
  modified_base (234)..(234): a, c, t, g, unknown or other
  misc_feature (234)..(234): n is a, c, g, or t
tcagacatacgcgtcacgaccggtgctcgatttagctgcgtcacgatctctcgttggggggggtctcaggaggcagcgctctcgggacgtctccaccatggcctgggctctgctattcctcaccttcctcactcgagggcacagggtcctgggcccagtctcgccctgacccagcctgcctccgtgtctggatcatctggacagtcgatcagctattccngcacgtggaccaanagtgactagttgggttcttttgacttcttcgtccttccgtacggtaaccaaacaaccgacccgacggaacccccaaaaccccccatacacgttactattttacgtcgggttctacctaccgttcggtcccggtacccttacggaacgggtactccttcctactacgttccgtcctttcgacgtacgggtacctaccgaacgttccgtacggaccaaaccgtacccggtacccttacccctaacgtactttcccgttacggtcggtaccgttacccgtaagggttttacggaacgggtacgttaacgtttactttaacgtttaacgttaccgtaggtacctttaccgtttttaaaccgtttaaaaggtttcgggttaccacccgtttaacgtttccggttttaccggggtttacgggttttacccgggacgggttacccgggtaaccgtaaccgggttacggtaccgggttaccccggttacccggttaccggtaccgtacccggacccggtaaccggccccgttccccgtaaccccggttccggttcctaacccgttccgttaacccccggg

SEQ ID NO: 130307 - DNA, 659 bp, Homo sapiens
  misc_feature: GYAE6OF01B341E.22.36.D03.1.454.CMB.1.raw
  modified_base (367)..(367): a, c, t, g, unknown or other
  misc_feature (367)..(367): n is a, c, g, or t
tcagacatacgcgtcacgaccggtgctcgatttagctgcgtcacgatctctcgttggggggggtctcaggaggcagcgctctcgggacgtctccaccatggcctgggctctgctattcctcaccttcctcactcagggcacgagggtcctgggcccagtctcgccctgacccagcctgcctccgtgtctggatcatctggacagtcgatcagtctatttcctgccacgtcgggaaccaacgagtgactagttgggttctttgactctcgtctcgtacgtaaccaacaaccaccgacgacccaaacccccatcactctattatgtctctacgtcgtccgtcctagagtcgtctctctactcgtcttcncgacggtcctacgacgttcgtacggaccaaccgtaccgtccctaaccctaactactcgtcgtcggtcctacgtaggttacggaacggtacgtacgttacctttaacttacgttacgtcgtacgtttaacgtttaacctttaaaggtccgaccgtaccctacgttccgttacggtttcgggtttaccgggcgggtaccgtacgtaaccggtaacggttcccggtacccgtccggtcgaccgtcggaacccgtacggtccgtcccgtccccgtgtccctacgttcgttcccccg

SEQ ID NO: 130308 - DNA, 610 bp, Homo sapiens
  misc_feature: GYAE6OF01DFHSV.22.36.D03.1.454.CMB.1.raw
  modified_base (217)..(217): a, c, t, g, unknown or other
  misc_feature (217)..(217): n is a, c, g, or t
  modified_base (310)..(310): a, c, t, g, unknown or other
  misc_feature (310)..(310): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctcgtgtctggatcatctggacagtcgatcagctatttccngcacgtgggaaccaacagtgactagttggtctttgactctgtctctagtaccaacaaccaccacgccaaacccccatacatactattagtgtntcactcgtacggcctgaagtctctactctactcgtcttctcgacggtctacgtaacgtcgtacggaacctaaccgacccggtacccttacccaacctactccgtacgtcgggtactcgttagttagaggactacgtacttacttatactgtcttagttacctttaaagtcgacacctaacttcgttcgttagggtttcggcggtacggaccgtaacgtacggtacgaccgttaccgtacggttcgaccgtacccgaacggaccgttcccggacccctcgggtactccgtcgttaccccgg

SEQ ID NO: 130309 - DNA, 715 bp, Homo sapiens
  misc_feature: GYAE6OF01CTQQM.22.36.D03.1.454.CMB.1.raw
  modified_base (219)..(219): a, c, t, g, unknown or other
  misc_feature (219)..(219): n is a, c, g, or t
  modified_base (236)..(236): a, c, t, g, unknown or other
  misc_feature (236)..(236): n is a, c, g, or t
  modified_base (295)..(295): a, c, t, g, unknown or other
  misc_feature (295)..(295): n is a, c, g, or t
  modified_base (305)..(305): a, c, t, g, unknown or other
  misc_feature (305)..(305): n is a, c, g, or t
  modified_base (310)..(310): a, c, t, g, unknown or other
  misc_feature (310)..(310): n is a, c, g, or t
  modified_base (337)..(337): a, c, t, g, unknown or other
  misc_feature (337)..(337): n is a, c, g, or t
tcagacatacgcgtcacgaccggtgctcgatttagctgcgtcacgatctctcgttggggggggtctcaggaggcagcgctctcgggacgtctccaccatggcctgggctctgctattcctcaccttcctcactcagggcacagggtcctgggcccagtctgccctgacccagcctgcctcgtgtctggatcatctggacagtccgatcagctatttccngcacgtcgggaccaacngtgactagttggtcttttgactctgtctctgaaccaacacaccacgaccccaaccccancatctattancggtntctactcgtccgcctgagactctctcntcgtcttctacgacgtcctacgtaacgtcgtacggacctaaccgcccggtaccccttaccctaaccgtacttcccgttcggttcgggtacccttacccgttaggtttacggaaccggtaccgttaacgttaccttttaaacgtttacctttacgtcggttacctttaacgttttaacccgttttaaaggttccggaccgttacccgttaaccgtttccggtttaccgggttttacggggttttacccgggcgggtaaccggtaccgtaaccggttaacggtccggtaacccggttcccgtacgggtaccgtaaccggacccgtaacgggtccctaccccggtaccccgttggtacccttccgttcccggttcccccgg

SEQ ID NO: 130310 - DNA, 643 bp, Homo sapiens
  misc_feature: GYAE6OF01D9KSM.22.36.D03.1.454.CMB.1.raw
  modified_base (377)..(377): a, c, t, g, unknown or other
  misc_feature (377)..(377): n is a, c, g, or t
tcagacatacgcgtcacgaccggtgctcgatttagctgcgtcacgatctctcttggggggggtctcaggaggcagcgctctcgggacgtctccacatggcctgggctctgcttattcctcaccttcctcactcgagggcacagggtcctcgggcccaggtctcgccctgaccacgcctcgcctccgtgtctggactcactcgtggacagtcgactcgagtctactttcctgacacgtacggaaccaacgagtcgacgtagtttcgggttctttagcttctcgtctcgtacgtaacaacaccaccgacgacccaaaccccatcactctattacgtgtctctacgtcgtcgtcctgacggtctcgctcactcgtcttcncgtacggtcctacgtaacgtcgtacggacctaaccgccgtaccctaccgtaaccgtcttccgtcgtcggtccttacgttaggttacgacggtacgtacgttactactttactcgtacgtacttacgtttacttaacgtcgacctccttacgttcgttcgggttacggtttcgggacggtacggacgtacggtaacgtccgtaccgttcggtcgtactccggtacgacggtccgtccgtcccgttacgccttccgtccgttaccccg

SEQ ID NO: 130311 - DNA, 678 bp, Homo sapiens
  misc_feature: GYAE6OF01BD4TR.22.36.D03.1.454.CMB.1.raw
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacagttgggtctttgactctgtctctggtaccaacaacacccaggccaaaccccccaatcatctattatgtgtcactcgtcgcctcaggagtctctcatcgcttctcagctccagtctggcaacgacgcctccctaaccatcctcgtcgggtctcctagtttcgagggtaccgtagttacttacgtttactttaacgtcgtccgtaagttttacccttttaaacgtttacgggcccgttaccctaaccgttccgtttaccgggtttcgggtttttaccggggtccgggtaacgggtccgtaacccggggtaacgttaccgggtaaccccggttccccgttaccggggtacccgtaaccggtaccccccggaaacgggttacccgttacccggtaccccccccgttaccgggtttacccctaaccgtttcccgtttacccccggg

SEQ ID NO: 130312 - DNA, 822 bp, Homo sapiens
  misc_feature: GYAE6OF01D8773.22.36.D03.1.454.CMB.1.raw
  modified_base (180)..(180): a, c, t, g, unknown or other
  misc_feature (180)..(180): n is a, c, g, or t
tcagacatacgcgtcacgaccggtgctcgatttagctgcgtcacgatctctcttggggggggtctcaggaggcagcgctctcgggacgtctccaccatcggcctgggctctgcttattcctcaccttcctcactcgagggcacgtcgggtccgtcgggccctagtctcgccctcgacccncgcctcgccgttcgtcgtcgtggactcactcgtacggacgtacggtacgactcgacgtccttactttccgcgaccgtaccgtaccgggaacccaagtcggtacgtacgttcggttttcgggtttctttacgcctttcgttcgttccgtaccgttaacgaaacccaaaccgtaaacccaccccggaaccggaaaccccccaaaacccccgtataccgtactttacgttaagttttcgggtcggtaccgttacctaccggttccgggtccccgtaccgtaacgtacgggtaccttccacgttacgtcgtccgttacgttccggacgtaccggttacctacggtacgtacgtaccgaccaaccggtccctacccgtaacctaacctcgtccgtcgtccggtacgttacgttaggtacgtacggtaccttacttaccgtttacgttacgttacgtacgttacgttttaacgtttaacgttaacggttccggtaccgtccttacggtttcggtttacgggttcggttaccggacggtaccggtaccgtacggttacgtccccgttacggtcccgttagaccggtaaccgccggtaaccgtcccggttaccccgtcccggtttaccgcctccgtttcccgtacccccg

SEQ ID NO: 130313 - DNA, 770 bp, Homo sapiens
  misc_feature: GYAE6OF01DU79N.22.36.D03.1.454.CMB.1.raw
  modified_base (172)..(172): a, c, t, g, unknown or other
  misc_feature (172)..(172): n is a, c, g, or t
  modified_base (220)..(220): a, c, t, g, unknown or other
  misc_feature (220)..(220): n is a, c, g, or t
tcagacatacgcgtcacgaccggtgctcgatttagctgcgtcacgatctctcgttggggggggtctcagggaggcagcgctctcgggacgtctccaccatggcctgggctctgctattcctcaccttcctcactcagggcacagggtcctgggcccagtctgccctgacccngcctgcctcgtgtctggatcatctggacagtcgatcagctattttccngcacgtacgggaccaaacgagtgactagtttgggttcttttgacttcgtgttcctccgttacggtaaccaaaccaacccgaaccccgaaccgggaccccaaaacccccccccaactccaattccttaattttaacgtcgggtacgttccgtaccgtccggttccggccccttacgaacgggtacgttcctctctacgttcgtccttccgtacgtacggtcctaccgtaacgtccgttacgggaccctaaaccgtacccgggtaccccttacccctaaaccctacttcccgttaccggtcgggtacccttaccggttaaggtttcggaacgggtaccgttacggttacctttaactttactttacgtcgttacgttacgttttacctttaagttaccggctacccgtacttcgttcgggtttcgggttttaccggcggtaacggcctaaccggtacggtaccggtacccgttccgttaccggccgtacgaccccggtaggtcccgtcccggtcccccgttccggtaccctaccgtttcccgttaccccggg

SEQ ID NO: 130314 - DNA, 746 bp, Homo sapiens
  misc_feature: GYAE6OF01CHPLZ.22.36.D03.1.454.CMB.1.raw
  modified_base (202)..(202): a, c, t, g, unknown or other
  misc_feature (202)..(202): n is a, c, g, or t
  modified_base (220)..(220): a, c, t, g, unknown or other
  misc_feature (220)..(220): n is a, c, g, or t
  modified_base (234)..(234): a, c, t, g, unknown or other
  misc_feature (234)..(234): n is a, c, g, or t
tcagacatacgcgtcacgaccggtgctcgatttagctgcgtcacgatctctcgttggggggggtctcaggaggcagcgctctcgggacgtctccaccatggcctgggctctgctattcctcaccttcctcactcagggcacagggtcctgggcccagtctgccctgacccagcctgcctccgtgtctggatcatcgtggacngtcgatcagctatttccngcactgggaccaangtgactagttggtctttgactctgtctcctggtaaccaacaaccacccacgaccccaaaccccccatcactctaatttactcggtgtctacgtccgtcggtccctgacggtacgtcctctactagtccgtacttccgtcgacggtcctaccgtaagtcgtacggactaaacccgtcccggtacccttacccgtaaaccgtacgttcccgttcgttcggggtacccttaccggtaacggttttacggaaccgggtaacgtacggtttacctttaacgttaaccgtttacgtacggtaccttaagtttttacccgttttaaaaggttccggacccgttaccttaccgtttccgtttcgggtttacggtttcccgggaacgggtacgtacccggtaaacgtaccggttaaccggtcccggtttcccggtacggtaccgaccggtacccccggtaaggtcccgttaccccgggttccccctaaccgggttccctacccggttcccgttcccccggg

SEQ ID NO: 130315 - DNA, 630 bp, Homo sapiens
  misc_feature: GYAE6OF01C4LKY.22.36.D03.1.454.CMB.1.raw
  modified_base (228)..(228): a, c, t, g, unknown or other
  misc_feature (228)..(228): n is a, c, g, or t
  modified_base (301)..(301): a, c, t, g, unknown or other
  misc_feature (301)..(301): n is a, c, g, or t
  modified_base (329)..(329): a, c, t, g, unknown or other
  misc_feature (329)..(329): n is a, c, g, or t
tcagacatacgcgtcacgaccggtgctcgatttagctgcgtcacgatctctcttggggggggtctcaggaggcagcgctctcgggacgtctccaccatggcctgggctctgctcctcctcagcctctcactcaggcacagggtcctgggcccagtctgccctgactcagccctccctccgcgtccgggtctcctggacagtcagtcaccatctcctgcactggaaccngcagtgacgttggtggttacaagtatgtctcgtgtaccaacaccaccagcacacgaccccaaatcatgattangagtcacgtagcggcctcgacgggtccngactcgtctctcgtcggctacgacgtcgtcggaccgaccgaccggtccctaccctcggtacccgttctccggttccgggccttccggaagggtccttagggaacggtagttacggacggtctagttattactttacgtcgtacttactacaagttatcggacgacggtacctaccttacggtacggtttggggttcggttaccggggacgggaacgggtacccgtaaggtccgttacggtacccgttacccgtaaggtcccgtaacggacccgaacggtcccgcccggtcccccgttacgg

SEQ ID NO: 130316 - DNA, 616 bp, Homo sapiens
  misc_feature: GYAE6OF01BG0QZ.22.36.D03.1.454.CMB.1.raw
  modified_base (130)..(130): a, c, t, g, unknown or other
  misc_feature (130)..(130): n is a, c, g, or t
  modified_base (350)..(350): a, c, t, g, unknown or other
  misc_feature (350)..(350): n is a, c, g, or t
tcagacatacgcgtcacgaccggtgctcgatttagctgcgtcacgatctctcgttggggggggtctcaggaggcagcgctctcgggacgtctccaccatggcctgggctctgctattcctcaccttcctnactcagggcacagggtcctgggcccagtctgccctgacccagcctgcctccgtgtctggatcatctggacagtcgatcagcatttcctgcacgtgggaccaacagtgacagtttggtctttgactctgtctcgtgtaccaacacaccagaccaaacccccatcactctaattatcggtctacacgtcgtccgcctcgaggtactctctcatccgtcttcncgaggtcctacaacgtcgtaggacaaccgaccggtccctaaccctaacctcttcctcgtcgggcctaccgaggtcctaggaagtactggacgtcgtagtatttactaacgtgtactcgtacttactacgtttcgaccgtacggtccgtaccgttacgtacggtttcgggtcggtaccgggtacgggtaacggtacccgtaacggtccgtaccgggtacccgttaccggttacggaccgtaccggcccgtaacggtcccgtccccgg

SEQ ID NO: 130317 - DNA, 641 bp, Homo sapiens
  misc_feature: GYAE6OF01DEY2R.22.36.D03.1.454.CMB.1.raw
  modified_base (222)..(222): a, c, t, g, unknown or other
  misc_feature (222)..(222): n is a, c, g, or t
  modified_base (237)..(237): a, c, t, g, unknown or other
  misc_feature (237)..(237): n is a, c, g, or t
  modified_base (323)..(323): a, c, t, g, unknown or other
  misc_feature (323)..(323): n is a, c, g, or t
  modified_base (358)..(358): a, c, t, g, unknown or other
  misc_feature (358)..(358): n is a, c, g, or t
tcagacatacgcgtcacgaccggtgctcgatttagctgcgtcacgatctctcgttggggggggtctcaggaggcagcgctctcgggacgtctccaccatggcctgggctctgctattcctcaccttcctcactcgagggcacgagggtcctgggcccagtctcgccctgacccagcctgcctccgtgtctggatcatctggacagtcgatcagctatttccngcacgtggaccaacngtgactagttggttctttgacttcgtgtcctcctagtaaccaacaaccaccacgaccccaaacccccatcatctattatgtcgtcncgtcgtccgcctgaggtctctctcactcgtcttcncgacgtcctactacgtcgtacggaccaaccgccgtcccttaacccgtaacctcttcccgttcggtcggtccttacgttacggtttaggaacggtacgtacgtttaccttaacgtttacttacgtgtactttaacgttttaccgtttaaagtccggtacctccgttaccttcgttcgggtttcggtttcgggcgtacgaccgtacgagttccgacccgttcgtacggtctaaccgacccgtacgtccgtcccggtaccccgtggtaccctccgttcgtcccccg

SEQ ID NO: 130318 - DNA, 630 bp, Homo sapiens
  misc_feature: GYAE6OF01ADGQK.22.36.D03.1.454.CMB.1.raw
  modified_base (234)..(234): a, c, t, g, unknown or other
  misc_feature (234)..(234): n is a, c, g, or t
  modified_base (303)..(303): a, c, t, g, unknown or other
  misc_feature (303)..(303): n is a, c, g, or t
  modified_base (307)..(307): a, c, t, g, unknown or other
  misc_feature (307)..(307): n is a, c, g, or t
  modified_base (341)..(341): a, c, t, g, unknown or other
  misc_feature (341)..(341): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcacgtgggaccaacngtcgactagttgggtcttttgactctgtctctgtaccaacacaccagaccaacccccatcatctattanggtntcactcgtcgcctgagactctctcactcgtctcngacgctacagtctggacacaccgtccctacctaccactcctcgtcggtctaccgtagttacggacggtacgtagttcttaactttacttacgtgtacttacgtttacctttaaagtcggtaccctacctaccgtttccgttacgggtttcgggttttaccgggacggtaccggtaccgtaaccggtaacggttccggtacccggttcccggtacgggtaccgacggacccccgtaggtcccgttacccggtccccccgttacggtcctacccgtttcccgttacccccg

SEQ ID NO: 130319 - DNA, 641 bp, Homo sapiens
  misc_feature: GYAE6OF01ELZZ6.22.36.D03.1.454.CMB.1.raw
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgccacgtcgggaacccaacgagtacgactagttgggttcttttgacttctgtctctcgtaaccaacaaccacccacgacccaaacccccactcactctattagtggtctcactcgcgcctcaggatcctctcactcgtcttctcgacgtcctacgtaacgtcgtacgaccaaccgaccggtccccttaccctaacctactcctcgtcgggtccttaccgtagttacgacggaacgtacgttaccttacgtttaacttacgtcgtacttacgtttacctttaagtcggactaccgtacttcgttcgtttacggtttcggacggtacgtcggtaaccgtaacggtcgtacccggttccgtacggtaccctcgacccgtaacgtccgtacccgtaccccggtccgtacctcccgttcgttaccccg

SEQ ID NO: 130320 - DNA, 666 bp, Homo sapiens
  misc_feature: GYAE6OF01BAI0U.22.36.D03.1.454.CMB.1.raw
  modified_base (221)..(221): a, c, t, g, unknown or other
  misc_feature (221)..(221): n is a, c, g, or t
  modified_base (236)..(236): a, c, t, g, unknown or other
  misc_feature (236)..(236): n is a, c, g, or t
  modified_base (348)..(348): a, c, t, g, unknown or other
  misc_feature (348)..(348): n is a, c, g, or t
  modified_base (472)..(472): a, c, t, g, unknown or other
  misc_feature (472)..(472): n is a, c, g, or t
tcagacatacgcgtcacgaccggtgctcgatttagctgcgtcacgatctcctcgttggggggggtctcaggaggcagcgctcgtcgggacgtctccaccatggcctgggctctgctattcctcaccttcctcactcagggcacagggtcctgggcccagtctcgccctgacccagcctgcctcgtgtctggatcatctggacagtcgatcagctatttccngcacgtgggaccaanagtgactagttggtctttgactctgtctctggtaccacacaccaggaccaacccccatcatacattatggtctcactcgtccgcctgaggtatcctctcagtccgtcttccncgtacggcctaccgaagttcgtacggaccaaccggacccggcccttaccctaaccgtacttccgtcgtcgggtcctcccgtaggtttcggaacgtacggacgttaccttaacgttatttaccgngtacctaacgttttacctttaaagtcggtaccgtacctaccgttcgttccggtttacgggttttccgggacgggtacggtcccgaaccggtacgtaccggtacccggttcccgttccgggtacctacggtaccccgtaagggtcccgtaccggtccccccttacggggttaccctccgtttccgttacccccgg

SEQ ID NO: 130321 - DNA, 641 bp, Homo sapiens
  misc_feature: GYAE6OF01BLUJF.22.36.D03.1.454.CMB.1.raw
  modified_base (177)..(177): a, c, t, g, unknown or other
  misc_feature (177)..(177): n is a, c, g, or t
  modified_base (226)..(226): a, c, t, g, unknown or other
  misc_feature (226)..(226): n is a, c, g, or t
  modified_base (246)..(246): a, c, t, g, unknown or other
  misc_feature (246)..(246): n is a, c, g, or t
tcagacatacgcgtcacgaccggtgctcgatttagctgcgtcacgagtctctcgttggggggggtctcaggaggcagcgctctcgggacgtctccaccatggcctgggctctgcctattcctcaccttcctcactcgagggcacgagggtcctgggccccagtctcgccctgacccngcctgcctccgtgtctggatcagtctggacagtcgatcagctatttccngctacgtcgggaaccaacgngtagactagttggttctttacgacttctcgtcctccgtacgtaaccaacaaccacccacgaaccccaaccccctatctatactattgtgtctacctacgtcgtccgtcctacgacgtacgtctctctactcgtcttactcgtacggctacctacgtctcggacctaaccgacccgtacctaccctaacgtccttccgtacggtcggtccttacgttacggttacggacggtacgtacgttactttacgttactacgtctacgttatttaaccttaagtcgtacctctacggtcttacggttcgttccggacgtacggaccgacggtacgtccgtaccgtcgtcgaccggtaccgcccgtaggcccgtacccgtcccgttcgctccgtcgtccccg

SEQ ID NO: 130322 - DNA, 761 bp, Homo sapiens
  misc_feature: GYAE6OF01C7P8M.22.36.D03.1.454.CMB.1.raw
  modified_base (221)..(221): a, c, t, g, unknown or other
  misc_feature (221)..(221): n is a, c, g, or t
  modified_base (236)..(236): a, c, t, g, unknown or other
  misc_feature (236)..(236): n is a, c, g, or t
  modified_base (313)..(313): a, c, t, g, unknown or other
  misc_feature (313)..(313): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacgagggtcctgggcccagtctgccctgacccagcctgcctccgtgtctggatcactcgtggacagtcgatcagctatttccngcacgtggaccaacngtgactagttggttctttgactctgtctcgtagtaccaacacacccgacgaccaaacccccatcatctattatggtntcactccgccgcctgacggtatctcgtacacgtccgtcttcgtacacggcctaccgtaacgttccgcggtaaccaaccgacccggttacccctaaccccttaacctacgtccttccggtcgggtcccttaccgtaggtttacggaacggtacgtacgttacttacgtttaactacgtactaccgtttacgtttaacctttaaacggttcggtaccctacccgttaaccgtttccggtttaccgggttttacgggttttaccggggacccgggtttaacggacccggtaaacccgggttaaacgggtcccggttaaccccgggttccccgttaccgggtacccggtaacccgggtaacccccggtaaacccgggttccccgtcccccggggttaccccccgttaccgggttttacccctaaccccggtttccccgttttaccccccggg

SEQ ID NO: 130323 - DNA, 621 bp, Homo sapiens
  misc_feature: GYAE6OF01BBYKW.22.36.D03.1.454.CMB.1.raw
  modified_base (267)..(267): a, c, t, g, unknown or other
  misc_feature (267)..(267): n is a, c, g, or t
  modified_base (569)..(569): a, c, t, g, unknown or other
  misc_feature (569)..(569): n is a, c, g, or t
  modified_base (586)..(586): a, c, t, g, unknown or other
  misc_feature (586)..(586): n is a, c, g, or t
tcagacatacgcgtcacgaccggtgctcgatttagctgcgtcacgatctctcgttggggggggtctcaggaggcagcgctctcgggacgtctccaccatggcctgggctctgctattcctcaccttcctcactcagggcacgagggtcctgggcccagtctcgccctgacccagcctgcctccgtgtctggatcatctggacagtcgatcgagctatttccagcacgtcgggaaccaacgtagtgactagttcgggttctttgactntctctcgtacgtaccaacaccacccggaccaacccccacactactctattatgtcgtcacgtcgtcgtccactagacgtctcctactactctcttctcgtcgtactcgtacgtactcgacgaccgaccgtacctaccctaacctactcgttcgtcgggtcctaccgttaggttaggaccggtaacgtacgttcttaccgtttatacgtgtacttacgttttaactaacgttacgccgtacctacgttcgttcgggttcggttacggcggacgtccacggtaacgtcgtacctcggtccgtanaccggaccaggtacccncgttcccctacgtcgtaccttccgtcccggtcccc

SEQ ID NO: 130324 - DNA, 727 bp, Homo sapiens
  misc_feature: GYAE6OF01BRV5M.22.36.D03.1.454.CMB.1.raw
  modified_base (234)..(234): a, c, t, g, unknown or other
  misc_feature (234)..(234): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacgagggtcctgggcccagtctgccctgacccagcctgcctccgtgtctggatcatctggacagtcgatcagctatttcctgcacgtgggaccaangtgactattgggtctttgactctgtcctcctacgtaccaacaaccacccaggacccaaacccccatcatctatttagtggtctcaccgtcgtccggccctcgacggtacgtctctcagtccgtcttcctacgacggtcctaccgtaacgtccgtcggacctaacccgaccggtcccttaacccgtaaccctacgttacctccgtacgggtcccttaccgttaggtttacggaacggtaccgtagttaccctttaacgtttactttacgtcttaccgttacgttttaaccgtttaagtccggtaccttacccgtaacgtttccgttaccgggtttacgggttttaccggggacgggtacgggtacccgtaaccgggtacggttacccggtacccggttacccgttccggtaaccgtacccggacccggtaaccggcccgtacccggttcccccccggttaccgtaccccttacccgttcccggttaccccccgg

SEQ ID NO: 130325 - DNA, 700 bp, Homo sapiens
  misc_feature: GYAE6OF01AE5AW.22.36.D03.1.454.CMB.1.raw
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcacgtcgggaccaacagtgactagttgggttctttgactctgtctccgtcggtaccaacaccacccacggacccaaaccccccactccatactatttacgtggtcgtcacgtccgtccggccctcgaggtcgtctctcacgtccgtcttctcgacggtcctaccacgtcgtcggaccaaccgccggtcccttaccctaacctctaccgttcgtcgggtcctaccggtaggtttacggacggtaacgtacgttacttaacgttacttacgtacgtacttacgttttaacctttaaagttccgaccgtccctacgttccgttcggtttgggtttccggacgggtacggtacccgtaccggttaacgggttacccggtacccggtttcccggtccggttaccgaccggtaccccgtaaccggtccccgtaccccggttaccccccggtaccggttccctaacccggttcccgtttaccccccgg

SEQ ID NO: 130326 - DNA, 641 bp, Homo sapiens
  misc_feature: GYAE6OF01DMTRB.22.36.D03.1.454.CMB.1.raw
  modified_base (221)..(221): a, c, t, g, unknown or other
  misc_feature (221)..(221): n is a, c, g, or t
  modified_base (238)..(238): a, c, t, g, unknown or other
  misc_feature (238)..(238): n is a, c, g, or t
  modified_base (310)..(310): a, c, t, g, unknown or other
  misc_feature (310)..(310): n is a, c, g, or t
  modified_base (313)..(313): a, c, t, g, unknown or other
  misc_feature (313)..(313): n is a, c, g, or t
  modified_base (330)..(330): a, c, t, g, unknown or other
  misc_feature (330)..(330): n is a, c, g, or t
  modified_base (346)..(346): a, c, t, g, unknown or other
  misc_feature (346)..(346): n is a, c, g, or t
tcagacatacgcgtcacgaccggtgctcgatttagctgcgtcacgatctctcgttggggggggtctcaggaggcagcgctctcgggacgtctccaccatggcctgggctctgctattcctcaccttcctcactcagggcacgagggtcctgggcccagtcctgccctgacccagcctgcctccgtgtctggatcatctggacagtcgatcagctatttccngcacgtgggaaccaacngtgactagttgggttctttgactctgtctcctggtaccaacaacaccacgaccaaacccccatcatcattangtntcactcgtcgcctgagntctctcatcgtcttcncacggcctacaagttccgacggtacaaaccgtccggcccttacccgtaaccacttcctcgtacgggtcctaccgaggtctaggaacggagtggaggtctagtaatttacgttacgtcgacacgtctacgtagttaggcgggaacgtccgaaggtaccggtaaacgttaacggtttttcggggtacggtttaccgggggaccgggttaacggggaacccgtaacgggtccgtaaccgggtaccccgttacggttaaccgggtaccaacccgggtacccggtaaacgggtcccccgg

SEQ ID NO: 130327 - DNA, 747 bp, Homo sapiens
  misc_feature: GYAE6OF01C9ZFL.22.36.D03.1.454.CMB.1.raw
  modified_base (218)..(218): a, c, t, g, unknown or other
  misc_feature (218)..(218): n is a, c, g, or t
  modified_base (325)..(325): a, c, t, g, unknown or other
  misc_feature (325)..(325): n is a, c, g, or t
tcagacatacgcgtcacgaccggtgctcgatttagctgcgtcacgatctctcgttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngccacgtcgggaaccaaacgagtcgactagttgggttcttttgacttctgtcctcctggtaaccaacaaccaccacggaccccaaaccccccatcatcctatttacnggtcgtacacgtcgtacggccctgaggacgtctctacagtcgtaccttcacgacggcctaccgtaacgtcctacgggaccctaaaaccggtcccggtaccccttacccctaaaccctaccgtttaccgtaccggttaccgggtaccttaccccggtttaggttacgggtaaacggtaccgttacgttaccgttaaccgtttaacttaccgtacgtttaccgttaaccgttttaaccgtttaaacggttaccggtacccgttaccgttaccgtttccgtttaccgggtttacgggttttaccgggtacgggtaaccggtaccggtaacccggtacgtaccggtacccgtcccggttacggtaccgtaccggaccgtacggtcctccccggtaccccgttcgtacctacgtcccgttaccccgg

SEQ ID NO: 130328 - DNA, 721 bp, Homo sapiens
  misc_feature: GYAE6OF01CI55Q.22.36.D03.1.454.CMB.1.raw
  modified_base (196)..(196): a, c, t, g, unknown or other
  misc_feature (196)..(196): n is a, c, g, or t
  modified_base (220)..(220): a, c, t, g, unknown or other
  misc_feature (220)..(220): n is a, c, g, or t
tcagacatacgcgtcacgaccggtgctcgatttagctgcgtcacgatctctcgttggggggggtctcaggaggcagcgctctcgggacgtctccaccatggcctgggctctgctattcctcaccttcctcactcagggcacagggtcctgggcccagtctgccctgacccagcctgcctccgtgtctggatcatcnggacaggtcatcagctatttccgngacacgtacggaaccaagagtacgactagtttcggttctttcgtacttcgtacgtcctacgtacgtaaccaaacaaccacccgacgaaccccaaaccccctaactacaacttactaagtttacgtcggtacgtactacgttccggtccgtaccgtacggacggtacgttcctacctactacgtcctcttaccgtacgtacgtacctaccgtaaggtcgtacggaccaaccgtacccgtaccctaccctaactacttcgtacgtcggtacttacgtagttacggaacgtactacgttacttaacttagtactgtacttaacgtttaacttaagtccgccgtactacgttcggttccggtttacgggtttacgggacggtaacgtaccgtaacggtacggttaccgtacccggttccggttaccggtacgaacccggtaacccgtaacgggttcccgaccccggttaccccgtttacggtacccttccgtttcccgtaccccg

SEQ ID NO: 130329 - DNA, 649 bp, Homo sapiens
  misc_feature: GYAE6OF01BYKL0.22.36.D03.1.454.CMB.1.raw
  modified_base (218)..(218): a, c, t, g, unknown or other
  misc_feature (218)..(218): n is a, c, g, or t
  modified_base (233)..(233): a, c, t, g, unknown or other
  misc_feature (233)..(233): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcacgtgggaccaangtgactgttggtcttttgacttctgtcctccgtcggtaccaacaaccacccacggaccccaaacccccccaatcctactctatttagtggtctctaccgtccgtccggtccctacgacggtcgttcctctctactccgtcttccgtccgggtcctaccgtaacgtcgtacggaccaaccgccggtccccttacccctaacacttcctcgtcggcttaccgtaggtttcggacgtacgtacttacgttactttacttctcgtacttacgtttaccttaagtcgcctcctacgttcttcggttaggtttccggcggtacgccgaccggtacgtccgtaccgtccgtcggtaccgacgtacccgacgtcccgtaccccggtccccttacggaccctaccgttccgtccccgttaccccc

SEQ ID NO: 130330 - DNA, 790 bp, Homo sapiens
  misc_feature: GYAE6OF01BSASL.22.36.D03.1.454.CMB.1.raw
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacgagggtcctgggcccagtctgccctgacccagcctgcctcgtgtctggatcatctggacagtcgatcagctatttcctgcacgtcggaaccaacgtagtgactagtttcgggttcttttgacttcgtcgttcctccgttacggtaaccaacaaccacccgaacggacccccaaaacccccccactccaacttactaattttagtcgggttctccaccgttccggtccgtaccctcggaggtacgttcctctactacgtctccttactcgacggtacctacgacgtccgtacggaccgaaaccgtcccggtacccttaacccgtaactccttaccgttccggtcggtacccttacccgttagggtttacggaacggtaccgtacgtttactttaacctttacgtttaccgtcgttaacctttaacggtttttaaacccttttaaacgggttacccggtacccttaccccgtttaacgttttacccgggtttccggggttttttagggttccccgggggacggttaaccgggaacccgttaaaccggttacggttacccgggtacccgttcccggttacggacccgtacccggacccgtaccgggcccttccccggtacccccgttagtccctacccgttcccgttcccccg

SEQ ID NO: 130331 - DNA, 634 bp, Homo sapiens
  misc_feature: GYAE6OF01CZUD0.22.36.D03.1.454.CMB.1.raw
  modified_base (207)..(207): a, c, t, g, unknown or other
  misc_feature (207)..(207): n is a, c, g, or t
  modified_base (237)..(237): a, c, t, g, unknown or other
  misc_feature (237)..(237): n is a, c, g, or t
  modified_base (252)..(252): a, c, t, g, unknown or other
  misc_feature (252)..(252): n is a, c, g, or t
tcagacatacgcgtcacgaccggtgctcgatttagctgcgtcacgatctctcgttggggggggtctcgaggaggcagcgctcgtcgggacgtctccaccatggcctgggctctgcttattcctcaccttcctcactcgagggcaacgtcgggtccgtcgggcccagtcctcgccctcgacccagccctcgtccctccgtgtcgtagntcatcgtggactagtcatcatctatttccngcacgtggaaccaangtagactgttgttcttgactctgtctcgtacgaaccaacaccaccgacgaacccaaccccatcatctacttagtcggtctactcgtaccgtccgcctagacggtctcactcacgtctactcgagtacgcctactaacgtcgtaccgaacaccgaccgtccctaacctaacctctacgtcgtcggcctacgttagtacggagtcgtacttgttaactctagtctacttattacgtttaagtcgacctacgttcgtcgttcggttcggtaccggtgacggtactaacgggtaccgccgtaccggtccgtacgggacctcccggttaaccgaacggttccctaccccggttccccgtagttccctccccgttcgtttaccccccg

SEQ ID NO: 130332 - DNA, 915 bp, Homo sapiens
  misc_feature: GYAE6OF01DZK6K.22.36.D03.1.454.CMB.1.raw
tcagacatacgcgtcacgaccggtgctcgatttagctgcgtcacgatctctcttggggggggtctcaggaggcagcgctctcgggacgtcctccaccagtcggccgtgggctcgtgtcttacttcctcctaccttcctacacctcgacgggccacggtacgggttccgtccgggccctaggttcgtccgccctaccgaacccgcgtcccgttccgtcccgttccggttcgttccggtacggtacttacctacgttccggttacgggaacctacggttacggtaacttaccgacggttacctttaacctttttccggacggtaccgtaaccgggttaaccggggaaaaccctaaacgtacgggttacggtaaccgtttaggggtttttaccggggttttctttttaaccgggtaccctttcggttttccgtttcccgttaacccggtttaaccggtaaaaccctaaaaccgaaaaccccgtacccggaacggtaaccccttaaaaccccctacccccgtacttactacctttacgttaaagtttcggtggttaccgttcctaccggttccggtacccgtacctacggtaacgggttccttccttcctacgtaccgttcgttcccttcgtacgtacggtcctaacgtacgtcgacgaccacggtcccgaccctaccgtactctccgtcggtccgtactcgttaggtcgacgtacgtcttacttacttcgttactcgttacttaaccgttttaactaacgtcggtcctaccgttacgttccggtttcgggttcgggttccgaaccgggtacgtacccgtacgtaacggttcccgttaccgttccggaccggtaccacccggtaccccgtaacgttcccgtcccccggtacccgttccggtccttcccggtttccccgg

SEQ ID NO: 130333 - DNA, 692 bp, Homo sapiens
  misc_feature: GYAE6OF01APH5J.22.36.D03.1.454.CMB.1.raw
  modified_base (231)..(231): a, c, t, g, unknown or other
  misc_feature (231)..(231): n is a, c, g, or t
  modified_base (676)..(676): a, c, t, g, unknown or other
  misc_feature (676)..(676): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctattcctgcactgggaccaangtgactagttcgggttctttcgactcgttcgtcctccgtacggtaaccaaccaaccacccacggaccccaaaccccccatccattctatttagtcggtacgtctaccgttccgtccgtccctacggtaggtacgtccttaccgtctacgttccgtacttccgtacgtacggtcctaaccgtaacgtcgtacggtaccgaaaccgtacccggtccccttaaccctaaaccgtccttaccgttcgtaccgggtccttccgtacggtttacggacggtacgtacgttacttacttacttacgtcgtacgttacgtttaacttaacggttcgaccgtacctacgtttccgttacggtttcgggtttcggaccggtacggacgtaccggtacgtcggtacccgtccgttggccggtacgacccggtacgtcctcccgtcccgtcgttccnccgttcggttaccccg

SEQ ID NO: 130334 - DNA, 824 bp, Homo sapiens
  misc_feature: GYAE6OF01AC99R.22.36.D03.1.454.CMB.1.raw
  modified_base (239)..(239): a, c, t, g, unknown or other
  misc_feature (239)..(239): n is a, c, g, or t
  modified_base (777)..(777): a, c, t, g, unknown or other
  misc_feature (777)..(777): n is a, c, g, or t
  modified_base (798)..(798): a, c, t, g, unknown or other
  misc_feature (798)..(798): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacgagggtcctgggcccagtcctcgccctgacccctagccctgccccttccggtcgtcctgggactccgattccgtggacaggtcgatcagtcacttttccngacctcgtacggggaaccctaaacgtggtacggaacctaggttttacgggttctttttacggaaccttcgttcggtaccttccgttacgggttaacccaaaacctaaccaaccccgtaacgggtaccccctaaaaaccccccccaacttaccaacctacgtaaaccttttacgtacgggtccgttacctaccgttacccggttcccggaccccttaccggtaacggtaccgttaccgttaccgttaccctaacgttccggtcctttaccgtccggtacggttacctaccgtaaacgttcccgttacgggaacctaacccggacccggttaccccctaacccttaaccctaacgttcccttaccggtcgggtacccgttacccgtaggttttaacggacgggtaaccggtcgttacctaacgtttactaccgtcgtacgttactttaccgttaacttaccggtacgtacctacgttccgttcgtttacggttcgggtacggtacgccgtaacgtaacgtcggtacccgtctacgggtcnccgtaccgtacgcccgtaccncccgtagtccctacgtccgttcccgg

SEQ ID NO: 130335 - DNA, 822 bp, Homo sapiens
  misc_feature: GYAE6OF01CMNZC.22.36.D03.1.454.CMB.1.raw
  modified_base (174)..(174): a, c, t, g, unknown or other
  misc_feature (174)..(174): n is a, c, g, or t
  modified_base (259)..(259): a, c, t, g, unknown or other
  misc_feature (259)..(259): n is a, c, g, or t
tcagacatacgcgtcacgaccggtgctcgatttagctgcgtcacgatctctcgttggggggggtctcgaggaggcagcgctctcgggacgtctccaccatggcctgggctctgctattcctctaccttcctcactcgacgggcacgacgggtccgtcgggcccagtctcgcccncgaccagcctcgcctcgtgtcgtggactcactcgtacggacaggtcactcagtcttcttcctgactacggacgggaaccaaacgnggtacgtacgttaggttttgggtttccttttacggtaccttcgttcgttcccgttaccgtaaccggtaaaccaaaccgaaacccgaccccgaaccggaaacccccaaaacccccctatacctaacttactaactttacgtcggtactcctaccgtcggtaccggtacctaggtacggtaccttcttacctacgtacgtccttcgttacaccggtacgtcctacgtacggttcacggacctaaccggacccgtacccttaccgaactcgttaccgtcgtacgtccttagttacggtacggacgttacgtacgttaccttacgttactacgtacgttaactttaacgtttaaaccgttaagggttccaaccgttaccggtttaaccgttcgggtttaccggggtttacgggttaccgggaccgggtacgttaaacccggtaccgggtaccggtttaaccggtccccggttacgttacccggtaacgacccccgggacggtaaccggttccccgtaccccggttaccccgtaaggtcccctttaacccggtcccgtttaccccccg

SEQ ID NO: 130336 - DNA, 692 bp, Homo sapiens
  misc_feature: GYAE6OF01C64J1.22.36.D03.1.454.CMB.1.raw
  modified_base (226)..(226): a, c, t, g, unknown or other
  misc_feature (226)..(226): n is a, c, g, or t
  modified_base (359)..(359): a, c, t, g, unknown or other
  misc_feature (359)..(359): n is a, c, g, or t
  modified_base (387)..(387): a, c, t, g, unknown or other
  misc_feature (387)..(387): n is a, c, g, or t
tcagacatacgcgtcacgaccggtgctcgatttagctgcgtcacgatctctcgttggggggggtctcaggaggcagcgctctcgggacgtctccaccatggcctgggctctgctattcctcaccttcctcactcagggcacgagggtcctgggcccagtcctgccctgacccagcctgcctccgtgtctggactcatcgtggacagtcgactcagctacttttccngcaccgtgggaaccaacgtaggtgactagtttgggttcttttgacttcgtcgttcctcgtacgtaaccaacaaccacccacgaccccaaacccccatacactactatttagcgtctccacgtcgtcccgtccngacggtctcgtcctcacgtcgtcttccncgacggtcctcgtagtcgtacgaccaaccgaccgtccctacccaactctccgtcgtaccgggtccttacggttacgttacggaacgtcgtacttacgttacttacgttcgtacgtaccgtttagtttaaccgtttaaaggttccggacctccttaaccgtttcgttcgggtttacgggtttccgggaccggacggttcccgaacgggttacctaccggacccggtttcccgtccggacgtccggaacccgtacggtcccgtccccggtaccccgttgtaccccgttccttcccggttacccccgg

SEQ ID NO: 130337 - DNA, 727 bp, Homo sapiens
  misc_feature: GYAE6OF01CNQVG.22.36.D03.1.454.CMB.1.raw
  modified_base (236)..(236): a, c, t, g, unknown or other
  misc_feature (236)..(236): n is a, c, g, or t
  modified_base (310)..(310): a, c, t, g, unknown or other
  misc_feature (310)..(310): n is a, c, g, or t
tcagacatacgcgtcacgaccggtgctcgatttagctgcgtcacgatctctcgttggggggggtctcaggaggcagcgctctcgggacgtctccaccatggcctgggctctgctattcctcaccttcctcactcagggcacagggtcctgggcccagtctgccctgacccagcctgcctccgtgtctggactcatctggacagtcgatcagctatttcctgcacgtgggaccaacngtgactagttggttcttttgactctgtctcctggtaaccaacaacaccagccaaacccccaatcatcatttagnggtcgtcactccgcggccctcgaaggactctctcactcgcttctcacggtcctaccgaagtccgtggaccaaaccgaccgggtaccccttaccctaaaccctacttccgtaccggttcgggtacccttacccgttaaggttttacgggaaacgggtaaccggttaacgggttacctttaaaccgttttaacgttaccgttacggtaccttaaacggtttttaaccctttttaaaaggttaccgggtaccgtaccctaaccgtttccgttacggggttttcgggttttaccggggacgggtacggtaccgtaaccgggtaacggtcgttacccggttccgtccgggtaccaccgggtaccccgaaagggcccttaccccgggtacccccttcggtaccctccgttcccgttacccccg

SEQ ID NO: 130338 - DNA, 788 bp, Homo sapiens
  misc_feature: GYAE6OF01CCBZW.22.36.D03.1.454.CMB.1.raw
tcagacatacgcgtcacgaccggtgctcgatttagctgcgtcacgatctctcgttggggggggtctcaggaggcagcgctcgtcgggacgtctccaccatggcctgggctctgctattcctcaccttcctcactcgagggcacgagggtcctgggcccagtcctcgccctcgacccagtcctcgccgtccgtgtcttggctcatcgtggacaggtcgatcagcttactttcctgacacgtacgggaccaagagtagactagttcggttctttcgtacttctcgttcctccgtacgtaaccaaccaaccacccgacggaccccaaacccccatccacttctagtttagtcggtacgtcctacgtccggtccgcctacgacggtactcctcgtctacgtccgtcttctccgtacgtcctaccgtaacgtccgtacggaccctaaccgtaccgtacccccttaccctaaccgtacctccgttccggtccggttaccctcccggttagttacgggaacggtaccgtacgttacctttaaccgttacttaccgttacgttacgtttaaccgtttttaacgtttaacgttacgggtcccttacccgttaccgtttaccggttccgggttttacggggttttacccgggacggggttaccgtaccgggtaaaccggtaaccggttacccggtacccggtttccggtaccggtacccgtccggtaaccccggtaccgggtcccgttaacccggttcccccggttacgttcccgtccgtttaccccgtttcccccgg

SEQ ID NO: 130339 - DNA, 765 bp, Homo sapiens
  misc_feature: GYAE6OF01DM7P8.22.36.D03.1.454.CMB.1.raw
  modified_base (218)..(218): a, c, t, g, unknown or other
  misc_feature (218)..(218): n is a, c, g, or t
  modified_base (234)..(234): a, c, t, g, unknown or other
  misc_feature (234)..(234): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcacgtgggaccaacngtgactagttggtcttttgactctgtctcctggtacaacacaccagccaaacccccactcatctattatgtgtcactcgtccgcctcgagcgtctctctatcgtcttctcgacggtcctacctaagtcctcggaccaaccgtacccgggtaccccttacccctaaaccgtcttcccgttccgttaccggacctttccccgttaggttttacggaacgggtaaaccggtacgtttaccgtttaaacctttacgtttaaccgtcgttacccgtttaaccgttttttaacccgttttaaaaacgtttccgggacccgttaccccgttaacccgtttccgttaccggggtttttacgggtttttcccggggaccggggtaacgggtaccccggttaaaccgggtaccgggttacggaacccccggtttcccggtacccgggttaccgaacccgggtacccccgtaacgggttccccgttcccgggttccccccccgttagggttacccctccgtttccccgtttacccccccggg

SEQ ID NO: 130340 - DNA, 609 bp, Homo sapiens
  misc_feature: GYAE6OF01ETSGS.22.36.D03.1.454.CMB.1.raw
  modified_base (219)..(219): a, c, t, g, unknown or other
  misc_feature (219)..(219): n is a, c, g, or t
  modified_base (359)..(359): a, c, t, g, unknown or other
  misc_feature (359)..(359): n is a, c, g, or t
tcagacatacgcgtcacgaccggtgctcgatttagctgcgtcacgatctctcgttgggggggggtctcaggaggcagcgctctcgggacgtctccaccatggcctgggctctgctattcctcaccttcctcactcagggcacaggtcctgggcccagtctgccctgacccagcctgcctccgtgtctggatcatctggacagtcgatcagctatttccngcactacgggaccaacagtgactagttgggttcttttgacttctgtctcctgtaccaacaaccaccgacgacccaaacccccactcactctatttagtggtctcacgtcgtcgcctcaggtactcctctcatcgtcttcncacgtctactagtcgtcgacaaccgtaccgccctaccctaactcttcgtcgtcggtctcgtagttggacggtacgtatcttaacttacgttactcgtacttaactttacttaagtcgcacctcttcgttcggttcggtttccggacggtacgaccggtaccgtaggtaccgtaccggttccggtacgtaccgacgtacccgaacggcccgttacccgtcccccgtacggtcccttccgtccgttaccccg

SEQ ID NO: 130341 - DNA, 780 bp, Homo sapiens
  misc_feature: GYAE6OF01CGJ5T.22.36.D03.1.454.CMB.1.raw
  modified_base (219)..(219): a, c, t, g, unknown or other
  misc_feature (219)..(219): n is a, c, g, or t
  modified_base (237)..(237): a, c, t, g, unknown or other
  misc_feature (237)..(237): n is a, c, g, or t
tcagacatacgcgtcacgaccggtgctcgatttagctgcgtcacgatctctcgttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngccacgtcgggaccaacngtagactagttgggttcttttagacttcgtcgtctcctacggtaaccaacaaccacccgacgaccccaaaccccccatcactactatttagcggtctactaccgttcgtcccggcctacgtacggtacgtcctctcgtacgttccgtctttccacgaccggtacttacccgtaacgttccgtacgggaacccaacccgtacccggtacccccttacccctaaacctaccttcccgttccggtaccgggtcccttaccggttaacggtttacggacgggtaacctacgttttaacccttacgttttaacgtaccgtacgtttactttaacgttttaaccctttaaacggtcggtaccctcccgttactttacccggttcggggttttaccggggtttccgggacggggtaaccggtacccgtaaccgggttacgtacccgggtacccggttacccgtttcgggacccgtacccggtacccggaaccgggttcccgtaccccgggtccccgttaccgggtccctcggtttccccgttaccccggg

SEQ ID NO: 130342 - DNA, 840 bp, Homo sapiens
  misc_feature: GYAE6OF01A0Z2J.22.36.D03.1.454.CMB.1.raw
  modified_base (227)..(227): a, c, t, g, unknown or other
  misc_feature (227)..(227): n is a, c, g, or t
tcagacatacgcgtcacgaccggtgctcgatttagctgcgtcacgatctctcgttggggggggtctcaggaggcagcgctctcgggacgtctccaccatggcctgggctctgctattcctcaccttcctcactcagggcacgacgggtcctgggcccagtctcgccctgacccagcctcgccctcgtgtctggatcatcgtggacagtcgatcagtctactttccgngacctacgtacggaaccaagtagtcgtactaggtttgggttcttttacgacttcgttacgttccgttaccgtaccggtaaaccctaaaccgaaaccccgaccccggtaaacccggaaccccccctaaaacccccccctaatacctaacttacttacttttaacggtcgggttacttaccgtaccggttcccggtacccggtcccctaggtaacggtaccgttccctaccgtaacctcgttcccgttccttaccgtaccgtaacggttcccttaaccggtaaccggttccgaccggtaaccctaacccgggtccccgtacccccttaacccgtaacctccgttccgttccggtaccggtacccgttacgttacgggttacggacggtaaccggttacgttacgttacttaacgttacgtacgtaacgtttacgtttaaccgtttaacgttaccggtacctcccgttacgttccggtttcggtttacgggttaccgggacggtaccggtaccgtacggtaccggtaccgtacccggtccgtaccgaccggtaccggaaccgtccggtaccgtccccggtaccgtaccccccgtgttcccgttccggttacccccg

SEQ ID NO: 130343 - DNA, 689 bp, Homo sapiens
  misc_feature: GYAE6OF01CN00K.22.36.D03.1.454.CMB.1.raw
  modified_base (218)..(218): a, c, t, g, unknown or other
  misc_feature (218)..(218): n is a, c, g, or t
  modified_base (233)..(233): a, c, t, g, unknown or other
  misc_feature (233)..(233): n is a, c, g, or t
  modified_base (314)..(314): a, c, t, g, unknown or other
  misc_feature (314)..(314): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctcgccctgacccagcctgcctccgtgtctggatcatctggacagtcgatcagcatttccngcactgggaccaacngtgactagttgggtcttttgactctgtcctcctggtaccaacaaccaccgaggaccaaaccccccaactcattcattttanggtcgtcactcgtccgccctcaggacgtctctcactcgtcttctcagcctcaacgtctcgacaccgaccggtcctaccctaaccgtacttccgtcttacgggtccttcccgttaggtttcggaacgggtaccgtacgttaccgtttactttaacgtttaccttacggtaccttacgttttaacccttttaaagttccggtaccgtccctacctttcggttaccggtttagggttttcccggacgggtacggtccgtaaccggaggttccggtaacccggttcccgttccgggtaccctacggtacccccggtaaaggtccccgttcccgggtacccccgttccgggttcccttacccgttcccgtttcccccggg

SEQ ID NO: 130344 - DNA, 672 bp, Homo sapiens
  misc_feature: GYAE6OF01B8IMH.22.36.D03.1.454.CMB.1.raw
  modified_base (217)..(217): a, c, t, g, unknown or other
  misc_feature (217)..(217): n is a, c, g, or t
  modified_base (232)..(232): a, c, t, g, unknown or other
  misc_feature (232)..(232): n is a, c, g, or t
  modified_base (235)..(235): a, c, t, g, unknown or other
  misc_feature (235)..(235): n is a, c, g, or t
  modified_base (492)..(492): a, c, t, g, unknown or other
  misc_feature (492)..(492): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgaccagcctgcctccgtgtctggatcatctggacagtcgatcagctacttcgnacacgtacggaccanganatagttggttctttagactcgttcgtctcgtacggtaaccaactaaccaccgacggaaccccaaaccccctatactatacttattacgtggtacgtacacgtccgtccgtcctagagtacgtctcgtactacgttccgtcgttccgtcgtacgtcctaacgtacgttcgacgaccaacggtaccgtcctaacccgtaactacgttcctacgtcggtacctcgtagttcggacgtacgtacttacttacttagttacngtaacgtttacgttaaccgtttaagtaccgtctaccgtacttcgttcgggtttcggttcgggacggtacgccgtaacggttcggtaccggtacccgttcggttaccggtacgtacccggtaaccgaccggtccgttccccggtaccccggttagtacccgttccgttcccgttaccccgg

SEQ ID NO: 130345 - DNA, 662 bp, Homo sapiens
  misc_feature: GYAE6OF01EX4M3.22.36.D03.1.454.CMB.1.raw
  modified_base (217)..(217): a, c, t, g, unknown or other
  misc_feature (217)..(217): n is a, c, g, or t
  modified_base (233)..(233): a, c, t, g, unknown or other
  misc_feature (233)..(233): n is a, c, g, or t
  modified_base (338)..(338): a, c, t, g, unknown or other
  misc_feature (338)..(338): n is a, c, g, or t
tcagacatacgcgtcacgaccggtgctcgatttagctgcgtcacgatctctcttgggggggtctcaggaggcagcgctctcgggacgtctccgaccatggcctgggctctgctattcctcaccttcctcactcagggcacagggtcctgggcccagtctgccctgacccagcctgcctcgtgtctggatcatctggacagtcgatcagctatttccngcacgtggaccaacgngtgactagtttcgggtcttttgacttctgtctccgtggtaccaaacaacacccaggaccaaaaccccccatcactcatttagtggtctcactcgtcgcctcaggngtctctacacgtcgcttctacgacggtcctaccaagttcctaggacaaccgaccggtccctaacccctaacacttctacgtgggtccttcgtagtttacgacgggtacgtacgttacttaacgtttattacgttcgacttacgtttaccgtttaaacgttacggtacccgtacctaccgttccgttcggtttacggtttccgggacgggtacggacgtaccggtaacggtcgtaacccggttccggtaccggttaccgaccggacccgtaacgggtcctacccggtcccccgttaccggtcccttacccgtccggttaccccgg

SEQ ID NO: 130346 - DNA, 630 bp, Homo sapiens
  misc_feature: GYAE6OF01C6VZN.22.36.D03.1.454.CMB.1.raw
  modified_base (228)..(228): a, c, t, g, unknown or other
  misc_feature (228)..(228): n is a, c, g, or t
  modified_base (249)..(249): a, c, t, g, unknown or other
  misc_feature (249)..(249): n is a, c, g, or t
tcagacatacgcgtcacgaccggtgctcgatttagctgcgtcacgatctctcgttggggggggtctcaggaggcagcgctcgtcgggacgtctccaccatggcctgggctctgctattcctcaccttcctcactcgagggcacgagggtcctgggccctagtctcgccctgacccagtcctgccctccgtgtctggactcatctggacagtcgatcagtctctttccngcgtacgtaggaccagagtanactaggtttcggttctttgaccttcgtgtcctccgtacgtaaccaacacccaccacgacccctaaacccccatcactctagttcgtggtctactcgtcgccgtcctacgaggtctctctactacgtcgtacttctcgtagtccaccgtagtcgtacgactaacgccgtaccttacccaacgtctccgtcgtcggccttcgtacgttcgaacggtcgtacttcttaacttacgtacgttgtacttaaccgtttacttaaacgtcgtaccgccttacgttcggttcgtttcggttaccgggcggtaccgcgtaaccgagttccgccggtacctgccgtaccgtccgtacgcccgtccgtcccgagttcctccgtcgttacccg

SEQ ID NO: 130347 - DNA, 720 bp, Homo sapiens
  misc_feature: GYAE6OF01A23MM.22.36.D03.1.454.CMB.1.raw
  modified_base (262)..(262): a, c, t, g, unknown or other
  misc_feature (262)..(262): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctactttcctgccactcggggaaccaacagtgactagttgggtcttttgactntgtctctgtaccaacaacacccaggaccaaacccccatcactcatttagtgtctcactccgtccgccctcaggagtcctctcatccgtcttctcacggtcctaccgtaacgtccgtacggaccaaaccgtaccggtcccttaacccctaaaccctacttcccgttccgtccgggtcccttacccgtaacggttttacggaacgggtaaccgtaacggtttacctttaacgttttaactttacgttaccggtacgttaacgttttaaccttttaaaagtttcggtacccgtacccgtaccgtttccgttcgggtttcgggttttccgggacgggtaccggtaccggtaacccggtacggtaccggtacccggttccgtaccgggtaccgtaccggaccccgtaacgggtcccgtacccgtacccccggttccggtaccctacccgttccgttacccccg

SEQ ID NO: 130348 - DNA, 261 bp, Homo sapiens
  misc_feature: GYAE6OF01AOJHO.22.36.D03.1.454.CMB.1.raw
  modified_base (105)..(105): a, c, t, g, unknown or other
  misc_feature (105)..(105): n is a, c, g, or t
  modified_base (162)..(162): a, c, t, g, unknown or other
  misc_feature (162)..(162): n is a, c, g, or t
  modified_base (206)..(206): a, c, t, g, unknown or other
  misc_feature (206)..(206): n is a, c, g, or t
  modified_base (224)..(224): a, c, t, g, unknown or other
  misc_feature (224)..(224): n is a, c, g, or t
  modified_base (230)..(261): a, c, t, g, unknown or other
  misc_feature (230)..(261): n is a, c, g, or t
tcagacatacgcgtcacgaccggtgctcgatttagctgcgtcacgatcgtctctgggctccagtttgaggacgagtctacttattactgcagttccttaaatgcnccactctcgtggtttcgcgaggcacgaagtgaccgtcctcggtcagcccaaggctcnccccctggtcactctcgttcccgccctacctcacgcgtatgtcngagcgggctggcaaggcncatagnnnnnnnnnnnnnnnnnnnnnnnnnnnnnnnn

SEQ ID NO: 130349 - DNA, 944 bp, Homo sapiens
  misc_feature: GYAE6OF01E00IA.22.36.D03.1.454.CMB.1.raw
tcagacatacgcgtcacgaccggtgctcgatttagctgcgtcacgatctctcgttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctactttcctgccacgtcgggaaccaaacaggtgaactagtttcggggtttcttttaggaccttcgttcgttccttcccgttacggtaaacccaaaacctaaaccaaccccgaacggaacccccaaaaacccccccctaactacctaacttactaacttttacgtcgggttacgtaccgtaaccgttccgtcccggtccctacggtaacggtacgttaccttctactacttccgtctttcctacgacgtcctaccaacggtttccgcggtaaccaaaccgtacccgggttacccccttaaccccgtaaacctaccgtttcccgttaccggttaccgggtacccctttaccggttaacgggttttacgggaacgggttaaccggttaaccgtttacctttaaaccgtttttaaccgtttaaccgttaccggttaaccgttttaacccggttttttaaaccgttttaaaacggtccgggttaacccgtaccccgttaaccggttttccgggtttaccgggtttttacgggtttcccggggtaccggggtaaccggtaacccggttaaacccgggttaacggttacccgggttaacccccgggttcccggtttacccgggtacccggtaaaccccggttacccccggtaaaccggggttcccccgtttacccccgggtttacccccccggttacccggtcccttttaaccccggttccccgttttaacccccccggg

SEQ ID NO: 130350 - DNA, 646 bp, Homo sapiens
  misc_feature: GYAE6OF01A61M6.22.36.D03.1.454.CMB.1.raw
  modified_base (173)..(173): a, c, t, g, unknown or other
  misc_feature (173)..(173): n is a, c, g, or t
  modified_base (223)..(223): a, c, t, g, unknown or other
  misc_feature (223)..(223): n is a, c, g, or t
  modified_base (335)..(335): a, c, t, g, unknown or other
  misc_feature (335)..(335): n is a, c, g, or t
  modified_base (370)..(370): a, c, t, g, unknown or other
  misc_feature (370)..(370): n is a, c, g, or t
tcagacatacgcgtcacgaccggtgctcgatttagctgcgtcacgatctctcgttggggggggtctcaggaggcagcgctctcgggacgtctccaccatggcctgggctctgctattcctcaccttcctcactcagggcacgagggtcctcgggcccagtctcgccctgaccngcctgcctccgtgtctggatcatcgtggacaggtcgatcagctactttcngcacgtacggaaccaacgagtagactagtttcggttctttgacttctcggtcctcgtacggtaaccaacaaccaccgacgaccccaaacccccatcattactatttagtgtntaccacgtcgtccgcctacgacggtatcctctacncttccgtcttcctcgacggtcctacgaacgtccgtacggtaccaacgacccggtaccctaaccctaacctacgttaccgtacgttcggtacctccgtaggttacggacgtacgtacgttactttacgttattccgtactcgttaacgtttacttaacgtccgtcgtacctcttcgttcggttcggttcggacggtacgtacgagtaccgtcgacccgtcgttcgacgtcgacccgacgtcccgtccgtacccgttcggacctcggttccttccccg

SEQ ID NO: 130351 - DNA, 891 bp, Homo sapiens
  misc_feature: GYAE6OF01BOZC8.22.36.D03.1.454.CMB.1.raw
  modified_base (223)..(223): a, c, t, g, unknown or other
  misc_feature (223)..(223): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcgagggcacagggtcctgggcccagtctgccctgacccagcctgcctccgtgtctggactcatcgtggacagtcgatcgagtctatttccngacacgtcgggacctaacgagtgactaggttcggttcttttgacttcgttcgttccgtccgttacggtaacccaaacgaacctaccccggaacggtaacccccctaaaaaccccccccctaagtcctaacttaccttaacgtttttagtacggggttcttacccgtaaccgttcccggttacccgggtcccttaacggaacggggttacttcccgttacctcgttaaccgttcccggttacctttccgtaccggtaaccgggtcccttacccggtaaacgggtttcccgttaccgggaaacccgtaaacccgtaaccccgggttaccccttaacccccggtaaaaccttaccgtttcccggttccgggttcccgggtaaccctttccccggtaaagggttttccgggaaacggttaccggttacgtttaaccctttaaaccggtttaactttaccggtacgttaccgtttaacgttttaacccgttttaaaacggtccggacccgttaccgttaccgtttcggttttaccgggtttcggggttttacccggacggtaccggttaacgtaaccggtacggttaccgtaccggtccccggttaggaccgtcccgggaccgtaggtcccgtcccgtaccccgttaggtcccctacgtttcccgtaaccccg

SEQ ID NO: 130352 - DNA, 724 bp, Homo sapiens
  misc_feature: GYAE6OF01EJH4P.22.36.D03.1.454.CMB.1.raw
  modified_base (306)..(306): a, c, t, g, unknown or other
  misc_feature (306)..(306): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcacgtgggaccaacagtgacagttgggtctttgactctgtctctgtaccaacaacaccagaccaaaccccccatcatcattatggtntcactcgtcgcctcgaggatctctcatcgcttctcaggtctccaagtcgacggacaaaccgacggtccctaccctaaaccacttcctacgtcgggccttccgtagtttgacggtacgtagttacttaacttacttaactcgtacttaacgtttacctttaaagttcggaccgtaccctacgttaccgttcgggtttacgggttttccgggacgggtaacgggtaccgtaaccccgggtaaaggttaccggttaaccccgggttaccccggttaccggggttacccgtaaacccggggtaacccccccggttaaaacgggggtcccccccgtttaacccggggtacccccccccccgggttttaacccggggtttccccgttaaaccccggtttcccccggtttttaacccccccgggg

SEQ ID NO: 130353 - DNA, 803 bp, Homo sapiens
  misc_feature: GYAE6OF01A8IMY.22.36.D03.1.454.CMB.1.raw
  modified_base (217)..(217): a, c, t, g, unknown or other
  misc_feature (217)..(217): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacagtgactagttggtctttgactctgtctcctgtaccaacacaccagacccaacccccactcatctattatggtctctactcgtccgtccctcgagtacgtctctcatccgtcttcgtcgacgtctaccgaacgtcgtcgacctaacgtacccggtaccccttacccgtaaccctcttaccgttccgtacgggtacccttaccggttacggtttacggacgggtaaccgttacgtttaaccgttacgtttaacgttacgttacgtacctttaacggtttttaacccgttttaaacgttaccgggtaccccgttacccttaccgtttacccggtttccgggttttaccggggttttacccggggaccggggttaacgggtaccccggtaaaccggggttaacccgggtttacccggttaacccccgggtttcccggttaccccggggttaacccggtaacccgggttaacccccccggtaacggggttaccccccgtttacccccgggtacccccccgggtttaccccgggttaaccccgttaccccgtttcccccggtttaaaccccccccgg

SEQ ID NO: 130354 - DNA, 549 bp, Homo sapiens
  misc_feature: GYAE6OF01E1GDG.22.36.D03.1.454.CMB.1.raw
  modified_base (217)..(217): a, c, t, g, unknown or other
  misc_feature (217)..(217): n is a, c, g, or t
  modified_base (297)..(297): a, c, t, g, unknown or other
  misc_feature (297)..(297): n is a, c, g, or t
  modified_base (402)..(402): a, c, t, g, unknown or other
  misc_feature (402)..(402): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactggaccaacagtgacattggtctttgactctgtctctgtacaacagcaccaggcaagccccagactcatcatttangctgtacaataacgcggccctcgacgggtcctgatcgcttctctggctccgaagtctggccaacaccgcctccctgaccatctctacgggctccgaggctggaanatgaggctgtattatctagctgtctctaatttcgactaggccgtcccgttaacgacgttttcggggtcggtttacgggaccgggtaacgggaccgtaaggtccgtacggacccggttaccgtaacgggtccgaacgggtaaccccgg

SEQ ID NO: 130355 - DNA, 602 bp, Homo sapiens
  misc_feature: GYAE6OF01DGFR0.22.36.D03.1.454.CMB.1.raw
  modified_base (113)..(113): a, c, t, g, unknown or other
  misc_feature (113)..(113): n is a, c, g, or t
  modified_base (161)..(161): a, c, t, g, unknown or other
  misc_feature (161)..(161): n is a, c, g, or t
  modified_base (212)..(212): a, c, t, g, unknown or other
  misc_feature (212)..(212): n is a, c, g, or t
  modified_base (223)..(223): a, c, t, g, unknown or other
  misc_feature (223)..(223): n is a, c, g, or t
  modified_base (250)..(250): a, c, t, g, unknown or other
  misc_feature (250)..(250): n is a, c, g, or t
  modified_base (259)..(259): a, c, t, g, unknown or other
  misc_feature (259)..(259): n is a, c, g, or t
  modified_base (351)..(351): a, c, t, g, unknown or other
  misc_feature (351)..(351): n is a, c, g, or t
  modified_base (372)..(372): a, c, t, g, unknown or other
  misc_feature (372)..(372): n is a, c, g, or t
  modified_base (402)..(402): a, c, t, g, unknown or other
  misc_feature (402)..(402): n is a, c, g, or t
  modified_base (424)..(424): a, c, t, g, unknown or other
  misc_feature (424)..(424): n is a, c, g, or t
  modified_base (450)..(450): a, c, t, g, unknown or other
  misc_feature (450)..(450): n is a, c, g, or t
  modified_base (461)..(461): a, c, t, g, unknown or other
  misc_feature (461)..(461): n is a, c, g, or t
  modified_base (469)..(469): a, c, t, g, unknown or other
  misc_feature (469)..(469): n is a, c, g, or t
  modified_base (477)..(477): a, c, t, g, unknown or other
  misc_feature (477)..(477): n is a, c, g, or t
tcagacatacgcgtcacgaccggtgctcgatttagctgcgtcacgatctctcgttggggggggtctcaggaggcagcgctcgtcgggacgtctccaccatggcctgggctctnctcctcctcacgcctctcacgcgaggacacgaggtctccgtggctcgngtctcgcctagctcacgcctcctcgcgtccggtctaccgtggactagcacncacatcctcgngcacacggacagcagtgacgttggttntaactaatntctctactacggaaccaacaccacgacgacaaacctccccaaatcgtatgtaattagaggactacaactaacggcgacctcggaccgggtcngtacgcgtcctttctcgtacncgtacagttccaggaccaacggcgttcccncgttgaccgtcttcgacggtcncgtaacgcgtagaagtagtgggtacngttataacttnttacgagnttcgaatnacgtagggtacagggcaacggtgtattacggtcggttacggaacgggacggtaaaccggaccgtagtccgtaccggttacgtaccggttaggaaccgtacgtaccgttaaccggcgtaaccccgg

SEQ ID NO: 130356 - DNA, 662 bp, Homo sapiens
  misc_feature: GYAE6OF01B2AHU.22.36.D03.1.454.CMB.1.raw
  modified_base (219)..(219): a, c, t, g, unknown or other
  misc_feature (219)..(219): n is a, c, g, or t
  modified_base (316)..(316): a, c, t, g, unknown or other
  misc_feature (316)..(316): n is a, c, g, or t
  modified_base (320)..(320): a, c, t, g, unknown or other
  misc_feature (320)..(320): n is a, c, g, or t
  modified_base (347)..(347): a, c, t, g, unknown or other
  misc_feature (347)..(347): n is a, c, g, or t
tcagacatacgcgtcacgaccggtgctcgatttagctgcgtcacgatctctcgttgggggggtctcaggaggcagcgctcgtcgggacgtctccaccatggcctgggctctgctattcctcaccttcctcactcaggcacgagggtcctgggcccagtctgccctgacccagcctgcctccgtgtctggatcatcgtggacagtcgatcagctattccngcacgtgggaaccaacgagtgactagttgggttcttttgactctgtctcgtagtaaccaacaacaccacggacctaaaccccccatcactctattanggtntcactcttcgcctagaggatctctacntcgtctctcacggtctacgaacgtctaggaccaacgaccggtaccctaccctaacctagtcctctcgggtccctaccgttaggtttacgaacggacgttatacctttaatttaacgtactacgatttaacttaacccgttttaaagtaccggacctcccgtaactttcggttacccggtttggggtttaccgggaccggttacggaccgttaaccgacggttacgacccggtaccgttccgtacgacccggtacccgtaaggtccctaccccggttaccccctacgggtccctaaccggttcctttacccccggg

SEQ ID NO: 130357 - DNA, 730 bp, Homo sapiens
  misc_feature: GYAE6OF01AMKDH.22.36.D03.1.454.CMB.1.raw
  modified_base (216)..(216): a, c, t, g, unknown or other
  misc_feature (216)..(216): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcacgtgggaccaacagtgactagttgggttcttttgacttcgttgtcctccgtacggtaaccaacaaccaccccacggaccccaaaacccccccatccactacctatttacgtcggttcgtacctaccgttccgtccggcccctacgtagggtacgttcctcgtctacgtccgtactttccgtacgacggtcctaccgtaacggttcctcgggaacctaacccgacccggtccccttaaccccgtaacctacttccgtacgtcgggtccctaccgttaggtttacggacggtaacgtcgttaccgttaacttacgttacgtacgtacgtttacgttttaaccttttaagttccggtacctcccttaccgtttccgttccgggttttcgggttttccgggacgggtacggaccgtaccgtaacggtccggtacccggttcccgtccggtaccgaccggtacccgtaacggtcccgtccccgtccccgttcggtccctccgttcccgttaccccg

SEQ ID NO: 130358 - DNA, 800 bp, Homo sapiens
  misc_feature: GYAE6OF01BZY6N.22.36.D03.1.454.CMB.1.raw
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctcgccctgacccagcctgccctccgtgtctggatcatctggacagtcgatcagctatttcctgcacgtcgggaaccaacgagtagactagtttggttcttttgacttctcgtcctctacggtaaccaacaaccaccacgacccaaaccccccactctactctatttacgtggtcgtccacgttccgtccgccctacgacggtacttctctctactccgtaccttctacgacggtcccttaccgaaggttcctacgggacctaaacccggtacccggtacccccgtttaaccccttaaccctacgtttccccgtacggtaccgggttccccttacccggttaacggtttacgggaacgggtaaccggttaccgttaccctttaacgtttaactttacccgtacgttaaccgttttaaccgtttttaaccttttaaacggttccggtacccgttaccccgtaccgtttccgtttaccggggttttgggttttacccggggaccggggtaaccggttacccggtaaccgggtacggttacccggtaccccggttccgttacccgggtcgaccccgggtacccgtaaccgggtcccgttccccgttacccccggtaccgttcccctccgttcccgtttaccccccg

SEQ ID NO: 130359 - DNA, 672 bp, Homo sapiens
  misc_feature: GYAE6OF01D44LP.22.36.D03.1.454.CMB.1.raw
  modified_base (220)..(220): a, c, t, g, unknown or other
  misc_feature (220)..(220): n is a, c, g, or t
  modified_base (321)..(321): a, c, t, g, unknown or other
  misc_feature (321)..(321): n is a, c, g, or t
  modified_base (327)..(327): a, c, t, g, unknown or other
  misc_feature (327)..(327): n is a, c, g, or t
tcagacatacgcgtcacgaccggtgctcgatttagctgcgtcacgatctctcgttggggggggtctcaggaggcagcgctctcgggacgtctccaccatggcctgggctctgctattcctcaccttcctcactcagggcacagggtcctgggcccagtctcgccctgacccagcctgcctccgtgtctggatcatctggacagtcgatcagctatttccngctacgtagggaccaacgagtcgactagttgggttcttttgacttctcgtctcctacgtaaccaacaaccaccgacgacccaaaccccctatcatctattntcggtntctacgtccgtcgcctcgaggtctctctcacgtcgtcttctacgcgtcctactaagtctcgaaccaaccgaccgtccctaccctaacgtacttccgtcgtcggtacttacgttagtttacggacggacgttacgttaccttaactttattaccgttcgtacgtttacgttttaacttaaacgttcggtacccgtaccttacgttcgtttacggtttcgggtttaccgggcggtaacggtccgtaacggtacggttaccgtaccccggttccgttaccggtctaacccggacccgtaacggtcccgtacccgtccccgttcggtcccttaccgttccgttccccgg

SEQ ID NO: 130360 - DNA, 818 bp, Homo sapiens
  misc_feature: GYAE6OF01DTCNW.22.36.D03.1.454.CMB.1.raw
tcagacatacgcgtcacgaccggtgctcgatttagctgcgtcacgatctctcgttggggggggtctcaggaggcagcgctctcgggacgtctccaccatggcctgggctctgctattcctcaccttcctcactcgagggcacgagggtcctcgggcccagtctcgccctcgacccagcctcgcctcgtgtctggactcatcgtcggactacgtcgatcgagtccttacttttccgtgccgtaccggtacggggaacccaaacgtaggtacggtacttaggttttcggggtttactttttcggactttcgttcgttccttaccggttacggtaaccaaaaccaacccgaccccgaaaccggaaccccctaaaaaccccccctaatacctaacgttacctttaagttttacggttaccggttacgtacctaaccggttccggttacccgggtaccctaacggtacggttaccttcttccgtaccgtacgttccgtccctttaccgcgtacggtacccttacgtaacggtccgtacggactaacccgtacccggtccccttaacccgtactcgttccgtacgttcggtaccttacggttaggtacggtacggtacgttcgtttaccttacgtttaacctcgtgttacttaacgttttaaccgttaagtcggtacctaccgtccgtttacggttcgggtttacggttacggggtacggacggtaccgtacggtacggttcccgtaccggttccgaaccggtcgaccggtccgtacggtccccgtaccggtacccgttccggtcctcccgttccgttccccgg

SEQ ID NO: 130361 - DNA, 723 bp, Homo sapiens
  misc_feature: GYAE6OF01BS25N.22.36.D03.1.454.CMB.1.raw
  modified_base (218)..(218): a, c, t, g, unknown or other
  misc_feature (218)..(218): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcacgtcgggaccaacgagtgactagttgggttcttttgacttctcgtctccgtggtaaccaacaaccacccgacggacccaaaccccccaactcactactatttacgtggtctactactcgtccggtccctcgaggtacgtctctcatccgtcttctcgacggtctaccgtaagtcgtcggaccaaccgtaccggtcccctacccctaaccacttccctcggtcgggtccttacccgtaggtttcggacggtaccgtacgttacctttaactttacgttacttcgtactttacgtttaacccgttttaaagttcgggtacccttacccgtaccgttaccggtttccgggtttacgggttttcccgggacgggtaaccggtaccgtaaccgggtaacggttaccggtaccccggttaccgttccgggtaccgtacccggacccggtaacggtcccgttacccggtaccccccgttaggttcccctaccgttcccgttcccccggg

SEQ ID NO: 130362 - DNA, 696 bp, Homo sapiens
  misc_feature: GYAE6OF01BSLKK.22.36.D03.1.454.CMB.1.raw
  modified_base (124)..(124): a, c, t, g, unknown or other
  misc_feature (124)..(124): n is a, c, g, or t
  modified_base (253)..(253): a, c, t, g, unknown or other
  misc_feature (253)..(253): n is a, c, g, or t
tcagacatacgcgtcacgaccggtgctcgatttagctgcgtcacgagtcgtctcgttggggggggtcctcaggaggcagcgcttctcgggacgtctccaccatggcctgggctctgctattccncaccttcctcactcgagggcacgagggtccttgggcccagttctgtcccttagacccagcctgcctccgtgtctggatcgagtcgtggacacgtcgagtcagctactttcctgactacgtcggaccaangtagactagttcggttctttgacttcgtacgtccgttaccgttacggtaaccaaccaaccgtaccccggaacggacccccaaaaccccccgtatccgtacgttacgtaacgttttaacgttacgggttacgtaccgacggtttcccggtccggtaccccttaggaacgggtacgttcctaccgtacaacgttccggacttcgacgtacggtcctaccgtaacgtcgtacgacgtaccgacgtccctaacctacactctcgtcgtctcgtagttacgacggaacgtacgtactactttacgtacttcgtacgtacgtttaccttaacgtcgacctaccgtacttcttcggttcggtttacgcggtacgcgaccgtacgtcgtcgtcgtccggactcggacccgtaacgcccgttaccggccccgttaggccctcgtccttcccg

SEQ ID NO: 130363 - DNA, 610 bp, Homo sapiens
  misc_feature: GYAE6OF01D8AUA.22.36.D03.1.454.CMB.1.raw
  modified_base (221)..(221): a, c, t, g, unknown or other
  misc_feature (221)..(221): n is a, c, g, or t
  modified_base (237)..(237): a, c, t, g, unknown or other
  misc_feature (237)..(237): n is a, c, g, or t
  modified_base (415)..(415): a, c, t, g, unknown or other
  misc_feature (415)..(415): n is a, c, g, or t
tcagacatacgcgtcacgaccggtgctcgatttagctgcgtcacgatctctcgttgggggggtctcaggaggcagcgctctcgggacgtctccaccatggcctgggctctgctattcctcaccttcctcactcagggcacgagggtcctgggcccagtctgccctgacccagcctgcctccgtgtctggatcatcgtggacagtcgatccagctatttccngccacgtgggaccaangtgactagttcggttctttgactctgtcctcctagtaccaacaaccacccgacggacccaaaccccccatcacttactattacgtggtactcaccgtcgtccgtcctacgacggtctctctctacgtccgtcttcgtcgacggcctcgaagtctacggacaacgccgtccaccgtacnctctcggtcgctcgtagtgacggtctagttcttattactcgtgtcttactttacgttaagtcgacctctacgttcgttcgtttcgttcggcggtacgtccgaacggtacgtacgtacccggtccgtcggtaccaccggacccgacggtacccggtcccgtccccgtaggtaccctaccggttcccttaccccggg

SEQ ID NO: 130364 - DNA, 618 bp, Homo sapiens
  misc_feature: GYAE6OF01D5XSZ.22.36.D03.1.454.CMB.1.raw
  modified_base (568)..(568): a, c, t, g, unknown or other
  misc_feature (568)..(568): n is a, c, g, or t
  modified_base (604)..(604): a, c, t, g, unknown or other
  misc_feature (604)..(604): n is a, c, g, or t
tcagacatacgcgtcacgaccggtgctcgatttagctgcgtcacgatctctcgttggggggggtctcaggaggcagcgctctcgggacgtctccaccatggcctgggctctgctattcctcaccttcctcactcagggcacagggtcctgggcccagtctgccctgacccagcctgcctcgtgtctggatcatcgtggacagtcgatcagtctatttcctgcacgtacgggaaccaacgagtagactagtttggttctttgaccttctgtcctcgtacgtaaccaacaccaccacgacccaaacccccatcatctattagtgtcgtcctacgtcgttccgcctgaggtactctctcgtactcgtctctcgtacgcctacgacgtcgacggtaccaacgtaccggtccctaccctaactacttccgtacgtcggtcctacgtagttcggagtacgtattacttacttagtactgtacttaactttacgtttaagccgtaccgtcctacgttccgttaggttcggttcggaggtcgaccgttacggacgtccgtaccgtccgtacggccnccggtacgacggtccctcccggtaccccgtgtcccnccgttccgtccccg

SEQ ID NO: 130365 - DNA, 697 bp, Homo sapiens
  misc_feature: GYAE6OF01EA07T.22.36.D03.1.454.CMB.1.raw
  modified_base (226)..(226): a, c, t, g, unknown or other
  misc_feature (226)..(226): n is a, c, g, or t
  modified_base (245)..(245): a, c, t, g, unknown or other
  misc_feature (245)..(245): n is a, c, g, or t
  modified_base (673)..(673): a, c, t, g, unknown or other
  misc_feature (673)..(673): n is a, c, g, or t
  modified_base (688)..(688): a, c, t, g, unknown or other
  misc_feature (688)..(688): n is a, c, g, or t
tcagacatacgcgtcacgaccggtgctcgatttagctgcgtcacgatctctcttggggggggtctcaggagcagcgctctcgggacgtctccaccatggcctgggctctgctattcctcaccttcctcactcgagggcacagggtcctgggcccagtctcgccctgacccagcctgcctccgtgtctggatccatcgtggactagtccgatcacgtctactttccngccacgtcgggaaccaacnggtagactagtttcgggttcttttagacttcgttcgtcctccgtagtaaccaaccaaccaccgacgacccaacccccatcattctattagtcggtactactacgtcgtacccgtccctagacggtactctacctcacttccgcttcgtacgacggtacctaccgtaacggttcgacggtacctaaaccggtacccgtcccccgttaacccctaacgtcttccgttacgggtaccgttccgttacccgtaagggttttacgaacggtacgttaccgttactttaaccgtttactaacgttccgtaacgtttaaccggttttaaccttaaagtccgggtacctaccgtacgtttccgtaggtttcggtaccggcggaacgtacgtacgtagtcgtacccggtcgtacggacaccgtccgactccgtcccnccgtgtacctccgtnttacccccg

SEQ ID NO: 130366 - DNA, 894 bp, Homo sapiens
  misc_feature: GYAE6OF01CK4UJ.22.36.D03.1.454.CMB.1.raw
tcagacatacgcgtcacgaccggtgctcgatttagctgcgtcacgatctctcgttggggggggtctcaggaggcagcgctcgtcgggacgtctccaccatggcctgggctctgctattcctcaccttcctcactcgagggcacgacgggtcctgggcccagtctcgccctgacccagcctgccctcgtgtctggatcagtcgtacggacagtccgatcagtctactttcgcgcacgtcgggaaccaacgtagtacgacttaggtttcgggttctttttcgacgttcgttacgttccgtaccgttacggttaaacccaaaccaaacccgtaacccgaccggtaaccccctaaaacccccccgtaaatacctaaactttaccgtaacgttttaacgtcggttacgttaaccgtaccgtttaccgggtcccggtacccctacggaacggttaccgttccgttccgttactaaccgtccgttccggttcctaaccggtaccggtacctaaccggttaaacggttcccgtacgggtaacccgtaaacccgtaccccggtaaccccttaacccgtaaacccgtcgttacccgttacgggtaccggtttacccctaccgggttacgggtttacggggtaaaccgggaccggtttacgttacctttaaaccgttttacgtaccgttacgttaaccggttttaaccgttttaaccgttaaggttaacccggccttacccgtaccgttcgtttacggggtttccgggtttaccggccgggtaaggtaccgtaaacccggtggtttacccgacccggttaccggttcgggaccctaacgggtacccggaccggtcccgtccccggtccccggtaagttcccccgttacgtttccccggttccccg

SEQ ID NO: 130367 - DNA, 981 bp, Homo sapiens
  misc_feature: GYAE6OF01DKFMI.22.36.D03.1.454.CMB.1.raw
tcagacatacgcgtcacgaccggtgctcgatttagctgcgtcacgatctctcgttgggggggggtctcaggaggcagcgctcgtcgggacgtctccaccatggcctgggctctgctattcctcaccttcctcactcagggcacagggtcctgggcccagtctcgccctgacccagcctcgcctccgtgtctggatcatctggacagtccgatacagctactttcctgcctacgtcggggaaccaaacgtaggtcgaacgttacggttttcgggtttccgtttttcggtaaccttccgttcggttcccgttacccgttacgggttaaacccaaaaaccgaaaccccaaaccccgaaaccgggaaaccccccaaaaaacccccccccgtaaaccttaacctaaacttacctttaaacgtttttaacggttacgggtttaccggttacctaacccggttaccgggttccccgggtaccccgtttaccggtaacgggggttaaccgttcccgttaaccttccgtaacgttcccggtttcccttttcccgttaccggtaaccggttaccccttaaccccgtaaacggtttcccggttaaccgggaacccctaaaacccgtacccccggggttaccccctttaacccccgttaaacccgtacttacccggtttccggtacggggtaccccttacccggtttacggtttacgggtaaccggtaaccggttacgttaccgtttaaaccctttttaacgttaccgttacgttaccgtttaaccgtttttaaccgtttttaaacggtaccgggttaccctacccgtttacgttaccggttttccggggtttacggggtttttccgggacgggtaaccggtacgttaaaccggtacggttaccggtacccggttcccggttacggtacccgaccggtcccgaacggtcccgttcccggacccccgttcgttaccgtccgttccgttccccgg

SEQ ID NO: 130368 - DNA, 783 bp, Homo sapiens
  misc_feature: GYAE6OF01CJU60.22.36.D03.1.454.CMB.1.raw
  modified_base (241)..(241): a, c, t, g, unknown or other
  misc_feature (241)..(241): n is a, c, g, or t
  modified_base (767)..(767): a, c, t, g, unknown or other
  misc_feature (767)..(767): n is a, c, g, or t
tcagacatacgcgtcacgaccggtgctcgatttagctgcgtcacgatctctcgttggggggggtctcaggaggcagcgctcgtcgggacgtctccaccatggcctgggctctgctattcctcacctttcctcactcgagggcacgtacgggtcctcgggcccagtctcgaccctgacccagtcctgcctcgtgtctggtactcgatcgtaggactaggtcgatcgacgtcttacgtttccngcgtaaccgtcgggaaccaacgtacggtacgacgttaggtttacgggtttcttttacgaccttcgtttacggttaccttaccgttaaccggtaacccaaaccgaacccgtaccccgaaaccggtaaccccctaaaacccccctattacctacttacgtttaacgttttacggtggttaccgttaccgtaccggttccggtcccgtaccgttacggacggttacttcctaccttcgtacgttccgttccgttactaccggacgtcccttaacgtaaccggttccgtaaccggtacctaacccggtacccggtaccccttaacccgttaacgtccgtttaccgtccgggttacggtacccctttacggttaggtttacggaacggttacgtacttacgttacgttactacgtacggttacttacgtttactaaggttccgacctacgtcgtacgttcggttcgtacggcggtacgtacgtaccgtagtcccgtacggttcgacgcgtaccgacgtcgcctccggtccnctacgtcctccgtccg

SEQ ID NO: 130369 - DNA, 692 bp, Homo sapiens
  misc_feature: GYAE6OF01A3IBY.22.36.D03.1.454.CMB.1.raw
  modified_base (216)..(216): a, c, t, g, unknown or other
  misc_feature (216)..(216): n is a, c, g, or t
  modified_base (303)..(303): a, c, t, g, unknown or other
  misc_feature (303)..(303): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcacttggaccaacagtgacattgggtcttttgactctgtctcctgtaccaacaacacccagaccaaaccccccactcatctattanggtgtcactcgtccggccctcgaggtagtctctcatccgtcttcctcacggcctacctaagtccgttggacccaaaccgaccgggtcccctacccgttaaccctacttcccttacgtcgggccttcccgtacggtttacggacgggtacgtacgttaccttacttacgttactcggtacttacgtttacccgttttaaagttaccggacctcccgtacgtttacccgtttcgggtttaccggtttttccggggccggtaacgggcccgtaaccgggtaaacggttcccggtaacccgttccccggttacggtacccgtaccggaccccgtaacggtcccgttcccggtacccccccgttaccggttcctacccgttccgttacccccgg

SEQ ID NO: 130370 - DNA, 666 bp, Homo sapiens
  misc_feature: GYAE6OF01DJ1Z2.22.36.D03.1.454.CMB.1.raw
  modified_base (222)..(222): a, c, t, g, unknown or other
  misc_feature (222)..(222): n is a, c, g, or t
  modified_base (648)..(648): a, c, t, g, unknown or other
  misc_feature (648)..(648): n is a, c, g, or t
tcagacatacgcgtcacgaccggtgctcgatttagctgcgtcacgatctctcgttggggggggtctcaggaggcagcgctcgtcgggacgtctccaccatggcctgggctctgctattcctcaccttcctcactcgagggcacgagggtcctgggcccagtctcgccctgacccagcctgcctcgtgtctggatcatctggacagtcgatcagctatttccngactacgtcgggaacctaacgagtgactagttggtcttttgactctgtctctggtaccaacaacaccacgacccaaaaccccctactcaatctaattagtggtgtcactcgtccggcctcgaaggtgtcctctcatccgcttcctcgaacggtctacgtaacgtcgtacgaccaacgaccggtacccttaccctaaacactcctcgtcggtaccgtccttaggttaggaaacggtcgtaacgttcttaaacgtttacgttactcggttaactagtttaaccgttaagttacgccgtaccttacgtcgttccgggtttacgttccgggtcggaacggtcgtaacggtacgtacggtacccggttaccgttaccggtacgaccgtaaccccgtagggtacccttcccgggtaccccgttccggtaccnccgtttcccgttccccgg

SEQ ID NO: 130371 - DNA, 696 bp, Homo sapiens
  misc_feature: GYAE6OF01C5NSZ.22.36.D03.1.454.CMB.1.raw
  modified_base (466)..(466): a, c, t, g, unknown or other
  misc_feature (466)..(466): n is a, c, g, or t
  modified_base (565)..(565): a, c, t, g, unknown or other
  misc_feature (565)..(565): n is a, c, g, or t
  modified_base (590)..(590): a, c, t, g, unknown or other
  misc_feature (590)..(590): n is a, c, g, or t
  modified_base (635)..(635): a, c, t, g, unknown or other
  misc_feature (635)..(635): n is a, c, g, or t
tcagacatacgcgtcacgaccggtgctcgatttagctgcgtcacgatctctcgttgggggggggtctcaggaggcagcgctctcgggacgtctccaccatggcctgggctctgctattcctcaccttcctcactcgagggcacacgggtcctgggcccagtctcggccctgacccagccctcgcctccgtgtctggatcatcgtaggacaggtcgatcacgtcttatttcctgacacgtacgggaccaagaggtagactggttgggtttacttttgacttcgttcgtcctaccgtacgtaaccaacaacccaccgaccggaaccccaaaccccctaagtcctactacttagtttagtgggtcctactaccgtccggtacccggtcccgtagacgggttactcctctctacgttcgtctctcgagtccctactagtcgtgaccaacgcccgtaccctaccaacgtcnccgtcgtcggaccttgttaggttacgacggtactcgttacttaacgttctacgttctaacgtttaacctttaacgtttaagtaccggtacctacccgtntttccggtcggtttgggttccgggnggaccgtacgtaccgacggtacccgtccgtaccgtcgggttaccncccgggtacgaccgttccggtaccccgtccccgttacgtcctacccgttcccgttccccgg

SEQ ID NO: 130372 - DNA, 945 bp, Homo sapiens
  misc_feature: GYAE6OF01D7EFN.22.36.D03.1.454.CMB.1.raw
  modified_base (228)..(228): a, c, t, g, unknown or other
  misc_feature (228)..(228): n is a, c, g, or t
tcagacatacgcgtcacgaccggtgctcgatttagctgcgtcacgatctctcgttggggggggtctcgaggaggcagcgctctcgggacgtctccaccatggcctgggctctgctattcctcaccttcctcactcgagggcacgagggtcctcgggcccagtctcgccctgacccagcctcgccccgtgtctggactcatcgtggacagtcgatcagtctactttccngactacgtacgggaaccaagagtacgtacgttagtttcgggttacttttagaccttcgttacgttccttaccgtacggtaaacccaaaccgaaacccgtaaccccgaaccggtaacccccaaaacccccctaacgtacctaacgttaccttaagttttacgtacggttacgtaccgtaccgtccggttacccggcccctaagtacggtacgttcctaccttaccgtacgttcccgttactttccgtacgtaccgtaccgttaaccgtaacggttaccgtaccggaaacccgtaaacccggttaccccggttaacccttaaccccccttaaacgttacccgttaccggtttaacccgggttacccgggttacctttaacccggtttacgggtttaaacggaaccgggtaaaccgttaacgtttaccctttaaagttttaccgttaaccgttaacgttaaccgtttaaccggttttttaaacgttaaaccggttcccggtaccgttaacccgttaccggttttccgtttacggggtttttaccggggtttaccggaaccggggttaccgtaaaccggttaacgggttacggtacccggtaaccccgggtttaccgccgggttaaccgaacccgggttaccgtaacccggttaccgtccccccggttaaccccggttacccggttaacctcccgtttcccgtcccggtttaccccccccg

SEQ ID NO: 130373 - DNA, 688 bp, Homo sapiens
  misc_feature: GYAE6OF01BQOX2.22.36.D03.1.454.CMB.1.raw
  modified_base (261)..(261): a, c, t, g, unknown or other
  misc_feature (261)..(261): n is a, c, g, or t
tcagacatacgcgtcacgaccggtgctcgatttagctgcgtcacgatcgtctcgttggggggggtctcaggaggcagcgctctcgggacgtctccacatggcctgggctctgctattcctcaccttcctcactcgagggcacgacgggtccgtcgggcccaggtcctcggtccctgaccctacgcctgccctccgtgtctggactcatcgtggacgagtcgatccagcctactttccgtcgcgtacgtacgggaccaacgngtcgaactagtttcgggttcttttgacttcgtgtctccgtagtaaccaacaccaccgacgaccccaaacccccgatcactctatttacgcgtacgtccacgttcgccggcctaggagtcgtctctacagttccgtctttccgcgtacggtcctaccgtagtcgtacggaccaaacgtcccgtacccttaacccgtaactacgttccgtccggttaccgggtcctaccgttaggtttacggaacggtacgtacttacgttactttacgtacgtctacgtttaactttacgttaacgtcggaccgtacctacttccggttacggttcggttacggacgggtacgtaccgtacgtacgtccgtaccgttccgtacgtacgacgtccgtacgtcccgtaccgtccccgtagtcccgtcgtccggttacccg

SEQ ID NO: 130374 - DNA, 721 bp, Homo sapiens
  misc_feature: GYAE6OF01AEJZX.22.36.D03.1.454.CMB.1.raw
  modified_base (221)..(221): a, c, t, g, unknown or other
  misc_feature (221)..(221): n is a, c, g, or t
tcagacatacgcgtcacgaccggtgctcgatttagctgcgtcacgatctctcgttggggggggtctcaggaggcagcgctctcgggacgtctccaccatggcctgggctctgctattcctcaccttcctcactcagggcacagggtcctgggcccagtctcgccctcgacccagcctgcctccgtgtctggatcatctggacagtcgatcagctatttccngcacgtcgggaaccaacgagtagactagtttcgggttcgttttgacttcttcgtcctccgtagtaacccaaacgaaccaccccgaacgacccccaaaaccccccaactcactacctatttacgtggtcgtccaccgtccggtccgccctacgacggactcctctctactcgtccttctcgacgtcctacctaagtcgtacggaccaaccgtaccgtacccctaccctaacctacgttccgttaccgtcggtccttacgtaacggtttagaccgggtacgtacgtttaccttaacttacgttacgtacgttaccgttaacgttttaaccgtttaacgttaccgggccgttacccgtacgttccgttccgggtttcggtttaccggggaccggtacggtaccgtaccgtaaacggtcccggtaccggtttcccgtcggtacgtaccggacccgtagggcccttccccggccccgttaccggtctcccggttcgttcccccgg

SEQ ID NO: 130375 - DNA, 862 bp, Homo sapiens
  misc_feature: GYAE6OF01BQF57.22.36.D03.1.454.CMB.1.raw
tcagacatacgcgtcacgaccggtgctcgatttagctgcgtcacgatctctcgttggggggggtctcaggaggcagcgctctcgggacgtctccaccatggcctgggctctgctattcctcaccttcctcactcgacgggcacgacgggtcctgggcccagtctcgccctgacccagcctgccctccggtgtcgtggatcatcgtggactaggtcgatcgagtctacgtttccgtgacctacggtaccgggaaccaacgtaggtacgtaacgttaggtttcgggtttccttttacggaccttcgtttaccgttccgttcccgttaaccggtaaacccaaaccgaacccgaaccccgtaacccggaaaccccccaaaacccccctaagtcctaacttacttacgtttaagtcggttactccgtaaccgttccggtacccggtccctacggacgggtacttaccttcctacgtacgtcccgtaccttccgtacggtaccggtacccgtacgtaacgtttcccgaacggtacctaaaccccggtacccgttaacccctacccgtaaacctccgttaccgtccggggttacccggttccgttacccggttaagggttaccgaaccgggttaacgttacgtttacccttaagttactcgtacgttacgttacgttttaactaacggtcgcctaccttacgttcggttccggtttaggttcccgggacggttaccgaaccggtaccggttaccgtaccgttcccgggtccttacgggtaccccgtaacgggaccccgtacgggttcccccgttaccccgggttccccggtaacccggttcccctaccggttttccccgtaccccccgg

SEQ ID NO: 130376 - DNA, 641 bp, Homo sapiens
  misc_feature: GYAE6OF01EG9NX.22.36.D03.1.454.CMB.1.raw
  modified_base (240)..(240): a, c, t, g, unknown or other
  misc_feature (240)..(240): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctcgccctcgacccagcctgcctccgtgtctggatcatcgtggacagtcgatcagctactttcctgccacgtcgggaccaagngtagactagtttgggttctttttgacctcttcgtccttccgtacggtaaccaaacaaccaacccgacgaaccccaaaccccccatcactactatttagtgtctcacgtcgtcgcctgagtcgtctctacactcgtcttctcgacggtcctacgaacgtcgtacgaccaaccgacccggacccttaccctaacctacttcctcgtcggtccttacgtaggttacggaggtaccgtacgttacttacgttattactcgtcttacgtttaccttaagttacgccgttacctacgttcgtttacggttcggtttacggcggtagtaccggaacgtacgtccggtaccgttcgtacgtacgccgaccgacgtcctcccgtcccgtacgttctcctccgttaccccg

SEQ ID NO: 130377 - DNA, 683 bp, Homo sapiens
  misc_feature: GYAE6OF01A577A.22.36.D03.1.454.CMB.1.raw
  modified_base (219)..(219): a, c, t, g, unknown or other
  misc_feature (219)..(219): n is a, c, g, or t
  modified_base (234)..(234): a, c, t, g, unknown or other
  misc_feature (234)..(234): n is a, c, g, or t
tcagacatacgcgtcacgaccggtgctcgatttagctgcgtcacgatctctcgttgggggggtctcaggaggcagcgctctcgggacgtctccaccatggcctgggctctgctattcctcaccttcctcactcagggcacagggtcctgggcccagtctgccctgacccagccctgccctccgtgtctggatcatctggacagtcgatcagctattccngcacgtgggaccaangtgactagttggtcttttgactctagtctcctggtaccaacaacacccaggaccaaacccccctaatccatcctatttagtcggttcgtctactcggtccggccctcgaagggtcgtcctctctagtccgtcctttctcgacggtcctacctaaggttccgtacgggacctaaacccgacccggtaccccttacccccgtaaacctcttcccgttaccgtcgggtccttacccgtaggtttacggaacggtacgtacgttacctttaacgttactttacgtacgtaccgttaacgtttaacctttaaagttcggcccgtaccctacgttccggtttccggttcggttttccggacggtacggtccaaccggtagtcggtacccgtcggtccggtcgaccgacccgaagtcccgtaccgtcccccgttcggtcctaccgtccgttccccg

SEQ ID NO: 130378 - DNA, 706 bp, Homo sapiens
  misc_feature: GYAE6OF01APT8N.22.36.D03.1.454.CMB.1.raw
  modified_base (221)..(221): a, c, t, g, unknown or other
  misc_feature (221)..(221): n is a, c, g, or t
  modified_base (237)..(237): a, c, t, g, unknown or other
  misc_feature (237)..(237): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcgagggcacgacgggtcctgggcccagtctcgccctgacccagcctgcctccgtgtctggatcatctggacagtcatcagctatttccngcacgtcggaccaagngtacactagttcggttcttttggacttctcgtctcctcggtaaccaacaaccaccacggtaccccaaaaccccccataccactctaactttagtcggttacgtcctaaccttccggtccggtcccctacgtacgggaacttccgtccttacacgtaccgtccttacctcggaccggtcctaccgtaagtccgtaccggtaaccaaccggtaccccggtaccccttaaccccgttaaccaccgttcccgttaaccgtccggggtacccttacccgttacggtttacggaacgggttaccgtaccgttaccgttaactttacttacgtcgtacttacgtttaacctttaaagtcgtccgtacctaccgttcgtaccgtttcggttcggtcggaggtccacggtctacggtccgtccggtactacgacgtaccgacgtccgtacccgcccgtacgtctaccgtccgttcccg

SEQ ID NO: 130379 - DNA, 759 bp, Homo sapiens
  misc_feature: GYAE6OF01DBEIR.22.36.D03.1.454.CMB.1.raw
  modified_base (382)..(382): a, c, t, g, unknown or other
  misc_feature (382)..(382): n is a, c, g, or t
tcagacatacgcgtcacgaccggtgctcgatttagctgcgtcacgatctctcgttggggggggtctcaggaggcagcgctcgtacgggacgtctccaccatggcctgggctctgctattcctcaccttcctcactcgagggcacgacgggtccgtgggcccagtctcgccctcgacccagcctcgcctccgtgtctggatcatcgtggacagtcgatcagcttactttcctgacctacgtacgggaaccaacgaggtagaacgttggtttcgggttcttttcgaccttcgtcgttccttaccgtacgtaacctaacgaacccaccgacgaacccccaaacccctatctatacttagtttagcgttcgctcgtccgtccgccngacgtctctctcgtactcgtcttcgcgtacgtcctacgtacgtcgtaacgacctaaccgtcccgtacccttaaccactacttccggtcggtacggtccttaacggttggtaacggacggtaccgttattaccgtttactttacgtacgttcgtttaaccgtttaagttttaacctttaaggtcccgccgttaccttacggtttacggtttcggggtttacgggttccggaccgggtacggtaacccgttaacccggtcggttacccgtaccggggtttcccctacggggtacccgaccgggacccgttaccgggtccccgtttccccgggaccccccggtttattacccccgtccgggtttccccggttcccccggg

SEQ ID NO: 130380 - DNA, 804 bp, Homo sapiens
  misc_feature: GYAE6OF01B0TA8.22.36.D03.1.454.CMB.1.raw
tcagacatacgcgtcacgaccggtgctcgatttagctgcgtcacgatctctcgttggggggggtctcaggaggcagcgctctcgggacgtctccaccatggcctgggctctgctattcctcaccttcctcactcagggcacgagggtcctgggcccagtctcgccctgacccagcctgcctcgtgtctggatcatcgtggacagtcgatcgagtcttactttccgtagactacgtacgggaaccaacgtaggtacgacttagtttggggttccttttagaccttctcgtcttaccgtacggtaaaccaacaaccgaccgaaccgtaacccccaaaacccccctaagtcctattacgttaagtttcggtcggtacttccgtaccggttccggtcccggtaccctacggacggtacttcctacctagtaacgtccttacgtttcgtaccgtacgttaccgtaccctaaggtcccgttacggaacccctaaaccgggtccccgtccccttaaacccttaacccgactttcccgttaaccgggttccggtaccgttacccgttagggttaaccggaaacggttaccttaacgtttaaccgttacgtttacgtacgttaccgttacgtttaaccgtttttaaccttaaacggttcggacccgtttacgccgttttaacgtgggtttaaccgggttcgggacgtaccgtaccgtacgtacggttcctaccggtccgttaacggcgaccgggtaccgtacgggtccccttacccggttccccgtagttccctaacggttcccgttacccgg

SEQ ID NO: 130381 - DNA, 711 bp, Homo sapiens
  misc_feature: GYAE6OF01BMK4C.22.36.D03.1.454.CMB.1.raw
  modified_base (211)..(211): a, c, t, g, unknown or other
  misc_feature (211)..(211): n is a, c, g, or t
  modified_base (251)..(251): a, c, t, g, unknown or other
  misc_feature (251)..(251): n is a, c, g, or t
tcagacatacgcgtcacgaccggtgctcgatttagctgcgtcacgatctctcgttggggggggtctcaggaggcagcgctctcaggacgtcaccaccatggcctgggctctgctcctcctcagcctcctcactcagggcacgagggtcctgggcccagtctcgccctgactcacgccctcccgtcgccggtccgggtctcgtggactgtcncgtacacctactcctcctgacctaaccgtacgggaaaccngaccgtaggtcggtacggtttggtaggtttaattaaacgtgttcgttcctaccgttaacggtaacccaaaaccgaaccgaaccccgaaggaacccaaaacccgtaacccccaaactcattacggttaatttacgcggaacgtacaaccgttacggacccggtccgttcggaaccgggtccctagacgttccggtaccttcgtcggtcggtacctacgtagttcgacgacctaacgccggtcctaccgacgtccgtcgtcgtacggcctacggacggtcgaaggtcggtaacgcgggtagttacgttagttacgtttaacgtcgtacggtctacgtactaacgtagtacggtcggggaacgtagcgaacggttagtagggtttgtcgggttacggggacggtaccgaggtaccgcggtaccgacggtcgacgtcgaccggcgtacgtccgtcccggtaccc

SEQ ID NO: 130382 - DNA, 664 bp, Homo sapiens
  misc_feature: GYAE6OF01A344V.22.36.D03.1.454.CMB.1.raw
  modified_base (149)..(149): a, c, t, g, unknown or other
  misc_feature (149)..(149): n is a, c, g, or t
  modified_base (248)..(248): a, c, t, g, unknown or other
  misc_feature (248)..(248): n is a, c, g, or t
  modified_base (265)..(265): a, c, t, g, unknown or other
  misc_feature (265)..(265): n is a, c, g, or t
  modified_base (318)..(318): a, c, t, g, unknown or other
  misc_feature (318)..(318): n is a, c, g, or t
  modified_base (499)..(499): a, c, t, g, unknown or other
  misc_feature (499)..(499): n is a, c, g, or t
  modified_base (635)..(635): a, c, t, g, unknown or other
  misc_feature (635)..(635): n is a, c, g, or t
tcagacatacgcgtcacgaccggtgctcgatttagctgcgtcacgatctctcgttgggggggtctcgaggaggcagcgctctcgggacgtctccaccatggcctgggctcgtgctacttcctcaccttcctacacctcgacgggcacgngggtcctgggcccagtcctcgcccctagaccccagccctgccctccggtagtccgtaggactcattcctaggacctagtccgatccagtctactttcgngctacgtagggaccaanagtcgactaggtttcggtctttagactctgtcctcgtcgtaaccaactaaccncctacggaccccaaaccccagtccactctacttgtgtactccacttcgtccgccctagacggtactacgtcctacgtactcgtccttccgtacgtacgtcctacggtaactcgtacgacctaacgccgtacccgtacccaacgttcctctaccggtcgtacccgttattcggagtaccggnttacgtacttacttacgtactcgtacttacgtttaactaagtccgtacacctcttccggttagttcggttacggccgtaggtccaacggtcgtaccgtaccgtccgtaggttccacggtccgtacgccccgttccncccggttactccgcgttcccgtaaccccg

SEQ ID NO: 130383 - DNA, 758 bp, Homo sapiens
  misc_feature: GYAE6OF01BBIMT.22.36.D03.1.454.CMB.1.raw
  modified_base (704)..(704): a, c, t, g, unknown or other
  misc_feature (704)..(704): n is a, c, g, or t
tcagacatacgcgtcacgaccggtgctcgatttagctgcgtcacgatctctcgttggggggggtctcaggaggcagcgctcgtcgggacgtctccaccatggcctgggctctgctattcctcaccttcctcactcgaggcacgacgggtcctgggcccagtctcgccctcgacccagcctcgccctccgtgtcgtggatctatctggacagtcgatcaagtctacgtttcctcgacgaaccgtacgggaacctaaacgtaggtacggaccttaggtttcgggtttctttttacgaccttcgttcgtacctaccgtacggttaaacccaaaccgtaacccgaaccccgaaccggaaccccctaaaacccccctaaatccaactttacgtaacttttacggtggttaccaccggtaaccttccgggtacccggcccttagaacgggtctacctcgcctacgtcgtcttaccgagtcggtactaccggtaagtccgtagacccaaaccggtccgtacccctaaccgtaacgtccgttcctcgggtacgtcctcgtaggttacggagtacgtacttacgtttactacttacgtcgtactttacttaacgtttaaggtacacccgttccttaagtttccgtcgggtttgggtttacccggacgacgggtacctaacggggtacctagggacccgtttccgccggtaacnccggtaccgacgtcccgtacccgtcccgttacctacgtttccgacggttccccg

SEQ ID NO: 130384 - DNA, 809 bp, Homo sapiens
  misc_feature: GYAE6OF01DCHRL.22.36.D03.1.454.CMB.1.raw
  modified_base (225)..(225): a, c, t, g, unknown or other
  misc_feature (225)..(225): n is a, c, g, or t
  modified_base (395)..(395): a, c, t, g, unknown or other
  misc_feature (395)..(395): n is a, c, g, or t
  modified_base (422)..(422): a, c, t, g, unknown or other
  misc_feature (422)..(422): n is a, c, g, or t
tcagacatacgcgtcacgaccggtgctcgatttagctgcgtcacgatctctcgttggggggggtctcaggaggcagcgctctcgggacgtctccaccatggcctgggctctgctattcctcaccttcctcactcagggcacgagggtcctcgggcccagtctgccctgacccagcctcgcctcgtgtctggactcgatcgaggacagtcgatacagctatttccngcctacgtcgggaaccaagtagtacgacttaggtttcggttcttttacgaccttcgtcgtccttccgtaggtaaacccaacgaaaccctaccgaacggaccccaaaacccccctatactactactagttacgtggtactccacgtccggtccgacctacagggtctactntactactcgtcctgtcgacgtccttanacgtcctacggaaccacccgtaccggtacccttacccgtaactacgtccggtcgtcgggtacccttacggttacggtttacggaacggttaccggtacttaccgttaactttaacgttaccgtcgttaaccgttaacggttttaccgttaaacggtccggtaaccgttacccgttaccgttacggttttccggggttacgggttttacccgggacggggttaccccggttaaaccgtacccgggttaaaccgggttacccggtccccgggttaaccggttttacccgggaaccggtaccccggtccccgggtaaacttccccggggttacccccggtaacccccgttgggtttaacccctaccccggttttcccgttaaccccccgg

SEQ ID NO: 130385 - DNA, 734 bp, Homo sapiens
  misc_feature: GYAE6OF01B6AB2.22.36.D03.1.454.CMB.1.raw
tcagacatacgcgtcacgaccggtgctcgatttagctgcgtcacgatctctcgttgggggggggtctcaggaggcagcgctctcgggacgtctccaccatggcctgggctctgctattcctcaccttcctcactcagggcacgagggtcctgggcccagtctcgccctgacccagcctgcctccgtgtctggatcatctggacagtcgatcagctatttcctgctacgtcgggaaccaacagtagactaggtttgggttccttttgaccttcttgtcctccgtgtaaccaacaaccacccacggaccccaaaccccccatacactctatttatggtcgtcactcgtccgtcctcgaggtactctcgtacactctcttcacgtacggtcctacgtagtctacgacctaaccgccgtaccctaccctaaacctcttccgtcgtcggacctaccggttaggtttacggacggtaaccgtcgttacctttaaccgtttacgtaccgtgttaccgtttaacgttttaacccgttttaacggtaccggtacccgtaccgttacccgtttcggtttaccgggtttcgggtttaccggggtacgggtacggtacccgtaacgggtacggttacccggttccccgttaccggtacggtacccgtacccggtacccgggtaccgtccccggttaccccggtacccccgttaccggttcccttacccggttccgtttccccccgg

SEQ ID NO: 130386 - DNA, 734 bp, Homo sapiens
  misc_feature: GYAE6OF01DQ529.22.36.D03.1.454.CMB.1.raw
  modified_base (228)..(228): a, c, t, g, unknown or other
  misc_feature (228)..(228): n is a, c, g, or t
  modified_base (246)..(246): a, c, t, g, unknown or other
  misc_feature (246)..(246): n is a, c, g, or t
  modified_base (394)..(394): a, c, t, g, unknown or other
  misc_feature (394)..(394): n is a, c, g, or t
tcagacatacgcgtcacgaccggtgctcgatttagctgcgtcacgatctctcgttgggggggggtctcaggaggcagcgctctcgggacgtctccaccatggcctgggctctgctattcctcaccttcctcactcagggcacgagggtcctgggcccagtctcgccctcgacccagcctgccctccgtgtctggactcatcgtggacacgtcgatcagctactttccngcacgtgggaaccaacgngtcgactagtttcgggttcttttcgtacttcgtcgttcctcgttacggtaccaaacgaaccacccgacggaccccaaacccccaactacactctaattacgtggtctctaccgtcgtcgcctagacggtctctctcacgtcgtcttcncgacgctactaagtcgtacgcaacgaccgtaccctacctaacctatccgtacgcggtactcgttaggttacgacggactacgtaccttaacttacgttacgtacgtacctttaacgtttactttaaacggttcgtaccgtaccttaccgttcggtttacgggtttccggttttaccgggcgggtaacggtacccggtaaaccgttaacgggttccggtaccccggttttcccgtacggggttacccgtaaccggtaccccgggtaaaccgggtccccgttaccccgggtaccccccgggtttacggttaccccgtaacccgtttccccgtttcccccggg

SEQ ID NO: 130387 - DNA, 808 bp, Homo sapiens
  misc_feature: GYAE6OF01A2D5Y.22.36.D03.1.454.CMB.1.raw
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcggctatttcctgctacgtacgggaacccaactaggtcgactagtttggggttcttttgacttctgtcctccgtaggtaaccaacaacacccacggaccccaaaccccccaactcactctatttagtggtctcacgtcgtccggccctacgacggtacttccgtctacgtacttcgtcctttcgtacgacggtcctacccgtaaaggttcctacgggaccaaccggtacccggtaccccttaccccttaaaccgtacctccgttcggtccgggtacccttaccgttaggttttacggaacggtaaccggtacgtttactttaactttacgttaacgttcgttaaccgttaacgtttttaaccgtttaaaacgttcgggtaaccctaccgttaccgttcgttttacccggtttcgggttttaccgggaccgggttacgggtaccccggtaaccggttaacggttacccgggttaaccccgggttccggttacccgggtaaccgtacccggtaaccccgggtaaccgggttcccttccccgggttaccccccgttaacgggtccctttaacccggtttcccgttacccccggtttacccccccg

SEQ ID NO: 130388 - DNA, 711 bp, Homo sapiens
  misc_feature: GYAE6OF01CQQEW.22.36.D03.1.454.CMB.1.raw
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgctacgtgggaccaacgagtgactagttgggtcttttgacttctgtctcctaggtaaccaacaaccacccacggacccaaaaccccccaactcaactctaatttatggtcgtacacgtcgtccggtccctacgaggtacgtctctcgactcgtcttctacaggtacctaccgtaacgtcgtacggacctaaccgtaccggtacccctacccttaaacctacgttccgttaccgtacgggtcccttaccgttaggtttacgaacggtacgtacgttaccttaactttacttacgttcgtacgttacgttttaacctttaaagtttaccggacccgtaccctaccgtttccgttaccgggtttggttttacccgggcggtaccggtaccgtaaccggtacgtacggtacccgttccgttaccggtaccgaccgtaccccgtaacggtcccgtcccggtacccccgttacggtccctaccgttcccgtttaccccg

SEQ ID NO: 130389 - DNA, 771 bp, Homo sapiens
  misc_feature: GYAE6OF01AUMSQ.22.36.D03.1.454.CMB.1.raw
  modified_base (682)..(682): a, c, t, g, unknown or other
  misc_feature (682)..(682): n is a, c, g, or t
  modified_base (733)..(733): a, c, t, g, unknown or other
  misc_feature (733)..(733): n is a, c, g, or t
tcagacatacgcgtcacgaccggtgctcgatttagctgcgtcacgatctctcgttgggggggggtctcaggaggcagcgctctcgggacgtctccaccatggcctgggctctgctattcctcaccttcctcactcagggcacgagggtcctgggcccagtctgccctgacccagcctgcctccgtgtcgtggactcactctggactagtcgatcacgtctactttcctggccacgtacgggaacccaagtaggtacgactaggtttcgggggttacttttacggacctttccgtcggtccttaccgttaccggtaaacccaaaccgtaacccaccccgaacggaaccccccctaaaaccccccctatacctaccgttactattttaacgtcggtctacctaccgtccgtaccggtaccctaggacggttctacctctacacgttaccgtcttcgtcggaacgtcctaaccggtaagttcccggtcgaacccgtaaccgtacccggtccccttaaccctaacgcgttccgtccggtacggtcccttacgtacgggttacggaacgttaccggtactttacgttaacgtttacgttccgtacggttaccgttaacgttttaacgtttaaacggttcccgggaccttaccggtaccgtttcgttaccggggtttcggttaccggnggtaccgaccgtaacgggtactacggcccgttcgacggtcaccggtaccgngtcccgtccccgtcccgttaagcctccgttcgttcccc

SEQ ID NO: 130390 - DNA, 654 bp, Homo sapiens
  misc_feature: GYAE6OF01C42JP.22.36.D03.1.454.CMB.1.raw
  modified_base (170)..(170): a, c, t, g, unknown or other
  misc_feature (170)..(170): n is a, c, g, or t
  modified_base (221)..(221): a, c, t, g, unknown or other
  misc_feature (221)..(221): n is a, c, g, or t
  modified_base (294)..(294): a, c, t, g, unknown or other
  misc_feature (294)..(294): n is a, c, g, or t
  modified_base (312)..(312): a, c, t, g, unknown or other
  misc_feature (312)..(312): n is a, c, g, or t
  modified_base (417)..(417): a, c, t, g, unknown or other
  misc_feature (417)..(417): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccngcctgcctccgtgtctggactcatcgtggactagtcgatcagctatttccngcacgtacggaccaagtgtcgactagttgggttcttttgactctcgtcctcctacggtaaccaactaccaccncgaaccccaaacccctancatctattagcgtctcacgtcggtcccgcctagacggtactctctctactcgtcttccgagtcgtccactaacgtcgtacgaccaacgccgtccctaacctaacnctctcggtcgcctcgtagttcgaacggtcgttactacctttacttacgtactcgttactacgttttacttaagccggtactaccgtaccttcggttcggtttcggtttaccgggcgtacggaccgtacggtaccgttacggtccccgttccggtaccggttaccgccggtacccggtaaccggcccttaccccgggttaccccgttacggtacccgttcccttccggttaccccccg

SEQ ID NO: 130391 - DNA, 675 bp, Homo sapiens
  misc_feature: GYAE6OF01A0A5W.22.36.D03.1.454.CMB.1.raw
  modified_base (231)..(231): a, c, t, g, unknown or other
  misc_feature (231)..(231): n is a, c, g, or t
  modified_base (270)..(270): a, c, t, g, unknown or other
  misc_feature (270)..(270): n is a, c, g, or t
  modified_base (302)..(302): a, c, t, g, unknown or other
  misc_feature (302)..(302): n is a, c, g, or t
  modified_base (322)..(322): a, c, t, g, unknown or other
  misc_feature (322)..(322): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaangtgacattgggtcttttgactctgtctcctggtaccaanaacaccaggcaaaccccccaatcatcatttangtagtcactcgtacgccctnaggagtctctcatcgcttctctaggctaccaagtctaggcaacacggcctccctaaaccatcctctacgggctccctagtttgaacgggtacgaggttaccttacgttaactttacgtcgtacgttaacggtttacccttttaaaagtttaccgggaccgtcccgtaaaccttccgtttaccggtttgggttttttaccggggaccgggtaacgggtacccgtaaccggtaaacggttcggtaaaccccggtttccgttacccggggttacctaacgggacccccgttaaaagggcccgtaaccgtcccccccgttacccggggttaccacccgtttccgtttaaccccccgg

SEQ ID NO: 130392 - DNA, 655 bp, Homo sapiens
  misc_feature: GYAE6OF01DCC7V.22.36.D03.1.454.CMB.1.raw
  modified_base (318)..(318): a, c, t, g, unknown or other
  misc_feature (318)..(318): n is a, c, g, or t
tcagacatacgcgtcacgaccggtgctcgatttagctgcgtcacgatctctcgttggggggggtctcaggaggcagcgctctcgggacgtctccaccatggcctgggctctgctattcctcaccttcctcactcagggcacagggtcctgggcccagtctgccctgacccagcctgcctcgtgtctggatcatctggacagtcagtcaccatcctcctgcactacggaaccagctagtgtacggttggtagttacaagtatcgtctccgtaggtaccaaccaccaccaggaccacaccgaccccaatcatgtattagngagtacacgacgcggtccgtacgacgggtcctgactcgtcttcgtcgtcgcctacgtacgtcgtcggccgtacgccgtccctacccgtcggtacccgtcgttaccggtcgggtccctacggacggtcgtagggacggtacgtaggtacggtagttacgttaacgtttacgtttaccgtacggttcttaaccgttagtacgttaacgtcgggacgtaccgggcgtacgtacggtttcgggttcggtacgggttcggggaaccgggtacgggtaacaacggtccgtaccggtaccgttaccgtacggtacccgaccggaccgtaggcccgtacccccgg

SEQ ID NO: 130393 - DNA, 708 bp, Homo sapiens
  misc_feature: GYAE6OF01BE9D0.22.36.D03.1.454.CMB.1.raw
  modified_base (221)..(221): a, c, t, g, unknown or other
  misc_feature (221)..(221): n is a, c, g, or t
  modified_base (237)..(237): a, c, t, g, unknown or other
  misc_feature (237)..(237): n is a, c, g, or t
  modified_base (371)..(371): a, c, t, g, unknown or other
  misc_feature (371)..(371): n is a, c, g, or t
tcagacatacgcgtcacgaccggtgctcgatttagctgcgtcacgatctctcgttggggggggtctcaggaggcagcgctctcgggacgtctccaccatggcctgggctctgctattccctcaccttcctcactcagggcacagggtcctgggcccagtctgccctgacccagcctgcctccgtgtctggatcatctggacagtcgatcagtctatttccngcacgtcgggaccaangtgactagttggttctttgacttctgtctccgtagtaaccaacaccaccacgaccccaaacccccatcatactatttagtggtctctacgtccgtcccgtcctcgaggtacgtcctctctacgtccgtcttccncgacgtcctacgtacgtccgtacgaccaacgacccgtaccccttaccctaacgacttccgtcgtcgggtccttccgttaaggttcggaacggtacgtacgttacctttaacgttacgtttacgtcgttaaccttaacgtttttaaccgtttaaacgttccgggtaccctaccttacccgttttcgttaccgggtttttacgggttccgggacgggtaacggcccggttaaaccggtacggttaccgtcccggttccggtacggtccgaccgtacccggtacggtaccccgttccccggtacccccgttaacgggtccttcccgttccgttacccccg

SEQ ID NO: 130394 - DNA, 741 bp, Homo sapiens
  misc_feature: GYAE6OF01AVV7A.22.36.D03.1.454.CMB.1.raw
  modified_base (163)..(163): a, c, t, g, unknown or other
  misc_feature (163)..(163): n is a, c, g, or t
  modified_base (209)..(209): a, c, t, g, unknown or other
  misc_feature (209)..(209): n is a, c, g, or t
  modified_base (234)..(234): a, c, t, g, unknown or other
  misc_feature (234)..(234): n is a, c, g, or t
  modified_base (452)..(452): a, c, t, g, unknown or other
  misc_feature (452)..(452): n is a, c, g, or t
tcagacatacgcgtcacgaccggtgctcgatttagctgcgtcacgatctctcgttggggggggtctcaggaggcagcgctctcgggacgtctccaccatggcctgggctctgctattcctcaccttcctcactcgagggcacgagggtcctgggcccaggtcncgccctgacccagcctgcctccgtgtctaggatcgatccgtggacnggttacgatcgagctacttttccgngccacgtcgggaaccaacgagtcgactaggtttcgggttcttttcggacttcgttcgtcgtccgtcgtaaccaaccaaccgacccgtaccggaaccccaaacccccctacgtacaaccgttacttaacgttacggttcgtacgtaccgtaccgttccggtcccggtacccgtacggtaacggtaccgtctaccgtcgtactccggtacttccggtacncggtaccgtactacggttccgaggttacccaaccgtacccggtaccctacccgtaactaccgtccgtcggtccggtaccttcgtaacggttacggacggtacgttacgttacttacttactacgtacgttaacgttacgtttaacttaacggtaccgaccgtccgtacttaggttcgttacggttcgtcggtacgtcgtaacggtcggtaccgtcccggtcggttaccgacgtacccgtacggaccggttcgtcccggcccttacgggtccaccgtttcccgtccccgg

SEQ ID NO: 130395 - DNA, 777 bp, Homo sapiens
  misc_feature: GYAE6OF01BM88Z.22.36.D03.1.454.CMB.1.raw
tcagacatacgcgtcacgaccggtgctcgatttagctgcgtcacgatctctcgttggggggggtctcaggaggcagcgctctcgggacgtctccaccatggcctgggctctgctattcctcaccttcctcactcagggcacgagggtcctgggcccagtctgccctgacccagcctgcctccgtgtctggatcatctggacagtcgatcagctactttcctgcacgtacgggaacccaacaggtcgacttaggtttgggttcttttaggaccttcgtcgttcctccgttacggtaaacccaaccaacctacccgaacggaaccccccaaaccccccaagtccacttacctaagttttacgtggttactacctaccgttccgtacccggtcccctaggtacggtacctccgtcctactacgttccgtccttctacgtacgtcctaccgtaacgtccgtacggaaacctaccggtaaccgtccccttaacctaacctcttccgtcggtacggtccttacggtaggttacggtaacggtacgtcgtttacccttaacgtttacgttaccgttacgtacgttttaaccgttttaacgtttaaacgtcgggtacccttacccgttacgttccggttttaccggttccggggtttaccgggacggtaccggtaccgtaaaccggtcggttacccggtcccggtccgtaccgggtaccacccggttacccgacggtcccctcccggtacccccgtacgtaccttcccgttccggttaccccccg

SEQ ID NO: 130396 - DNA, 649 bp, Homo sapiens
  misc_feature: GYAE6OF01AZ253.22.36.D03.1.454.CMB.1.raw
  modified_base (203)..(203): a, c, t, g, unknown or other
  misc_feature (203)..(203): n is a, c, g, or t
  modified_base (221)..(221): a, c, t, g, unknown or other
  misc_feature (221)..(221): n is a, c, g, or t
  modified_base (237)..(237): a, c, t, g, unknown or other
  misc_feature (237)..(237): n is a, c, g, or t
  modified_base (430)..(430): a, c, t, g, unknown or other
  misc_feature (430)..(430): n is a, c, g, or t
  modified_base (493)..(493): a, c, t, g, unknown or other
  misc_feature (493)..(493): n is a, c, g, or t
  modified_base (604)..(604): a, c, t, g, unknown or other
  misc_feature (604)..(604): n is a, c, g, or t
tcagacatacgcgtcacgaccggtgctcgatttagctgcgtcacgatctctcgttggggggggtctcaggaggcagcgctctcgggacgtctccaccatggcctgggctctgctattcctcaccttcctcactcagggcacgagggtcctgggcccagtctcgccctgacccagcctgcctccgtgtctggatcatctggacngtcgatcagctatttccngcacgtcggaccaacngtgactagttcgggttctttgctcgtgtcctctcgtaaccaacaaccaccgacggaccccaaaccccccactcatctatttacgtggtactaccgcttccgtcggccctcgacgtactcctcctcgtacttcgtcttccgacgacgtccaccgtacgtctcgaccaaccgacccgtcccttaccctaaccctnttccgtccgtcggtcccttcgttacggttggaacggtacgttacgttctttaacgttattacncgtactttaacgtttaccgttaagttccggcctaaccttctttcggttacggttcggtttacgggacggtacgccgtaacggtacggtaccgtccccggtcgttacggacnccggaccgtcgcccgtaccgtcccgttcgccttcgttccctcccg

SEQ ID NO: 130397 - DNA, 942 bp, Homo sapiens
  misc_feature: GYAE6OF01BS9FJ.22.36.D03.1.454.CMB.1.raw
tcagacatacgcgtcacgaccggtgctcgatttagctgcgtcacgatctctcgttggggggggtctcaggaggcagcgctctcgggacgtctccaccatggcctgggctctgctattcctcaccttcctcactcagggcacgagggtcctgggcccagtctgccctgacccagcctgccctccgtgtctggatcatcgtggacagtcgatcagtacttacgtttcctgccgaccgtacggggaaccctaacgtaggtcgaacgttaggtttcggggtttccttttggaccttccgttcgtaccttccggttaacggtaaccaaaaccgaaacccgtaccccgaaccggaacccccctaaaacccccccaattaccgtaacttaccttaacgttttaacggtcgggttaccgttaccgtaaccgttcccgggtaccccgtaccccgttacggtaaacgggtaccgttcccgttaccgtaccgtaccgttcccggtttaccctttaccgtaccggtaaccgggtccctttaacccggtaacggtcccgggttacggaacccgtaaaccccggtacccgggttacccccttaaccccgtaaccttccggtttaccctccgggttaccgggtaccctttaaccggttacggtttacgggaacggtaaccggtttacttacccgtttaacgtttaacttaccggtacgttaccgttttaaccgtttttaacgtttaaacgggtccgggtaccccttaaccgtacccgtttacggttttaccggggtttccgggtttaccggggaccgggtaacggtacccggttaaccgggtacggtacccggttacccggttcccggtggtaaccctaccggaccccggttaaccggttacccccctaccccgggttacgtaacccgtccgttccgttacccccgttaaccccccg

SEQ ID NO: 130398 - DNA, 737 bp, Homo sapiens
  misc_feature: GYAE6OF01AHV0V.22.36.D03.1.454.CMB.1.raw
  modified_base (224)..(224): a, c, t, g, unknown or other
  misc_feature (224)..(224): n is a, c, g, or t
tcagacatacgcgtcacgaccggtgctcgatttagctgcgtcacgatctctcgttgggggggggtctcaggaggcagcgctctcgggacgtctccaccatggcctgggctctgctattcctcaccttcctcactcagggcacgagggtcctgggcccagtctgccctgacccagcctgcctccgtgtctggactcatctggacagtcgatcagtctatttccgngccacgtacgggaaccaacgtagtcgactaggtttcgggttcttttcggacttcgtcgtccttccgtacggtaacccaaaccaaccctaccccgaacggaccccctaaaaccccccactacctactcttatttacgtggttacgtccgtaccgtccggtccgtccgtacggagtctcctctacctacgtccgtcttccgtacgacgtcctacgtacgtcgtacgaccgaaccgtcccggtaccctacccgtaactcgttccgtcggtcggtaccttacggtacggttacggacggtaacgtcgttaccttaactttacgttacgtacgtacctttacgtttaaccgtttaacgtccgtaccgtaccgttaccgttccggtttacgggtttcggggttaccggacggtaccggtaccgtaccggtaacggtcccggtaccgtccggtaccggtaccgaccgtacccggtaccgtcccgtcccggtcccgtcggtacctccgttcccttaccccg

SEQ ID NO: 130399 - DNA, 1106 bp, Homo sapiens
  misc_feature: GYAE6OF01CFVRQ.22.36.D03.1.454.CMB.1.raw
  modified_base (240)..(240): a, c, t, g, unknown or other
  misc_feature (240)..(240): n is a, c, g, or t
tcagacatacgcgtcacgaccggtgctcgatttagctgcgtcacgatctctcgttggggggggtctcaggaggcagcgctctcgggacgtctccaccatggcctgggctctgcttattcctcaccttcctcactcgagggcacgagggtcctcgggccctagtctcgccctcgacccacgcctcgccctcgtgtcgtggactcacgtctcggacacggtcgatccgagtctactttccgngcacggtacgggaaccaagtacggtacgtacgtacggttttcgggttcttttacgtaccttcttcggttcctacgtacgtaacccaaaccgaaccacccgaaccggaacccccctaaaacccccgtactacctaacttacgttaacgtttacggttcgggttacgtaccgtaaccgttcccgggtccccggtacccgttaacgggaaccgggttaccgtttaccttacccttaaccgttacggttcccgtttccgttacccggttaccggtacgggttaaccccgtaacccggttaaacgggtttcccgtaacccgggtaacccctaaccccgggttaaccccggttaccccccttaaaccccggttaaacccttcgtttaccccgggtttacccgggtacccggggtttccccttaaccggggttttaacgggtttaaccggggtaaaccggggttaacccgggttttaacccgttttaaccgttttaaacccgttttaaccgtttaacccggtttaccgggtttaaaccccgttttttaaccggtttttaaaaccccggttttaaaacggttccccgggttaaccccgttacccggtttacccggttttacccgggttttaccggggggtttttacccggggttttacccgggggaaccgggttaaaccgggtttaaccccgttaaacccgggggtaaaccgggtttacccccgggttaacccgggttttcccccgggtaacgggttaaccccggtacccgggaacccccgggtttaaacccggttccccggttaacccccgggtttccccccgggttacggttttaacccccgtacccgtttccccgtttaaacccccccggg

SEQ ID NO: 130400 - DNA, 726 bp, Homo sapiens
  misc_feature: GYAE6OF01BYJX0.22.36.D03.1.454.CMB.1.raw
  modified_base (225)..(225): a, c, t, g, unknown or other
  misc_feature (225)..(225): n is a, c, g, or t
  modified_base (434)..(434): a, c, t, g, unknown or other
  misc_feature (434)..(434): n is a, c, g, or t
  modified_base (712)..(712): a, c, t, g, unknown or other
  misc_feature (712)..(712): n is a, c, g, or t
tcagacatacgcgtcacgaccggtgctcgatttagctgcgtcacgatctctcgttgggggggggtctcaggaggcagcgctctcgggacgtctccaccatggcctgggctctgctattcctcaccttcctcactcgagggcacgagggtcctgggcccagtctcgccctgacccagcctcgcctccgtgtctgatcatcgtggacagtcgatcagctactttccngccacgtacgggaccaagtagtagactagtttgggtttcttttacgacttcgtgttccgtccgtacggtaaccaaaccaaccgtaaccccgaaccggaaccccctaaaaccccccccaactacctacttacctattttaacggtcggtctacctaccgttccggtcccggtccctacggaagtacgttcctactctactcgtaccttcncgtacgtcctacgtaacgtcgtacgacaaccgtcccgaccctaaccctaactcgtccgtacgtcggtcctacgtacggttcgaacggtacgtacgttaccttaagttacgtacgtctaccgtttaacgtttaacctttaaggtccgtacccgtaccgttacgtttcggtttcgggtttcgggtttaccgggacggtacgtaaccgtacgggtaacgtccggtaccgttccggtccggacgtacccgaccgtacgcccgttcccggcccgtacgttccnccgttccgtccccg

SEQ ID NO: 130401 - DNA, 854 bp, Homo sapiens
  misc_feature: GYAE6OF01C6YN2.22.36.D03.1.454.CMB.1.raw
  modified_base (232)..(232): a, c, t, g, unknown or other
  misc_feature (232)..(232): n is a, c, g, or t
  modified_base (840)..(840): a, c, t, g, unknown or other
  misc_feature (840)..(840): n is a, c, g, or t
tcagacatacgcgtcacgaccggtgctcgatttagctgcgtcacgatcgtctcgttgggggggtctcaggaggcagcgctctcgggacgtctccaccatggcctgggctctgctattcctcaccttcctcactcgacggcacgagggtcctgggcccagtctcgccctcgacccagcctcgcctccgtgtcgtggatcatcgtaggacaggtcagtcacgtctactttccgngcacgtcggaaccaacgtaggtcgtaacgttaggtttcgggtttcttttcggtaacttcgtccggttaccttacccggttaccggtaaaacccaaaaccgaaaccccgaaccccggtaaccgggaaaccccccctaaaaaacccccccctaattaccaaaccttaccgtttaaacgtttttaacggtcgggttaccttacctaccggttcccggttacccggtcccctaaggtaaacgggtctttaccctcgttaccgtaccttccggttaccttccgttacggaaccgttcccgtaacgttaacggttccgtaacgggaaccaaacccggttaccccggtaacccctttacccgaaccttacgtaccgttcggtacggtcccttacggtacgttacggaacgttacgtacgtttaccgttaacttaacgtactcgttaacttaacggtttaaccgtttaagaaccggtcctaccgtttaccgttcggttacgggtttccggttacgggacgttaacggccgtaacggtacggttcgtacccggttcgaccggttaccggaaccgtacccggttacgcccgttaccccggtcccgttacgggtacccncggtccgtaccccg

SEQ ID NO: 130402 - DNA, 732 bp, Homo sapiens
  misc_feature: GYAE6OF01BMXC7.22.36.D03.1.454.CMB.1.raw
  modified_base (250)..(250): a, c, t, g, unknown or other
  misc_feature (250)..(250): n is a, c, g, or t
  modified_base (492)..(492): a, c, t, g, unknown or other
  misc_feature (492)..(492): n is a, c, g, or t
tcagacatacgcgtcacgaccggtgctcgatttagctgcgtcacgatctctcgttggggggggtctcgagggaggcagcgctcgtcgggacgtctccaccatggcctgggctctgcttattcctcaccttcctcacgtcgagggcacgagggtcctcgggcccagtcctcggtcccctcgacccacgcctgccctccgttgtccgtaggactctatcgtaggactaggtcgatcgaatctacgtttccgngactacgacgggaaccagtagtagacgtaggtttcgggttacctttgaccgtcgtcgtccgttccgttacgaacccaacgaaccaccccgaacggaaccccaacccccttaatactacttacttaaggttacgtcggtactccgtaccgtcgaccgcctcgaagtctcgacctacagtccgtcttaccgtagcttcgtaacctaggcctcgaccgaaactcccgtcctaaccaactcgtacncgtagtccgtagtagttacgaccggtaagtaccgtattacttacgtcggtactacttaagtttaaccgtttaacgcgtaccgtcctaacggtccttgggttaaccggttcccggaggttacccgtaggaaacgacgtttcccgaaccgggttacgaccggttaaccccggaggttaaccccgaaagttccggtaaaccccccgggtcctaacccggggtccttcccgtcccgtttcccgg

SEQ ID NO: 130403 - DNA, 656 bp, Homo sapiens
  misc_feature: GYAE6OF01AKIZ9.22.36.D03.1.454.CMB.1.raw
  modified_base (273)..(273): a, c, t, g, unknown or other
  misc_feature (273)..(273): n is a, c, g, or t
  modified_base (332)..(332): a, c, t, g, unknown or other
  misc_feature (332)..(332): n is a, c, g, or t
  modified_base (635)..(635): a, c, t, g, unknown or other
  misc_feature (635)..(635): n is a, c, g, or t
tcagacatacgcgtcacgaccggtgctcgatttagctgcgtcacgatctctcttggggggggtctcaggaggcagcgctctcgggacgtctccacatggcctgggctctgctattcctcaccttcctcactcagggcacacgggtcctgggcccagtctcgccctgactcagccctcccgtcgcggtccggtctccgtggacagtcagtccaccgatcctccgtcggccacgtacggaaccagcaggtggtacgttgggtacgttaacaagtntcgtctcgtacgtaccacaccacacgcacgaccgaccccaaagtccatacgtatttacnggtacggtacaacgtaacgcggccgacgtacggggtcctagtcgtcgtcttcgtcgtgcctcgtaacgttcgtggaccgtaccgccggtaccctcccgtacgtacccgttcgtcgtccggtacctccgtacggcgttacggaacggtcgacggtacggtccgttaagtaactttactagtaccgtcttaacctgaacttcgacgcgacgggtcgtaactacttcggttacggcggttcgggtacggaccggtacgtacgtcgtcgtacccggtcgtaccgtacgacccgtaccgacggtcccnccccgtcccggtccgtaccgg

SEQ ID NO: 130404 - DNA, 875 bp, Homo sapiens
  misc_feature: GYAE6OF01DGO71.22.36.D03.1.454.CMB.1.raw
  modified_base (626)..(626): a, c, t, g, unknown or other
  misc_feature (626)..(626): n is a, c, g, or t
  modified_base (808)..(808): a, c, t, g, unknown or other
  misc_feature (808)..(808): n is a, c, g, or t
tcagacatacgcgtcacgaccggtgctcgatttagctgcgtcacgatctctcgttggggggggtctcaggaggcagcgctcgtcgggacgtctccaccatcggccgtgggctctgtctacttcctcaccttcctcactcgagggcacgtacgggtccgtcgggccctagtcctcgccctcggacccacggtcctcggtccctccggttcgtcgtacggactcctacgtcgtacggactacggttacacgtacagtaccttacttttccgtacgccgtaaccggtacgggaacctaacgttacggtacgttaacggttcggttttacggggttttccttttaccggtacttttccgtccggtttaccgttaccggttaaccggaaaaccctaaccgtaaaccccaaccccggtaaccccggaaaacccccctaaaaccccccctaacttacctaaactttaccgtttaacgtttaacggtcgggtttaactcccggttaaccggtcccggttaccggtaccctacggaaccgttccgttcctaccgttacgtctcccgttcttcggtaccgtaccgtaccgtacgttaacgtcgttaccggaactaaccgtcccgtaccttaacccncgtacctccgtacggtcgtaccgttacgtacggttaacgacggtacttaacgttacgtttaactacgttacgtacgtttacttaacgtttaacgttaacggtcgacccgttcgtaccgtttcggttcgggttcggttacggaccgtacggaccgtacgggacgttcccgacggttacccggngtaaccgcccgtcggtaacccttcccggacccgttccggtaaccttccgaacccttttccggtcccc

SEQ ID NO: 130405 - DNA, 618 bp, Homo sapiens
  misc_feature: GYAE6OF01D89NK.22.36.D03.1.454.CMB.1.raw
  modified_base (218)..(218): a, c, t, g, unknown or other
  misc_feature (218)..(218): n is a, c, g, or t
  modified_base (310)..(310): a, c, t, g, unknown or other
  misc_feature (310)..(310): n is a, c, g, or t
tcagacatacgcgtcacgaccggtgctcgatttagctgcgtcacgatctctcgttggggggggtctcaggaggcagcgctctcgggacgtctccaccatggcctgggctctgctattcctcaccttcctcactcagggcacagggtcctgggcccagtctgccctgacccagcctgcctcgtgtctggatcatctggacagtcgatcagctatttccngccactgggaaccaagagtgactagtttgggtcttttgactctgtctcgtggtaccaacaccaccaggcccaacccccatcatactatttanggtgtcacttcgcgccctgaggctctactcactccgtcttctcacggcctaccgaagtcgtacggaccaaccgccggtacccctacccgtaacctacttccgtcgtacgggtccttacccgtaggtttacgaacggtacgtacgttctttaacttacgtttactggtacttacgtttacctttaagttccgaccgtacctacttccgttacggtttcgggtttaccgcgggtacgacctacgtacgtcgtacccgtcgtaccggctacgacccgagacccgtccgcccctggtcctgtcccgttcccg

SEQ ID NO: 130406 - DNA, 819 bp, Homo sapiens
  misc_feature: GYAE6OF01DYVV5.22.36.D03.1.454.CMB.1.raw
  modified_base (248)..(248): a, c, t, g, unknown or other
  misc_feature (248)..(248): n is a, c, g, or t
tcagacatacgcgtcacgaccggtgctcgatttagctgcgtcacgatcgtctcgttggggggggtctcaggaggcagcgctctcgggacgtctccgccatggcctgggctctgctacttcctcaccttcctcactcgacgggcacgacgggtccgtcgggccctagtctcgccctacgacccacgcctcgcctccggtgtcgtggactcgactccgtggactagttcgactcgacgtcttactttccncgaccgtacgtacgggaacctaacgaggtacgtacgttaggtttcgggtttacttttacggtaccttcgttcgttcccgttaccgttaccggtaaacccaaaccgaaccccgaaccccggaacccggtaaacccccctaaaacccccccgtatacctaacgtttaccgttaacggtttaccggtcggttaccgtacccgtccgttacccgggtacccgtaccgtacggtaacgtccgttcctaccttacgtaccgttccgttccgtaccgtacgtaccgtacctaacgtcgtacgtaccgaaccgtacccgtacccttacccgtaacctactacgttcccgtcggtcttaccgtaagttcggtaacggcgtaacgttcttactttacgtacttacgtacgtttaactttaaccgtttaacgtaacggtccgtaaccttcctttacggtttcggtttacgggttcggtaacggcggaaccgtaccgtaacggtcctccggtaccggttcgcgtaaccgccggtaccgtcgtcccgtcccgttccggtacctccgtccgtcccggttcccccg

SEQ ID NO: 130407 - DNA, 736 bp, Homo sapiens
  misc_feature: GYAE6OF01CH5PB.22.36.D03.1.454.CMB.1.raw
  modified_base (229)..(229): a, c, t, g, unknown or other
  misc_feature (229)..(229): n is a, c, g, or t
  modified_base (438)..(438): a, c, t, g, unknown or other
  misc_feature (438)..(438): n is a, c, g, or t
tcagacatacgcgtcacgaccggtgctcgatttagctgcgtcacgatctctcgttgggggggggtctcaggaggcagcgctctcgggacgtctccaccatggcctgggctctgctattcctcaccttcctcactcgagggcacgagggtcctgggcccagtctgccctcgacccagcctgcctccgtgtcgtggatcatcgtggacagtcgatcagtcctacttttccngctaaccgtaggggaacccaaagtacggtagaacgttaggtttcgggtttcctttttcggacttaccgttcgttccttcccgttacggtaaaccctaaaccaaccaccccgaaccgggaacccccaaaaccccccctaactaccacgttacttaactttaacgtggtcgtactctcggtccgcctcgaggactctctcactccgtctcncgacgtcctacgagtcccccgaggtacaacccgaccgtcccgtaacctaaccctactcccgttcgtcggtcctccgttaggttacggacggtacgtcgtacgttaactttactctacgtacttaacgtttaacttaacgtcgaccgtccgtaccgttcgttcggtttcgggttccgggacggtacggaccgtaccgggtaccgtcggtacccggttccggtacggttacccggcggtacccgtacccgggacggttccccctaccccggttcggtacccctccgttcccgttccccgg

SEQ ID NO: 130408 - DNA, 923 bp, Homo sapiens
  misc_feature: GYAE6OF01B6YPA.22.36.D03.1.454.CMB.1.raw
tcagacatacgcgtcacgaccggtgctcgatttagctgcgtcacgatctctcgttgggggggtctcaggaggcagcgctctcgggacgtctccaccatggcctgggctctgcttactcctcaccttcctcactcgacgggcacgtcgggtcctacgggcccagtcgtacgccctgacccagccctgcccttccggtgtcctaggtactcagttcgacgggactagtaccgatccgagccttaactttccgtcgaccgacgtacgggaacctaacgtcggtacgactttacggtttcggggtttcttttacggacctttcgttccgttaccgttaccggtttaaccggtaaaacccaaaaccgtaaccccgaccccggaaaccggtaaaccccctaaaaccccccgtattacctacttacggttaacgttttacgtcgggtttaccaccgttacgttcccggttaacccggcccgttacggaaccggttcgttcctaaccgttcccgtaacggtacccggttccttcccggtcgaaacccggttaccgttacctaacgggtccgggtaacgtaacccggtaaccggtacccggtaaccccttacccgtaaacgttccgttaccgttacggttcccgggtaccgttaccgttagggttaacggaacggtaccgttacgttaccgtttacctttacgtaccgttcgttaacccgtttaagtttaaaccgtttaacggtccgtaccgttaccgttaccgtttccggttaccgggtttacgggtttccggacgggtttaccggtccggtaaccgggttaccttccggtaaccgttccggttaccggtaccgttaccgggaccccgtaacggtccccggttaacccgtccccggttaccgtttcccgttacccggttcccgttaccccg

SEQ ID NO: 130409 - DNA, 650 bp, Homo sapiens
  misc_feature: GYAE6OF01EPMXM.22.36.D03.1.454.CMB.1.raw
  modified_base (208)..(208): a, c, t, g, unknown or other
  misc_feature (208)..(208): n is a, c, g, or t
  modified_base (227)..(227): a, c, t, g, unknown or other
  misc_feature (227)..(227): n is a, c, g, or t
  modified_base (246)..(246): a, c, t, g, unknown or other
  misc_feature (246)..(246): n is a, c, g, or t
  modified_base (250)..(250): a, c, t, g, unknown or other
  misc_feature (250)..(250): n is a, c, g, or t
  modified_base (357)..(357): a, c, t, g, unknown or other
  misc_feature (357)..(357): n is a, c, g, or t
  modified_base (485)..(485): a, c, t, g, unknown or other
  misc_feature (485)..(485): n is a, c, g, or t
  modified_base (511)..(511): a, c, t, g, unknown or other
  misc_feature (511)..(511): n is a, c, g, or t
tcagacatacgcgtcacgaccggtgctcgatttagctgcgtcacgatctctcgttgggggggggtctcaggaggcagcgctctcgggacgtctccaccatggcctgggctctgctattcctcaccttcctcactcaggggcacgagggtccgtcgggcccagtctcgccctgacccagcctgcctccgtgtctggatcatcgtggacngtcgatcagctacgtttcngtcacgtcgggaccaacgnggtnacttagttcggttctttgacttcttcggtccttaccgtacgtaaccaacgaaccacccgaccggaacccccaaacccccactacactactacttagtcggtcgtacncgttccgccgtcctacgacgacgtctctcagtcgtcttcgaccgacgtcctacgtaacgttcgcgtaccaacgtcccgtcccttacctcggtccctccgtcgtacgggcctacggcgtctaggaacgngtgacggtctaggtacttacgttacncgacttactctaagtcgtacgcggtacgacgacgttaacgttcgggtacgggttccggtacgggaccgggtaacggaacgtcgtaccggtcgtaccggttacgtaccggacgaacgtcccggtacgttcccgaacccgg

SEQ ID NO: 130410 - DNA, 748 bp, Homo sapiens
  misc_feature: GYAE6OF01BV5QU.22.36.D03.1.454.CMB.1.raw
  modified_base (209)..(209): a, c, t, g, unknown or other
  misc_feature (209)..(209): n is a, c, g, or t
  modified_base (223)..(223): a, c, t, g, unknown or other
  misc_feature (223)..(223): n is a, c, g, or t
  modified_base (428)..(428): a, c, t, g, unknown or other
  misc_feature (428)..(428): n is a, c, g, or t
tcagacatacgcgtcacgaccggtgctcgatttagctgcgtcacgatctctcgttggggggggtctcaggaggcagcgctctcgggacgtctccaccatggccgtgggctctgcttattcctcaccttcctcactcgaggcacgagggtcctggccagtctcgccctgacccagcctcgcctcgtgtctggatcatctggacagtcgancagcttactttccngactacgtcgggaaccaactagtgacttaggtttggtttctttgtacttcgttacgtcttaccgtacgtaaccaaccaaccaccgaccgaccccaacccccaatcaactcttatttagtcgtactcacgtccgtcccggacctcgacgtctctcctactactcgtcttacgtaccgtacgtcctacgtacgtcgtcgaccgaacncccggtccctaaccctaaccgtcttccggtacggttccggtccgttacgttagggttaccgaagggttaccggtactttacggtttaaccgtttagtttaccgagtttacctttaacgttttacgtttaaacgttccgggtaccttaccccggtttacgttccggtttacggttttccggggttcgggtacgggtacccggttaacggtaaccgaccgggtttaaaccggttcccggttccgttacggtaccgtacccggacccgtacggtaccgttccccgtacccggttcccgtccgtaccgttcccgttacccccgg

SEQ ID NO: 130411 - DNA, 601 bp, Homo sapiens
  misc_feature: GYAE6OF01B891W.22.36.D03.1.454.CMB.1.raw
  modified_base (232)..(232): a, c, t, g, unknown or other
  misc_feature (232)..(232): n is a, c, g, or t
  modified_base (302)..(302): a, c, t, g, unknown or other
  misc_feature (302)..(302): n is a, c, g, or t
  modified_base (306)..(306): a, c, t, g, unknown or other
  misc_feature (306)..(306): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacngtgacattggtctttgactctgtctctggtaccaacaacaccgacgacccaaacccccatcatctattanggtntcactcgtcgccctgaggacgtctctcatcgtcttctcaggtctacagtctggacaacgccgtccctaccaacctctcctcgtcggccttaccgtaggtttcgacggtacgtacgttaccttaacgttacttactgtacgttaacgttttaccctttaaagtcggtacctaccctacgttcgttcggtttacgggtttccgggacggtacggtccgaaccggtacgtaccggtacccgtccgtcggtacaccgtaccgaacggtcctccgcccccgtgtcctcgttccgttcccg

SEQ ID NO: 130412 - DNA, 700 bp, Homo sapiens
  misc_feature: GYAE6OF01DSNNN.22.36.D03.1.454.CMB.1.raw
  modified_base (230)..(230): a, c, t, g, unknown or other
  misc_feature (230)..(230): n is a, c, g, or t
tcagacatacgcgtcacgaccggtgctcgatttagctgcgtcacgatctctcgttggggggggtctcaggaggcagcgctctcgggacgtctccaccatggcctgggctctgctattcctcaccttcctcactcgagggcacgtagggtcctgggcccaggtctcggccctgacccagcctgcctccgtgtctggactcatcgtggacaggtcgatcagtctatttccgngcctacgtcgggaaccaacgtgtcgactaggtttgggtttctttaggacttcgtcgttccttccgttacggtaaccaaactaaccgtaccccgaacggtacccccaaaaccccccgtaatccaacttacgtacttttaggtcggtacgtcctaccgtccggtccgccctagacgggtctcctctcgtactccgtcttcgtcgacggtctaccgtaacggtctacggaaccaccgtacccgacccttacccgacttctccgtcgtcgggtacctcgtaggttggacgtcgtattcttacttacgtctcgtcgttaacttcgttaacgcgacctccgttagttcgttcggtttcggtacgggtcgaaggcccgtaacggccgttccggaccgttcggttccggaactcccgaaccgggtcgtcccggttacccgtcccccggttagtacccgtcccgttccgggtttccccg

SEQ ID NO: 130413 - DNA, 782 bp, Homo sapiens
  misc_feature: GYAE6OF01D33AE.22.36.D03.1.454.CMB.1.raw
tcagacatacgcgtcacgaccggtgctcgatttagctgcgtcacgatctctcgttggggggggtctcaggaggcagcgctctcgggacgtctccaccatggcctgggctctgctattcctcaccttcctcactcgagggcacatggtcctgggcccagtctgccctgacccagcctgcctccgtgtctggactcatcgtggacagtcgatcagctatttccgtgccacgtcgggaaccaacgtagtagaccgtagtttcgggtttcttttacggacttcgtcgttccttaccgtacggtaaccctaaaccaaccgaccccgaaccggtaaccccaaaacccccccattacaactacttagtttacgtcggtcgttcctaaccggttccggtacccggtcccgtacgaggtacttccttacgtctattccgtcttcctacgacggtcctaccgaagtccgtacggacctaaaccgtaccggtacccctaacccgtaacctccttaccgtcgtacggtccttacgtaggtttacggaacggtacgttacgttaccttaactttacgttacgttgtaacgtttaacgtttaacgttttaaacgttaccggtccttaccgttacgttaccggtttacgggtttcgggtttaccgggacgggtaaccgtaccgtaaaccggtacggttacccggttacccgttacccggtacggtcccgacccggtaccccgtaacgggtcccgtaccccggttccccggttaccgttcccgtacccgtttccccgg

SEQ ID NO: 130414 - DNA, 729 bp, Homo sapiens
  misc_feature: GYAE6OF01EWBO5.22.36.D03.1.454.CMB.1.raw
  modified_base (261)..(261): a, c, t, g, unknown or other
  misc_feature (261)..(261): n is a, c, g, or t
  modified_base (313)..(313): a, c, t, g, unknown or other
  misc_feature (313)..(313): n is a, c, g, or t
  modified_base (377)..(377): a, c, t, g, unknown or other
  misc_feature (377)..(377): n is a, c, g, or t
  modified_base (682)..(682): a, c, t, g, unknown or other
  misc_feature (682)..(682): n is a, c, g, or t
  modified_base (690)..(690): a, c, t, g, unknown or other
  misc_feature (690)..(690): n is a, c, g, or t
tcagacatacgcgtcacgaccggtgctcgatttagctgcgtcacgatctctcgttggggggggtctcgaggaggcagcgctcgtcgggacgtctccaccatggcctgggctctgtcttattccctcctacctttcctacactcgagggccaacggcgggttcctcgggcccagtcctcgccctacgacccacgtcctcgtccttccgtgtcgtggactcctatcgtcggaactggtacgagtcacgtcgttacttttccgngacgtacggtaccggaaccaacgtggtagtacgttaggtttcggtttacttnaccttcgtctacgtccgaacgtaacccaacacccgacccgtaaccgaacccccaaaaccccctntactacgtttaccttatttagtccggtacttaccgaccgttccgacccggtctagacggtaccttctcgtactcggttactcttcgactcggtaccacggttacgttaccgaccggtaacccaaccgggtaccctaccctacctactaccgtccgtacgtcggtcctgtacggtcgacgtactacgttattacctagtactacgtattaaccggttttacttaacggtccgtaaccctctaccgttcggtttacgttcgggtcgacggtaacgaccgtagtacgtccgtaccgtgtaccggaccnccggaacncccggtccgtacccgtccttacgccttcgtccccgtccc

SEQ ID NO: 130415 - DNA, 877 bp, Homo sapiens
  misc_feature: GYAE6OF01BL8C9.22.36.D03.1.454.CMB.1.raw
  modified_base (245)..(245): a, c, t, g, unknown or other
  misc_feature (245)..(245): n is a, c, g, or t
  modified_base (269)..(269): a, c, t, g, unknown or other
  misc_feature (269)..(269): n is a, c, g, or t
tcagacatacgcgtcacgaccggtgctcgatttagctgcgtcacgatctctcgttggggggggtctcaggaggcagcgctctcgggacgtctccaccatggcctgggctctgctattcctcaccttcctcactcgagggcacgacgggtccgtcgggcccagttctcgcccctagacccgagcctcgtccgttccggtgtctaggtatcatcgtggacctgtcgtactacagtcttactttccgngacctacggtacgggaacctaagnggtacgtaacttcggtttagggtttccttttcggtactcgttcgttctaccgtacggtaaccaaaccgaaccgaacccgaccggaaccccctaaacccccaactactaactacttagtttaacgtgttaccgtctaccgttccgtcccgaccgttgacgggtaccttcctactacgtcttctccttacgacctggtaccctacgtacctcgggacaaccgtaaccgaccgtcccttaacctaaccgtcgttccgttacgggtccgttaaccttacggttaacggttacgaacgggtactttaaccgtccgtttaacgttaacgttaccgtacggtttaaccgtttaaaccgttttaacccgtttaagggtacccgtacctttacccggtaccggttttaaccgggttttcggtttaacccggggttcggggtaacccgtaccggggtaaccgttaaaccgggttaccggttaccccgggtttaccgttaccccggggtaccggttacccggtaaacccgtaacccgggtacccgggtttccccgtacccccggttacccccgttaaggggtttaccccttccccggttacccggtttacccccccggg

SEQ ID NO: 130416 - DNA, 815 bp, Homo sapiens
  misc_feature: GYAE6OF01BMCCV.22.36.D03.1.454.CMB.1.raw
  modified_base (231)..(231): a, c, t, g, unknown or other
  misc_feature (231)..(231): n is a, c, g, or t
  modified_base (251)..(251): a, c, t, g, unknown or other
  misc_feature (251)..(251): n is a, c, g, or t
tcagacatacgcgtcacgaccggtgctcgatttagctgcgtcacgatctctcgttgggggggggtctcaggaggcagcgctctcgggacgtctccaccatggcctgggctctgctattcctcaccttcctcactcagggcacgagggtcctgggcccagtctcgccctgacccagcctgcccttccggtgtcgtggactctatcgtggacagtcatcgagtctactttccncgcacgtcgggaaccaacgngtacgactagttgggttcttttcggaccttcgtcgtaccttccgtacggtaaccaaaccgaacccacccgtaaccgaacccccaaaaccccctatacctacttactatttacggtcggtactacctacggtccggttcccgacccttcggaacgggtcttccttactacgtacgttccgttccttaccgtacggacgttccctacgttaagtccgtacggaccaaccgtacccggtacccttaccctaaccgttcgttcccttccgggtcgtacccgttacggttaaggttaccgggaacggtaacgttcttaacttttaactacgttcgttaccgttacgtttaaccttttaaccggttaaacgtccggacccgttacctaaccgggtttcggttttccgggtttcgggtttaccggggacggtacccgggaaccgttaaccggggtacgtaccccggttacccggttcgggttaacccggaccgtcccggtaacccggttccgggaccccttccccggtaccccggttaccgacccgttttccggttccccggttccccccg

SEQ ID NO: 130417 - DNA, 668 bp, Homo sapiens
  misc_feature: GYAE6OF01EAYCN.22.36.D03.1.454.CMB.1.raw
  modified_base (172)..(172): a, c, t, g, unknown or other
  misc_feature (172)..(172): n is a, c, g, or t
  modified_base (233)..(233): a, c, t, g, unknown or other
  misc_feature (233)..(233): n is a, c, g, or t
  modified_base (236)..(236): a, c, t, g, unknown or other
  misc_feature (236)..(236): n is a, c, g, or t
  modified_base (256)..(256): a, c, t, g, unknown or other
  misc_feature (256)..(256): n is a, c, g, or t
  modified_base (274)..(274): a, c, t, g, unknown or other
  misc_feature (274)..(274): n is a, c, g, or t
tcagacatacgcgtcacgaccggtgctcgatttagctgcgtcacgatctctcttggggggggtctcaggaggcagcgctctcgggacgtctccaccatggcctgggctctgcttattcctcaccttcctcactcgagggcacagggtcctgggcccagtctgccctgacccngcctgcctcgtgtctggatcatctggacagtcgatcagctatttccagcacgtggaccaangtnactgttggtctttgactctntctctgtaccaacaaccnccacgaccccaaaccccctatcacgtctattagtggtctcactcgtccgtacctgaaggtctcctctacgacttcgtcctttcgcgtacgtcctaacctagtcgtacggtaccaaccgtccgtacccttaccccgtaactacttccgttcgtcgggtccttccggtagttcggaacgtcgtacgttacttacgtttactcgttacgtacgtttacgtttaaccgttttaaagtcggtaccgttacctaccgtttcggttaccgggtttcgggtttacggacgggtaaccgtccggtaaacggtaccggttccggtaccccgttcgtttaccgggacctacccggccgtaacggtccttcccgtacccccgtggtaccctaccgttcgtaccccg

SEQ ID NO: 130418 - DNA, 620 bp, Homo sapiens
  misc_feature: GYAE6OF01CCR17.22.36.D03.1.454.CMB.1.raw
  modified_base (219)..(219): a, c, t, g, unknown or other
  misc_feature (219)..(219): n is a, c, g, or t
  modified_base (263)..(263): a, c, t, g, unknown or other
  misc_feature (263)..(263): n is a, c, g, or t
  modified_base (467)..(467): a, c, t, g, unknown or other
  misc_feature (467)..(467): n is a, c, g, or t
tcagacatacgcgtcacgaccggtgctcgatttagctgcgtcacgatctctcgttggggggggtctcaggaggcagcgatctcgggacgtctccaccatggcctgggctctgctattcctcaccttcctcactcagggcacgagggtcctgggcccagtctgccctgacccagcctgcctccgtgtctggatcatctggacagtcatcagctatttccngcacgtcgggaaccaatagtgactagtttggttcttttgacttntgtcctcctacggtaaccaacaaccacccgagaccccaaaccccccaatcattcatttatggtcgtctactcgtccggccctagagtactctctcgtatcgtcttctcgacgtcctaccgaagtccgtagaccaacgtacccgccctaccctaacctctctcgtggcctcgtagtttggagtacgtattcttacttatacgtanacgttactttaaccgtttaagtccggccgtaccttacgttccttggttcgtttaccgggcggtacggtctaacggtacgtaccgtaccgtccgtacggccgtacgcccgaagtcccgtccgtcccccgttacggtccctcgttcccgtcccgg

SEQ ID NO: 130419 - DNA, 833 bp, Homo sapiens
  misc_feature: GYAE6OF01CEYCW.22.36.D03.1.454.CMB.1.raw
  modified_base (180)..(180): a, c, t, g, unknown or other
  misc_feature (180)..(180): n is a, c, g, or t
tcagacatacgcgtcacgaccggtgctcgatttagctgcgtcacgatctctcgttgggggggggtctcagggaggcagcgctctcgggacgtctccaccatggcctgggctctgctattcctccaccttcctcactcgagggcacgacgggtcctcgggcccagtctcgccctcgacccncgtcctcgtccttccgtgtcgtggtactcagtcgtggactaggtcgatcacgtcttactttccgtgcgtacgtacgggaccaacgtagtacgtacgttacggttggtttccttttcgaccgtttcgttacgttaccttcccgttaacggaaacccaaacccaacccgacccccggaaccggtaaccccccaaaacccccctactacctaagttcgttaagttttacggcggtttaccgtaccgttaccggtccccggtacccgggtaccgttaccggtagggtacccgttctaccttacgtaccggtttccgtaccttcgtacgtcggtaaccctacgttaacggtccgtaacgggaccctaaaccccgtacccggttcccctaaacccttacgttcccgttacccggttcgttccggttacccgttaacggttacgggtaacggtaaccggttacggttaactttaccggtttaactttacgtaccttcggtaacctttacggttttaacgttaagtccgttacctaccgttcgtttcggtttcgttccgggttagggaccgtaccggtacgtacgtaccgtaccgtaccgtccggtacgacgtaccggcccgtagcccgtacccggtccgtcctcctcgtcccgttccccg

SEQ ID NO: 130420 - DNA, 1004 bp, Homo sapiens
  misc_feature: GYAE6OF01EQEPJ.22.36.D03.1.454.CMB.1.raw
  modified_base (199)..(199): a, c, t, g, unknown or other
  misc_feature (199)..(199): n is a, c, g, or t
  modified_base (227)..(227): a, c, t, g, unknown or other
  misc_feature (227)..(227): n is a, c, g, or t
tcagacatacgcgtcacgaccggtgctcgatttagctgcgtcacgatctctcttgtgggggggtctcaggaggcagcgctctcgggacgtctccacctatggcctgggctctgctattccctcaccttcctcactcagggcacgagggtcctgggcccagtctcgccctgacccagcctgcctcgtgtctggatcatcnggacagtcgatcgagtcctaattttccngacctacgtacggggaacccaaagtagtagaacgtacgtttttcggggttactttttcgaacttccgtacgttccttccgtacggtaaaccctaaaccaaacccctaccccgaaccggaacccccaaaacccccccaactacctaacttaccgtaattttaggtcggtttaccgtaccttaccgttaccgggttccgggtaccccttacgaacgggttacgttacctttaccgtaccttaaaccgttcggttacccttttaccgttaccccggtaaacggggttaccccttaaccccggttaaaaacggttcccgggtttaaacgggaaccccttaaaaaccccgggtaacccgggttcccccctttaaccccccggttaaaacccgttaaccgtttccccggtttaccggtttaacccgggggtaaccccgtttaaaccccggtttaaagggtttcccggtaaaacgggggtttaacccgttaaaccgggtttaccttttaaacctttaccgtttttaaacccgttaacggtttaaccggtttaaccgttttaaccccgttttaaaggtttaacccggtacccgttaacccgtttaaccgttaccgggttacggttttccggggttttaccgggacggggttaccgaacccggttaaaccgtaaccgggtcggttaaccccggttcccgggttaacggcccgttaccggaaccccgtaccgggtaccgttaccccgggttaccccccggttacggttccccgtacccgtttccccg

SEQ ID NO: 130421 - DNA, 818 bp, Homo sapiens
  misc_feature: GYAE6OF01BRAFG.22.36.D03.1.454.CMB.1.raw
tcagacatacgcgtcacgaccggtgctcgatttagctgcgtcacgatctctcgttggggggggtctcaggaggcagcgctctcgggacgtctccaccatggcctgggctctgctattcctcaccttcctcactcagggcacgagggtcctgggcccagtctcgccctgacccagcctcgcctccgtgtcgtgatcatcgtgacagtcgatcagctactttccgtgccgacgtacgggaccaacgtagtacgtacttaggtttcgggtttacttttcggaaccttcgttcgttcccgttaccgttaacggtaacccaaaaccaaaccccgaccccggtaacccggaaacccccccaaaaacccccccctaagtttacctaacttactttaaacgttttacggttcggtccttaccggtaccgttccggtcccggcccttagaacgggttcctcgtcctacgtctcgtcttccgacgtcgcctacgtacgtcgtacggaaccaccgtacccgtacctaccctaactactccgtacggtccggttactacgttacgtttggaaacgtccgtacgtttacttaacgttacgttaccgtacgttacgttaccgttttaaaccgtttaacggtccgtaccgtacccgttacgtttcgggtttaccgggttttccgggtttacgggaccggttacggtacccggtaaccggttaacggttcccgtacccggttccggttacccggtcgaaccccgggtaacccgtacggtccccgttccccgggtcccgttaccggtaccttaacccgttcccgttaaacccccg

SEQ ID NO: 130422 - DNA, 764 bp, Homo sapiens
  misc_feature: GYAE6OF01BOE7L.22.36.D03.1.454.CMB.1.raw
  modified_base (180)..(180): a, c, t, g, unknown or other
  misc_feature (180)..(180): n is a, c, g, or t
tcagacatacgcgtcacgaccggtgctcgatttagctgcgtcacgatctctcgttggggggggtctcaggaggcagcgctctcgggacgtctccaccatggcctgggctctgtctattcctcacctttcctcactcgagggcacgacgggtccgtcgggcccagtctcgccctcgacccngcctcgcccttccggtgtcgtaggtactcgtactccgtaggactagtcgatcgagtctacttcctgactacggacggaaccagtaggtacgtacgttaggttgggttttactttcgtaccttcgttcgttccgttaccggttaccgaaaccaaacccgaaccaaccccggaaccggtaaaccccaaaacccccctaatactaacctttacgttacgtttaacgtggtaccgtccgtaaccgttccggccgtaccgtagaacgtcgtctccacgtactccttctcgtcgaccgtctaacgtacggtaccgagaacccgtaaccgtcccgttaccctaacccgtactaaccgttctaccggtcgtcttacgtagggttacgaacggttacgtcttaaccgtttattaccgtactcgttaacgtttacgtttacttaacggtccgaccgttcctacgtttcggttgtttaccgggtcggacgtacggtaccgtacgtcggttacccgccggttcgacggaccgtacccgaaccggtccgtcccgtaacccggtcccgttaccgtccttcccgttcccgttacccccg

SEQ ID NO: 130423 - DNA, 851 bp, Homo sapiens
  misc_feature: GYAE6OF01ECX20.22.36.D03.1.454.CMB.1.raw
  modified_base (203)..(203): a, c, t, g, unknown or other
  misc_feature (203)..(203): n is a, c, g, or t
  modified_base (244)..(244): a, c, t, g, unknown or other
  misc_feature (244)..(244): n is a, c, g, or t
tcagacatacgcgtcacgaccggtgctcgatttagctgcgtcacgatctctcgttggggggggtctcaggaggcagcgctctcgggacgtctccaccatggcctgggctctgctattcctcaccttcctcactcagggcacagggtcctgggcccagtctgccctgacccagcctgccttccgtgtctggatcatcgtggacngtcgatcagtctactttcctgccaacgtcgggaaccaacgngtacgacgtagtttcgggttcttttagaccttcttacgttccttacccgttacggtaacccaaacaacccgaaccccgtaaccggaaccccccaaaaccccccctaactacctaacttacgttaacgttttagtcgggttactaccgtaccgtttccggtcccggtacccctacggtaacggtacgttccttacctctacgttccttccgttactcgacggttcctaaccgtaacggtcgtaccggaaccgtaacccgaccccggtacccccttaacccgtaacccttcttaccgtccggtaccgggttccttaccggtacggtttacgggaaccgggttaactaccggtttacttttaaccgtttaacgtttccgttaacgttaccgtttaaacggttttttaccctttaaaggtcccggtaccgttaccccgttaacgggttttccggtttaccggggttttcggggtttaccggggacggtaccgggtaaaccgtacggttaacggtcccgggttaccgttccggtaccggttacggcccggtaccggtacccgtccggtccccggttacccgacccgttacgtcccgttccggttaccccccg

SEQ ID NO: 130424 - DNA, 686 bp, Homo sapiens
  misc_feature: GYAE6OF01AYHKL.22.36.D03.1.454.CMB.1.raw
  modified_base (235)..(235): a, c, t, g, unknown or other
  misc_feature (235)..(235): n is a, c, g, or t
tcagacatacgcgtcacgaccggtgctcgatttagctgcgtcacgatctctcttgggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcactgggaaccaagngtgactagtttcgggttcttttgacttcttcgtccttccgtacggtaaccaaaccaaccacccgacggaccccaaaacccccccaactaccactactaatttagtggttactactaccgtccggtccgtccctacgacggtacgtcctcgtctacgtccgtcttccgtacgacggtcctaccgtaacgttccgtacgtacctaaaccgacccggtacccctaaccccgttaaacctcgttcccgttccggtcgggtcccttaccgttaggttacggaacggtacgttacgttaccttaactttacttacgtcgtaacttacgtttaacctttaagtcgacctcctacgttcgttcgttcgggttcggacggacgacgacgtacgtcgtaccgtcgtacgcgtaccgaccgacgtccgtcccgtccccgttcggtcctcgttccgtaccccg

SEQ ID NO: 130425 - DNA, 877 bp, Homo sapiens
  misc_feature: GYAE6OF01EUAEY.22.36.D03.1.454.CMB.1.raw
  modified_base (247)..(247): a, c, t, g, unknown or other
  misc_feature (247)..(247): n is a, c, g, or t
tcagacatacgcgtcacgaccggtgctcgatttagctgcgtcacgatctctcgttgggggggggtctcaggaggcagcgctctcgggacgtctccaccatggcctgggctcgtgctattcctcaccttcctcactcgagggcacgtaggtcctgggaccctagtctcgccctacgacccagcctgtcctccgtgtctggactcactcgtacggaacgtaggtcgatacgacgtacttactttaccgnggaccgtaacggtacgggaaccctaaagacgtacgtaacgtacggtttcgggtttactttcgtaccttcgttcgtaccgttaccgtaaccggtaaaccctaaaccgaaccgaacccgaaccgaaccccctaaaccccctactacgtaacttaacctaacgtttagtacggttccgtaccgtacccgttccggtacccggtacctacgtaagggtacttccgtaccgttaaccgcgttaccgttaccttaccggtaaccgtcggttaccgtaaccggttaacgtacgggtaacccgtaaacccgtaaaccggtaaccccgtaccccttaaaacccgtttaacgcctttacccggtaccggggttacggttaccctacgggtttaacggttaaccgggaacgtaaccgggtaactttaacgtaaacgttttaacgtaacccggttagttacgttttaaaccgtttaaccgtttaaagtacccgggtacccttaccgttaccggttacgtttcggggtttaccggttacgggacgtaaccggtagtaaaccggtcgtaaccggtccggttacggtagaccgtccgaccggtaaccgtccgtaccccgtccgtatcccgtcgtcccgttcccgg

SEQ ID NO: 130426 - DNA, 778 bp, Homo sapiens
  misc_feature: GYAE6OF01A9EY2.22.36.D03.1.454.CMB.1.raw
  modified_base (119)..(119): a, c, t, g, unknown or other
  misc_feature (119)..(119): n is a, c, g, or t
  modified_base (222)..(222): a, c, t, g, unknown or other
  misc_feature (222)..(222): n is a, c, g, or t
  modified_base (261)..(261): a, c, t, g, unknown or other
  misc_feature (261)..(261): n is a, c, g, or t
  modified_base (619)..(619): a, c, t, g, unknown or other
  misc_feature (619)..(619): n is a, c, g, or t
  modified_base (759)..(759): a, c, t, g, unknown or other
  misc_feature (759)..(759): n is a, c, g, or t
tcagacatacgcgtcacgaccggtgctcgatttagctgcgtcacgatctctcttggggggggtctcaggaggcagcgctctcgggacgtctccaccatggcctgggctctgctattccncaccttcctcactcagggcacgtagggtccgtgggcccctagtcctcgaccccgtcgacccaggccctcgtcccgtccgttgtccgtggatcactcgtggacngtcgatcagcgttacttcctgccacgtacggaacctaanggtacgactaggtttcgggttacttttcgacttcgtcgttccgttaccgtacggttaacccaaaccgtaacccaaccccggtaccggaaaacccccaaacccccccgtaacgtactaaccttacgttaactttaggtccggtacttaccgtaacccgttccgtaccggtcccgtacgtaggtacgtacctccgtctaacgtccgttctcgtacgaccgtcctacgtacgtcgacgtaccaaacgtcccgtacccgtacctaaccgtccgtcgtacgtccggtaccgttacgttacggtacggaacgtacgtacgttaccttaacgttacttccgtcttacgttacgttaacgtttaancggttacctacgtaccgttccgttacggtttcgggtaccggcggtaaaccggtcgtaaacgtaccggtacgtacccggtgttaacccggcgtaaaccggtcccgtaacgggtccctacccggacccgttaccggttaccnccccgttcggttacccccc

SEQ ID NO: 130427 - DNA, 640 bp, Homo sapiens
  misc_feature: GYAE6OF01CTGK0.22.36.D03.1.454.CMB.1.raw
  modified_base (229)..(229): a, c, t, g, unknown or other
  misc_feature (229)..(229): n is a, c, g, or t
tcagacatacgcgtcacgaccggtgctcgatttagctgcgtcacgatctctcgttggggggggtctcaggaggcagcgctcgtcgggacgtctccaccatggcctgggctctgctacttcctcacctttcctcactcgagggcacgacggggtcctgggccccagtctcgccctgaccctgcctcgcctcgtgtctggatcatcgtggacagtcatcagctatttccgngcacgtgggaccaacgagtgactgtttgggttcttttggacttctcgtcctccgtacggtaaccaacaaccaccacggaccccaaacccccatccactctatttagcggtctacaccgtcgtccgtcctgacggtctctcgtcactcgtcttcgcgcgtctaccgaagtcgtacgaccaaccgtccgtaccctacctaaccacttcgtcgtcggtctacgtagttcggacgtcgtacttaccttaactttctacgtgtacgttacgtttacgttaacgtcggtcctacgtaccgttcgttacgggttcggtttcggcggtacgccgtaacggacggtccgtaccggtccgtacgtccgaccggacccgtacgtcccgtacccgcccgttcgtacctccgttccgttccccg

SEQ ID NO: 130428 - DNA, 795 bp, Homo sapiens
  misc_feature: GYAE6OF01BHJXL.22.36.D03.1.454.CMB.1.raw
  modified_base (222)..(222): a, c, t, g, unknown or other
  misc_feature (222)..(222): n is a, c, g, or t
tcagacatacgcgtcacgaccggtgctcgatttagctgcgtcacgatctctcttgggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacaggtcgatcagtctactttccngcacgtcgggaaccaagagtcgactagtttcgggttcttttacgacttcgttcgtccttccgttacggtaaaccaaaccaaacctaccccgaaccggaacccccaaaacccccccgatccaacttctaatttagtcggtacgtctaccgttccgtcccggtccctacgagggtacgttccctactctactccgtccttaccgtaccgacgtcctaccgtaacggttccgtacgggacctaacccgtacccgtacccctaacccgtaaccctacttccgtccgtcggtccctacgttaggttcggaacggtaccgttaagtacctttaacgttacgttaccgtcgttaccgtttaacgttttaaccgtttaaacggtcggtacccgtaccgttaccgtttcgggttaccgggttttacgggttccgggacgggtaccggtaaccggaccggtaacgggttacccggtacccggttacccggttcgggacccgtaacccggtcccggaaccggttccccgttacccccggtcccccggttaccggtcccgttaccccgtttcccggttcccccgg

SEQ ID NO: 130429 - DNA, 777 bp, Homo sapiens
  misc_feature: GYAE6OF01BBMY1.22.36.D03.1.454.CMB.1.raw
  modified_base (224)..(224): a, c, t, g, unknown or other
  misc_feature (224)..(224): n is a, c, g, or t
tcagacatacgcgtcacgaccggtgctcgatttagctgcgtcacgatctctcgttgggggggggtctcaggaggcagcgctctcgggacgtctccaccatggcctgggctctgctattcctcaccttcctcactcagggcacgagggtcctgggcccagtctcgccctgacccagcctgcctccgtgtctggatcatctggacaggtcgatcgagctatttccngcacgtcgggaccaacagtgtactagtttgggtcttttgacttctgtcctccgtcgtaaccaacaccacccgacgaccccaaaccccctatccacttctatttagtggtactcacgtcgtccgcctagacggacgttcctctacgactccgtacttcgtcgacggtacctacgtacggtccgtacggaccaaccggtcccggtacccttaccgtaacctccgttcgttacggtccgggtacccttccgttaagggttcggaacggtacgttacgttactttaaccgtttacgttacgtcgtaaccgtttaccgtttaaccgtttaagtccggtacccgttaccgtaccgttccggtttaccggtttacgggtttacccgggcgtaaccgggtaccgtaacccgggttacggtaccccgggttaacccggttcccggtttacccgggaaaccgtaccccgggtaccccggtaaccggggttcccccgttaaccccggggttcccccccgttaccggttacccgttacccccggttccggtttaaccccccccgg

SEQ ID NO: 130430 - DNA, 665 bp, Homo sapiens
  misc_feature: GYAE6OF01EMC5W.22.36.D03.1.454.CMB.1.raw
  modified_base (221)..(221): a, c, t, g, unknown or other
  misc_feature (221)..(221): n is a, c, g, or t
  modified_base (236)..(236): a, c, t, g, unknown or other
  misc_feature (236)..(236): n is a, c, g, or t
tcagacatacgcgtcacgaccggtgctcgatttagctgcgtcacgatctctcgttggggggggtctcaggaggcagcgctcgtcgggacgtctccaccatggcctgggctctgctattcctcaccttcctcactcagggcaacgagggtcctgggcccagtctgaccctgaccagcctgcctccgtgtctggatcatctggacagtcatcagctactttcngcacgtaggaccaangtacgactagttcgggttctttaggaccttcttcggtccttaccgttaggtaaaccaaaccaaccacccacggaaccccctaaaaccccccatacgacttacttacttagtcggtacgacctactcggtccgaccctaggacggtactcccttgacctacgttaccgtcttactcgagtcctacgtaacgttcgtacggaacaaccggtaccgtacccttaccctaacacttcccgtacgtcggtacctacgtacgtttaggaacggtacgtacgttactaacgttactacgtagtacttaacgtttaccttaagtcgcacctagtcgttcgttggttacggaggtcacgtaccgtagtaccgtacccgtcgtacgacgtaccgaaccgaggtccctacggaccccttacggtcctacgtccttacccg

SEQ ID NO: 130431 - DNA, 892 bp, Homo sapiens
  misc_feature: GYAE6OF01CWYF6.22.36.D03.1.454.CMB.1.raw
  modified_base (184)..(184): a, c, t, g, unknown or other
  misc_feature (184)..(184): n is a, c, g, or t
tcagacatacgcgtcacgaccggtgctcgatttagctgcgtcacgatctctcgttggggggggtctcgaggaggcagcgctcgtcgggacgtctccaccatggcctggctctgctacttcctcaccttcctcactcgacgggcacgtcgggtccgtcgggccctagtccgtcgccctacgaccncgcctcgtcctcgtcgtctgtactacatcgtaggacgacgtcgtatcacgtcttactttccgcgtaccgtacggtacggaaccacgtagtacgtacggttagtttcggggtttactttttcgaccgtttccgttacggtttacccgtaccgtttaaccgggaaaacccctaaacgaaacccccgtaaacccccggaaccgttaaaaccccccccaaaaaccccccccgttattacccttaaccggttaaccttttaaagttttacgggttcccgggttaactacccggttaaccccggtttacccgggtccccggtaacccgtggtaacgggttaaccctttccgcccttaacgtaccgtccggtttaccttacggtaacccggtacgttacccgtaacgttaacctcccggggtaataaacccccgtaaccggtccctaaccccttacccgttaaccgtcttccggtacggtacccgttccgttacccggttagtcggtaaccgtaccttacgtaacgttactttacgtacgttacggtacttttaacggttaaccgtaagttacctacccgtaccttacgttcgttacgggttccgttacgggtcggtaccggtccgtaccggtacgtcccggtcgtccggtacgtcccgtaccgtcccgtaccgtccgtacccgtccgtaccctcttcccggtccgtaacccccg

SEQ ID NO: 130432 - DNA, 808 bp, Homo sapiens
  misc_feature: GYAE6OF01AI7MH.22.36.D03.1.454.CMB.1.raw
  modified_base (187)..(187): a, c, t, g, unknown or other
  misc_feature (187)..(187): n is a, c, g, or t
  modified_base (247)..(247): a, c, t, g, unknown or other
  misc_feature (247)..(247): n is a, c, g, or t
  modified_base (368)..(368): a, c, t, g, unknown or other
  misc_feature (368)..(368): n is a, c, g, or t
tcagacatacgcgtcacgaccggtgctcgatttagctgcgtcacgatctctcgttggggggggtctcaggaggcagcgctctcgggacgtctccaccatggcctgggctctgctattcctcaccttcctcacgtcacgggcacgacgggtccctcggggccccagtctacgtcccctcggaaccccncgtccctcgtccctcggtcgtcgtggactcatcgtaggactgtcatcagtctactttccngaccacggtacggaacctaacgtgtagtacgtaggtttcggttctttgaccttgtccgtccttaccgtacgtaaccaaccgaaccccaccgaccggaacccccaaacccccctatccactntaactttgcggtctacctccgttccggtccggacccttaggacgtaccgtcctcgtactaccgtcttacctccgaccgtacgtaccctcggtaacgttcgacgtaacccgaccgtaccccgtaccctacccttacgtcttcccggtacgggtccgttaccgtacccggtaggttaccggacgggtaccgttaaccgtttacttaacgttcctttaacgtccgttaaacgtttaccgttttaaccgtttaaccgtcggtaccccgttacgtaccgttttcgggttcgggtttaccgggtacgggtacgggtacccgtacgggtaccgttaccggtaaccggtcccggttccgtaccggacccgtaccggaccccggttaagtcccccccgggtaaccggttccccgttacccggtcctcccggtttcccggttaccccccg

SEQ ID NO: 130433 - DNA, 849 bp, Homo sapiens
  misc_feature: GYAE6OF01A3XGH.22.36.D03.1.454.CMB.1.raw
tcagacatacgcgtcacgaccggtgctcgatttagctgcgtcacgatctctcgttgggggggggtctcaggaggcagcgctctcgggacgtctccaccatggcctgggctctgctattcctcaccttcctcactcgagggcacgagggtcctgggcccagtctgccctcgacccacgcctcgccttccgtgtcgtggtatcatcgtaggacaggtcgatcagtctactttcctcgactacgtcgggaaccaacgtaggtacgaacgttaggttttcgggtttacttttaggaccttcgttacgttccttacccgttacggtaaccaaaccaaccctaaccccggaacccggaaaccccccaaaacccccccctaactaccgtaacttaaccctttaagttttaaccggttgggtttaccgtaccttaccgttcccgggtcccggtccctaccggtaagggtaccgttctcctactaccgttaccttaccgttcctacggtacgtacctaccgtacggttaccgtacggtaaccgaccgtacccgtacccttaacccgtaacgtacttccgtaccggtcggtaccgttacgttacggttacggacggtaccgttaacgttactttaacgttaccttacgttacgtaacgtttacgtttaaccgtttaaacggttcggaaccgtaccctacgtttaccggttcgggtttacggttacggaccgggtacgacccgtaacgtaccggtaccgtaccgggttaccgtaccggtacgttaacccgacccgggtaacgtccccggttcccgtacccccggttacgtccgttaacccgtttcccggttaccccccgg

SEQ ID NO: 130434 - DNA, 688 bp, Homo sapiens
  misc_feature: GYAE6OF01AWFSO.22.36.D03.1.454.CMB.1.raw
  modified_base (199)..(199): a, c, t, g, unknown or other
  misc_feature (199)..(199): n is a, c, g, or t
  modified_base (237)..(237): a, c, t, g, unknown or other
  misc_feature (237)..(237): n is a, c, g, or t
  modified_base (270)..(270): a, c, t, g, unknown or other
  misc_feature (270)..(270): n is a, c, g, or t
  modified_base (560)..(560): a, c, t, g, unknown or other
  misc_feature (560)..(560): n is a, c, g, or t
tcagacatacgcgtcacgaccggtgctcgatttagctgcgtcacgatctctcttggggggggtctcaggaggcagcgctcgtcgggacgtcaccaccatggcctgggctctgctcctcctcagccctcctcactcagggcacgagggtcctgggcccagtctcgccctgactcacgccctcccgtccgcgtccgggtcncgtggacagtcagtcacatctctgcacgtacggaaccngctagtcgtacgttggtacggttaacaaggttntacggtccttaccgtaggtaacccaacctacccaacccgaggccaaccaccgaacccccctaaaatctaagtacgttaatttacgacggtacgtaccaaacgttaacgggcccgggtacctaccggtaacggggttccctagacgttcgtcttccgtacgtccggctaaccgtaggtccgtagggccgaaccgaccgtcccgtccgtcgaccgtcgtacggtcggacctccgaaggtctaggaggtacgtacggagttcctaagttatttacgtacgtcgtactacctanacgtgcggagtaccggcgtatacgtggtcgggtcggtcgggacgggaccgacgtaccggtcgtaccgggtaccgttaccgacggtccgtaaccgacccggtagtcccctccccggtaccccgtaccgg

SEQ ID NO: 130435 - DNA, 768 bp, Homo sapiens
  misc_feature: GYAE6OF01CEQL6.22.36.D03.1.454.CMB.1.raw
  modified_base (260)..(260): a, c, t, g, unknown or other
  misc_feature (260)..(260): n is a, c, g, or t
  modified_base (712)..(712): a, c, t, g, unknown or other
  misc_feature (712)..(712): n is a, c, g, or t
tcagacatacgcgtcacgaccggtgctcgatttagctgcgtcacgatctctcgttggggggggtctcaggaggcagcgctcgtcgggacgtctccaccatggcctgggctctgcttattcctctaccttctcactcgacgggcacgtacgggtccgtcgggccctagttctcgtcccctacggaccctacgccgtcgtcccgttccgtcgtccgtaggtactcgtactcgtcggacacgtcgtatcgagtctacttccgngaccgtacggtacgggactaacgcgttacgacttaggtttcggtctttacgacgttcgtacgttccgttaccgtacgtaacccaacctaacccgaacccgaaccggtaacccccaaacccccgtaactacctactacgtttacttacgtcggtactaccgtacggtccgtcccggtacctagaccggtctacctcgttcacgtcgttctaccgtcacgtcctacgtacgttacgcgtaaccgacccgtccgtaccctacccgtaacgtcttcccggtagccggttcttacggttacggtggaaccggtacttcgttaaccttagtttaccagttcctacggtttaactttaaccgttagtccggtcttaccgtaccgtttggttccggttcggttaacgccgggtaacgtaccggtacggtcgtaccgttcccggtccggtagtcccgtacncccggtacggttcccgtcccttccgggtcccttaccgttcccgcccgtttacccgg

SEQ ID NO: 130436 - DNA, 817 bp, Homo sapiens
  misc_feature: GYAE6OF01CB3QS.22.36.D03.1.454.CMB.1.raw
  modified_base (216)..(216): a, c, t, g, unknown or other
  misc_feature (216)..(216): n is a, c, g, or t
  modified_base (260)..(260): a, c, t, g, unknown or other
  misc_feature (260)..(260): n is a, c, g, or t
  modified_base (604)..(604): a, c, t, g, unknown or other
  misc_feature (604)..(604): n is a, c, g, or t
  modified_base (764)..(764): a, c, t, g, unknown or other
  misc_feature (764)..(764): n is a, c, g, or t
tcagacatacgcgtcacgaccggtgctcgatttagctgcgtcacgatctctcgttgggggggggtctcaggaggcagcgctctcaggacgtcaccacatggcctgggctctgctcctcctcacgcctcctcactcgaggggcacgacggggtcctcggggcccaggtctcgccctgactcacgccctccctcggcggtccgggtcttccgtggacngttaccagtccacctattcctccgtagacctacgtacggaaccngcgtaggtcggtaccggtttgggtacggttaacgtaagttagttcgttccgtaccgtacggtaaacccaaccgaccccgaaccacggccaaccacccgaaccccctaaactacattagttaacgtttagtaggtacggtactaacgtaacgggcccgggtacctacgggacgggtccctaggacttccggactttcgtccgtaggtcccacgttaagccggttacggaccgtaaccgtaccggtccctccgtcggtaccgttccgtacggtcgggtacctccggtacggtaccggtaggtaccggtagtacggggacggttcgtagttaacgttttaccgtacncgtttactcggtacttacggttacttacgggtcctacgggtcccgttaaccgtaccggtttcgggtttacgggtacggtccgggggtaaccggggtaacggtacccggttaaggttaccccgggtaccggtaccccggttaaccgtacggggttaaaccnccccgggtaaaacccggttccgggtacccccggttcccgggttaccccccggg

SEQ ID NO: 130437 - DNA, 827 bp, Homo sapiens
  misc_feature: GYAE6OF01C28ZX.22.36.D03.1.454.CMB.1.raw
  modified_base (311)..(311): a, c, t, g, unknown or other
  misc_feature (311)..(311): n is a, c, g, or t
tcagacatacgcgtcacgaccggtgctcgatttagctgcgtcacgatctctcgttggggggggtctcgaggaggcagcgctctcgggacgtcctccaccagtcggcctgggctctcgtcttacttcctctacccttcctacactcgacgggcacgtacgggtccgtcgggcctagtctcgccctgacctcgcctcgtcctcggtgtcgtggtactctacgtcgtagggacgagtccgactcgacgtcttactttccgcgtaccgacggtacggaaccaacgtgtacgtacgttacggtttcggttcttacncttcgtcgtcctaccgtaaccgtaacctaaaccaacccgacccgtaacccggaaaccccctaaaacccccgtataccgttactaacgtttacgttacggtcggtaccgttacctaccggttcccgtaccggtccctaacggtaggtccttccgttaccggttacaccgtttccggtacttccggtaacggtaacgtcctaacgtacggttcgaacggtaccaaccggtcccgtaccctaccgtaactcgttacgtcggtaccggttactacggttacgtacggtacgtaactttaccgtaactttactacggttactacgtttaaccgtttaacgtttaaccttaacggtaccgtccgttaaccgtcgtttcgttcggggttacggttccgggaccggtacgacggtaacccgttaccggtcgtaccccggttcgtaacccgcggtacccccggtacgtccgggtttccccctccggtaccttaccgttacccgttccccttcccccggtaacccc

SEQ ID NO: 130438 - DNA, 924 bp, Homo sapiens
  misc_feature: GYAE6OF01BARAX.22.36.D03.1.454.CMB.1.raw
tcagacatacgcgtcacgaccggtgctcgatttagctgcgtcacgatctctcttggggggggtctcaggaggcagcgctctcgggacgtctccaccatggcctgggctctgctattcctcaccttcctcactcgagggcacgacgggtcctgggcccagtctcgccctgacccagcctgcctccgtgtctgatcatcgtggacagtcgatcacgctactttccgtgacctacgtacgggaaccaagtaggtagaccttagtttcgggtttacttttacgaccttcgttccggttaccttcccgttaccggtaaacccaaaccaaacccgaaccccgtaaccggaaccccccaaaaccccccccgtaactcctaactttaccttaacgttttacgtcgggttactaccgtaaccgttcccggttccccggtaccccttacggtaacgggttaccgttcccttacccgttaacgtaccgttcccggttaccctttacccgttacccggtaaccgggtcccctttaacccggtaacggtttacccggtaaccgggtaacccgaaaaccccggtcccccggttaacccccttaacccccttaaacccgtacgtttccccgttaccggtacccgggttacccgtttacccggttacgggtttacgggaaccgggttaaccgttacgtttaacctttacgttttaacgttaccggttacgttacgttttaaccgttttaaccgttttaacggtccggtaccgtaccttaccgtttccggtttacgggtttcgggtttacgggaccggtacgtaccggtaaccggtacgttaccggtacccgttcgttacccggaccgtaccgggtacccggaacgtccccgttacccggcccccggtttacggttaccctccggtttcccgttacccccg

SEQ ID NO: 130439 - DNA, 752 bp, Homo sapiens
  misc_feature: GYAE6OF01AKBDI.22.36.D03.1.454.CMB.1.raw
  modified_base (232)..(232): a, c, t, g, unknown or other
  misc_feature (232)..(232): n is a, c, g, or t
  modified_base (629)..(629): a, c, t, g, unknown or other
  misc_feature (629)..(629): n is a, c, g, or t
tcagacatacgcgtcacgaccggtgctcgatttagctgcgtcacgatctctcgttggggggggtctcgaggaggcagcgctctcgggacgtctccaccatggcctgggctctgctattcctcaccttcctcactcgagggcacgagggtccgtcgggcccagtctcgccctcgacccagcctcgcctccgtgtcgtggactcatcgtaggacagtcatcagcttacgtttcngctacggtaccgggaaccaacgtaggtacgtacgtacggttttcgggtttctttttaggtaccttcgttcgttcccgttacccgttacggttaaacccaaaaccaaaccccgaaccccgtaacccggggaaaacccccccaaaacccccccgtaacctaccttacgttaccttaagttttcggtaggttccgttaccgtaaccgttccggttccccggtacccttacgaacggttccttccgtcttccgaccttcgtccttctaccgtacggccgtaacctacgttccggacgtaaccaaccgtacccgtccctaacctaccacttcgcgtacggcttcgttagtacggacgtactacttacttcgtacttcgtctacttatttaaccgttatccgntacctcgttcgttcggttggttccggagaccggtccgtaacgtcggaccttcccgggtcgtacgaccgtcggacccgcgtccccggtcgttacccctacggcttcccgttcccgtacccccgg

SEQ ID NO: 130440 - DNA, 620 bp, Homo sapiens
  misc_feature: GYAE6OF01A8X15.22.36.D03.1.454.CMB.1.raw
  modified_base (168)..(168): a, c, t, g, unknown or other
  misc_feature (168)..(168): n is a, c, g, or t
  modified_base (208)..(208): a, c, t, g, unknown or other
  misc_feature (208)..(208): n is a, c, g, or t
  modified_base (217)..(217): a, c, t, g, unknown or other
  misc_feature (217)..(217): n is a, c, g, or t
  modified_base (235)..(235): a, c, t, g, unknown or other
  misc_feature (235)..(235): n is a, c, g, or t
  modified_base (259)..(259): a, c, t, g, unknown or other
  misc_feature (259)..(259): n is a, c, g, or t
  modified_base (363)..(363): a, c, t, g, unknown or other
  misc_feature (363)..(363): n is a, c, g, or t
  modified_base (522)..(522): a, c, t, g, unknown or other
  misc_feature (522)..(522): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcacttcctcactcaggcacagggtccgtggcccagtctgccctgacccngcctgcctccgtgtcgtggatcatcgtgacagtcgatcanctatttccngccacgtcggaaccacgngtgactacgttggttctttgactntgtcctccgtacgaaccaacaccaccacgaccccaacccccatcactctattatgtcgtcaccgtcgtccgcccgtacgagggtctcctctcacgtcgtcttcncacggtcctaccgaacgtcgcggaactaccgaccgtccctacctaacctctcgtcgtccgtcttcgtagtcggaacgtcgtactcgttaattctacgtctacgttatttaaccgttaacgtcgtaccgtactacgttcggttacggttcggttaccggnggtaaccggctaaccggtaagttcccggtaccgtccgtagtacccgcccgaccgtccgtactcccccggtcccgttagtcccctgttcccgttccccg

SEQ ID NO: 130441 - DNA, 734 bp, Homo sapiens
  misc_feature: GYAE6OF01COQP9.22.36.D03.1.454.CMB.1.raw
  modified_base (123)..(123): a, c, t, g, unknown or other
  misc_feature (123)..(123): n is a, c, g, or t
  modified_base (208)..(208): a, c, t, g, unknown or other
  misc_feature (208)..(208): n is a, c, g, or t
  modified_base (237)..(237): a, c, t, g, unknown or other
  misc_feature (237)..(237): n is a, c, g, or t
  modified_base (699)..(699): a, c, t, g, unknown or other
  misc_feature (699)..(699): n is a, c, g, or t
tcagacatacgcgtcacgaccggtgctcgatttagctgcgtcacgatctcgtcgttggggggggtctcaggaggcagcgctcgtcgggacgtcctccaccatggcctgggctctgctattccncaccttctcactcgagggcacgacgggtcctgggacccagtctcgccctgaccctagccgtgccctcgtcggtctggatcatcgnggactaggtctatcacgtctacgtttccngcctacggacggaacctaaagcggtacgacgttaggtttacggttcttttacgacttcgttcggtacctaccgtacgtaaaccaaaccaaccgaccccgaacgaacccccctaaaaccccccgtaatacctaacgtacttaaagtttacgcggttactaccctacccggttccggacccggtacccctaggtaacggtacctctaccgtactactaccggtaccttgaccggtcggtaaccctacgtaacgtcgtacgaacctaacccggaccccgtaccttaaccctaactcgtacctcggtcgtaccgtacgtagttacgacgtacgtacttacttaagttactacgtcgtaacttaacgttaaccgttaaggtacccgactacgttactccggtttcgttacggttcggccgacgtaacgacgttacggcgtaccgtccgagtcctaccgacgttaccncgtacccgtacctcgaacctccgtccgtaaccccg

SEQ ID NO: 130442 - DNA, 764 bp, Homo sapiens
  misc_feature: GYAE6OF01BV6OQ.22.36.D03.1.454.CMB.1.raw
  modified_base (224)..(224): a, c, t, g, unknown or other
  misc_feature (224)..(224): n is a, c, g, or t
  modified_base (241)..(241): a, c, t, g, unknown or other
  misc_feature (241)..(241): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacgagggtcctgggcccagtctcgaccctgacccagcctgcctccgtgtctggatcatcgtggactagtcgatcagtctatttccngacacgtcgggaccaanagtcgactagttgggttcttttagaccttcgttacgtcctccgtacggtaacccaaacaacccgaccccgaacggaacccccaaaacccccccaagtaccaacttacctaattttacgttgggtccgttacctaccgtccggtaccggtcccctacgacggttacgtccttctctacgtccgtacttcgtcgacggtcctaccgtaacgtcgtacggactaacccgaccgtaccctacccgtaacctacgttccctccgtcgggtacccttacgttaggtttacggaacgggtaccgtacttaccttacgtttaacgtttccgtacgtacgttttaacgttttaacctttaaagggtccggtacccgtaccttccgtttgttccgggttttcggtttacgggaccgggttacggaccgtaaccggtacggtacccggtcccgttccgtaccggtaccgaccgtacccggacggttcccgtaccccggtccccgttacgggtacctcccgttccgttacccccg

SEQ ID NO: 130443 - DNA, 914 bp, Homo sapiens
  misc_feature: GYAE6OF01DF0U6.22.36.D03.1.454.CMB.1.raw
  modified_base (192)..(192): a, c, t, g, unknown or other
  misc_feature (192)..(192): n is a, c, g, or t
  modified_base (575)..(575): a, c, t, g, unknown or other
  misc_feature (575)..(575): n is a, c, g, or t
tcagacatacgcgtcacgaccggtgctcgatttagctgcgtcacgatctctcgttgggggggggtctcagggaggcagcgctcgtcgggacgtcctccaccagtggcctggggctctgcttacttcctcctaccctttcctcactccgaggggcacgtcggggtcctcgggcccagtctcgccctcgacccngcctcgccgtcgttgtcgtggtactctagttctagggaacctaggtacctatacgaagtcctttacttttccacgtaccgtaccggtaccgggaacctaacggtaggtaccgtaattgggtttacgggttttcttttcggacctttcggttcgttcccgttaccgttacccgggtaaaccaaaaccgtaacccccgaaccccggaacccggtaaaccccccctaaaaacccccctaacgtttaccctaacgttaccgttttaaacgtttttacgggtacgggtttccgttaacccgtacccggtttcccgggtaccccggttacccggttacgtacgggttaaccgttccttaccggtaccttccggttcccttccgtttccnccggtaccgtacccttaacggtaccgttccggtaccggtaccaaccccggttcccgttaacccccttccctaaccgtcgtttcccgtcgggttccgggtacctttacggttttacgggttaacggtacggtaccggttaccttttaactttaccgtttaacgtacttccgttaacgtttaccttttaacgtaacgtccgtcctaccttgttccggttcggtttcggttacggcggtacggtaccgtacggtccggttcccgacgtttcccgggactaacgccccgaccggtaccggtcccctacccggtcccgttctaaccgtccgtttcccgttcccc

SEQ ID NO: 130444 - DNA, 672 bp, Homo sapiens
  misc_feature: GYAE6OF01AZSI6.22.36.D03.1.454.CMB.1.raw
  modified_base (223)..(223): a, c, t, g, unknown or other
  misc_feature (223)..(223): n is a, c, g, or t
  modified_base (243)..(243): a, c, t, g, unknown or other
  misc_feature (243)..(243): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacgagggtcctgggcccagtctcgccctgacccagcctgcctccgtgtctggactcatcgtggacagtcgatcagtctatttccngacacgtcgggaaccaacgngtgactagttggttctttgacttctgtctccgtcgtacaacaaccaccgacgacccaaacccccatcatctattactggtctctacgtcgtcgccctcgacggtacgtctccgtctacgtcgtccttcgtcgacggtcctaccgaacgttcgtacggaaccgaaccgtacccggtacccctaccccgtaacctcgttaccgtacggtcgggtcccttacgttacggttacggaacggtacgtacgttactttaacttacttacgtacgtactttacgttttaacctttaaggttccgtcgtaccttcgttccgtttgttcggtttacgggcgtacggtaccaccggttactccggttacccgtcgttaccggacgtaccgacccgtacgcccgtcccggtcccttaccgtcctaccgtccgttccccgg

SEQ ID NO: 130445 - DNA, 755 bp, Homo sapiens
  misc_feature: GYAE6OF01AWDHZ.22.36.D03.1.454.CMB.1.raw
  modified_base (200)..(200): a, c, t, g, unknown or other
  misc_feature (200)..(200): n is a, c, g, or t
  modified_base (218)..(218): a, c, t, g, unknown or other
  misc_feature (218)..(218): n is a, c, g, or t
  modified_base (235)..(235): a, c, t, g, unknown or other
  misc_feature (235)..(235): n is a, c, g, or t
  modified_base (385)..(385): a, c, t, g, unknown or other
  misc_feature (385)..(385): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacngtcgatcagctatttccngcacgtgggaccaacgngtgactagttgggttcttttgacttctcgtcctccgtcggtaacccaacaaccacccgacggaccccaaacccccccgaatccatctactttagtggtcgtcactcgtccggtccctcgacggtacgtcctcctctactccgtccttacncgaacggtcctaccgaacgttccgacggacctaaccgacccggtcccttacccctaacctacgttccgtcgtacgggtccttacccgtaacggtttcggaaccgggtacgtacgttaccttaacgttatttacgcgtaccttaacgttttaaccgtttaaaggtccggtaccgtacccgttaccgttccgtttacgggtttccgggtttttaccgggaccgggttacgggaaccccgttaaccgggtaacgttcccgggtaaccccggtttcccggtaccgggttacccgaaccggtaccccggtaacggtccccgttaccccggaccccccgtttaccggtccgtacccgttcccggttaccccccggg

SEQ ID NO: 130446 - DNA, 898 bp, Homo sapiens
  misc_feature: GYAE6OF01B94N3.22.36.D03.1.454.CMB.1.raw
  modified_base (181)..(181): a, c, t, g, unknown or other
  misc_feature (181)..(181): n is a, c, g, or t
tcagacatacgcgtcacgaccggtgctcgatttagctgcgtcacgatctctcgttgggggggggtctcaggaggcagcgctcgtcgggacgtcctccaccatggcctgggctctgctacttcctcaccttcctcactcgagggcacgcgggtccgtcgggcccagtctcgccctcgacccncgcctcgcctccgtgtcgtgactcatcgtggactaggtcactcgacgtccttactttccgtcgaccgtaaccggtaccgggaaacctaacgtaggtacggtacgtttacgggttttcggggttttacttttcgaaccgtttccgttacggttcccttaccggttaaaccggtaacccaaaacccaacccgaacccccggaacccggaaaaccccccctaaaaccccccgtaatacctaacgttacgtttaagtttacggtcggttaccgtaccgtaccggttcccggtccccgtaccgtacggacggttccttcctcgtaccgtacgttccgtcttacccggtacgaccgttacccgtaaccgtacggttccgtaaaccggacctaacccggtcccgtaccccttaaccctaacctccgttccggtccgggtaccgtccgttacccggtttaggttacgggaaccgtaccggttactttaccgtttaacctttcgttaccgtcgtttaacccgttttaacgtttaaccggtttaacggttacccgtacccgttaccctttaaccgggttttcggtaccgggttttccggggtttaccgggaccggtaccggttaaccggaccggttacggttcccgacccggttccggtacgaccggtacccggaccgtacgtccccgtacccggtccccgtacgttaccctccgttcccgttcccc

SEQ ID NO: 130447 - DNA, 835 bp, Homo sapiens
  misc_feature: GYAE6OF01CJUEZ.22.36.D03.1.454.CMB.1.raw
  modified_base (229)..(229): a, c, t, g, unknown or other
  misc_feature (229)..(229): n is a, c, g, or t
tcagacatacgcgtcacgaccggtgctcgatttagctgcgtcacgatctctcgttggggggggtctcaggaggcagcgctctcgggacgtctccaccatggcctgggctctgctattcctcaccttcctcactcgagggcacagggtcctgggcccagtctcgccctgacccagcctcgccctccgtgtctggatcatcgtggacgagtgatcacgtactacttttccnggacctacggtacgggaaaccaagtacgtagacttaggtttcggtttacgtttcgacttcgtacgttcgtacccgtaaggtaaacccaaacgtaacccaaccccgaccggaaaccccccaaaacccccctagtactacgttaacttaacgtttagtcggttacgtccgtaccgttcccgtcccgggtacccctcggaaagggtctacctcgtactacgtccgtacttccgtacacggtccttaccgtaaggttccacggaaccaaccgtaccccggacccttaaccccaaccttcgttccgtaccggtccggttactacccggttaaggttaccgggaacggtaaccggttaccgttaacttaacgttttaacgtcgtacggttaacgttaccggttttaaaccgtttaaacggtaccgggtacctacccgttaccgtttacgggttcgggttttacggttaccggggacgggtaaccgtaccgaaccgggtaaccgtaccggtacccgggtttcccacgggttaaccaccggtaccccggtaacggttcccttacccccggttaccccgttacggtacccttaccgttcccgtttaaccccccgg

SEQ ID NO: 130448 - DNA, 966 bp, Homo sapiens
  misc_feature: GYAE6OF01BFE5G.22.36.D03.1.454.CMB.1.raw
  modified_base (121)..(121): a, c, t, g, unknown or other
  misc_feature (121)..(121): n is a, c, g, or t
  modified_base (949)..(949): a, c, t, g, unknown or other
  misc_feature (949)..(949): n is a, c, g, or t
tcagacatacgcgtcacgaccggtgctcgatttagctgcgtcacgatctctcgttggggggggtctcagggaggcagcgctctcgggacgtctccaccatggcctgggctctgctattccncaccttcctcactcagggcacgagggtcctgggcccagtctcgccctgacccagccctgccttccgtgtcgtggtactcctaacttcgtacgggaaccaggtaccgtaattccgaaggtccttaaccttttttccccgtcggaaccctaaccggttaaccgggggaaacccaaaaccgtaagggtttacgaaaccgttaggggtttttccggggttttaccttttttacggtaacctttccgtttccgttcccgttaccccgttaacgggttaaaaccccaaaaccgtaaccccgaaacccccggaaccggaaacccccccaaaaacccccccctaattaccctaaacttctttaacgtttacggtcgggttaccgtacctacccgggttccgtccccggtaccccgtttacggacgggttaacccttccttaccgttaccggacttcccggtttaccctttaccgtcccgtacggtcccttaaccggtacggttccgtacgggaccctaaacccggacccggttaccccctaacccctaacgtccgttaccgttaccgggtccgggtaccctttaccggttaaggtttaccgggaacgggtaacccttaacgtttacctttaacgtttaccgttaccgtcgttacctttaaccggtttttaccctttaaagttccgggtacccttaccggtccgtttaccggttacgggttttcggggttcgggaccggaccggtacggttaaccgaccgggttcccgtacccgggttccgtaccggtacacccggtacccgtaccggtcccgttccccgtacccggtcgtttaccncccgtttcgtacccccg

SEQ ID NO: 130449 - DNA, 763 bp, Homo sapiens
  misc_feature: GYAE6OF01AMWA6.22.36.D03.1.454.CMB.1.raw
tcagacatacgcgtcacgaccggtgctcgatttagctgcgtcacgatcgtctcttgggggggtctctaggaggcagcgctcgtcgggacgtctccaccagtggcctgggctactgctattccgtcaccttcctacactcagggcacgtagggtcctgggccctagtctgccctgacccagcctcgcctccgtgtcgtggatcatcctggacagtcgaatcgacgtctatttcccagcctacgtcgggaaccaagtagtggaactagtttacgggtactttttaggaaccttcgttcggtcctccgttacggtaaaccaaacaaccgaaccctaacggaccctaaaacccccccaataccgactcctaatttagcgttgtacaccttcgtccggtccctacgagacgtctacgtcaacgtcgtcttcgtcgagtccacgtaagtccgtagggacctaacgtacccggtacctaacccgtaaccacgttccgttccggcgggtccttacccgtaaggtttacgggaacggtacggtacgttacgttaacttaccggttactacggtactttaacgttttaaccgtttaacgttaccggtaccgtaccgttaccgttaccgttccgggtttacgggtttcccgggacgggttaaccgtacgggtaccggttaaacgtacccggtaccgtaaccgtacggtcgtaaccggacccggtagtaccctacccggtaccccttacgggtccttaacccgttcgttaccccg

SEQ ID NO: 130450 - DNA, 518 bp, Homo sapiens
  misc_feature: GYAE6OF02F5S1Z.22.36.D03.1.454.CMB.1.raw
  modified_base (437)..(437): a, c, t, g, unknown or other
  misc_feature (437)..(437): n is a, c, g, or t
tcagacatacgcgtcacgaccggtgctcgatttagctgcgtcacgatctctcttggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtctttgactctgtctcctggtaccaacaacacccaggcaaaccccccaatcatcatttatggtgtcactcgtcggccctcaggagtctctcatcgcttctcaggctccaagtctggcaacacggcctccctaacatctctgggctccagtttgaggacgagtctacttattactgctagttcctttaaattaggcnccactctcgttgtttcggcggtagcaccgagtgaccgtcctcggtcacgcccgaaggcctcgcccctggtctacctctccg

SEQ ID NO: 130451 - DNA, 523 bp, Homo sapiens
  misc_feature: GYAE6OF02HI7YV.22.36.D03.1.454.CMB.1.raw
tcagacatacgcgtcacgaccggtgctcgatttagctgcgtcacgatctctcttggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacaccaggcaaaccccccaactcatcattatgtgtcactcgtcggccctcaggagtctctcatcgcttctcaggctccaagtctggcaacacgcctccaaccatctctggctccagtttgaggtacgagtctacttattactgctagttacctttaaattacggcgtcctactctcgttggttttcggcggagtccacgtagtcgtacccgtctcggtcacgcccaaggtctcgcccctggtcaccgtctccg

SEQ ID NO: 130452 - DNA, 523 bp, Homo sapiens
  misc_feature: GYAE6OF02GJFSF.22.36.D03.1.454.CMB.1.raw
  modified_base (363)..(363): a, c, t, g, unknown or other
  misc_feature (363)..(363): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtctttgactctgtctcctggtaccaacaacacccaggccaaaccccccaactcatcattatggtgtcactcgtcggccctcaggagtctctcatcgcttctcagctccaagtctggcaacncgcctccctaaccatctctgggctccagtttgaggacgagtctacttattactgtctagtttacctttaaagttacggcgtcctactcttcgttggttttcggcggtagcacgagtcgaccgtctcggtcacgccagctcgcccctcggtccactctccg

SEQ ID NO: 130453 - DNA, 639 bp, Homo sapiens
  misc_feature: GYAE6OF02GQ11F.22.36.D03.1.454.CMB.1.raw
  modified_base (312)..(312): a, c, t, g, unknown or other
  misc_feature (312)..(312): n is a, c, g, or t
tcagacatacgcgtcacgaccggtgctcgatttagctgcgtcacggaagtctctcgttgggggggtctcaggacggccagcgctctcgggacgtctccaccagtggccgtgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggccaaaccccccactcatcatttanggtgtcactcgtcggcctcaggagtctctcatcgcttctcaggctcaagtctggcaacacggcctcctaaccatctctcgggctccagtttgaggacgagtcttacttattactgctagtttacctttaaagttcggtacgtccctaacttccgttcgggtttcgggtttttaccgggccgggtaagggtcccgtaacccggtaaaggttccggtaaccccgggtttcccgttaccggggttcccgtaacgggccccccgtaaaggggtccccgtcccccggttacccgggttcccgtaaccgttcccgttaccgtttaccccccgg

SEQ ID NO: 130454 - DNA, 532 bp, Homo sapiens
  misc_feature: GYAE6OF02HFVZT.22.36.D03.1.454.CMB.1.raw
  modified_base (303)..(303): a, c, t, g, unknown or other
  misc_feature (303)..(303): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggccaaacccccactcatcatttangtgtcactcgtcggcctcaggagtctctcatcgcttctcaggctccaagtctggcaacacggcctaccctaacatcctactgggcctccagtttgaggacgagtctacttattactgctagttccttaaagtcgcgtacctacttctcgttggttttcggcggtagcaccgagtcgaccggtcctcggtcacgacccgaaggcctcgcccccgtcggtcactccttccg

SEQ ID NO: 130455 - DNA, 528 bp, Homo sapiens
  misc_feature: GYAE6OF02JD0J5.22.36.D03.1.454.CMB.1.raw
tcagacatacgcgtcacgaccggtgctcgatttagctgcgtcacgatctctcttggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctctggtaccaacaacaccaggccaaacccccaatcatcattatgtgtcactcgtcggcctcaggagtctctcatcgcttctcaggctccaagtctggcaacacgcctcctaacatctctggctccagtttgaggacgagtctactttattactgctagtttcctttaaattcggacgtcctaacttcgttcgttggttttcggcggtaacggcaaccgtagtcgaccgtcgtacggtcacgcccaaggctcgcccctggtcctactcgtccg

SEQ ID NO: 130456 - DNA, 520 bp, Homo sapiens
  misc_feature: GYAE6OF02H4CDQ.22.36.D03.1.454.CMB.1.raw
  modified_base (437)..(437): a, c, t, g, unknown or other
  misc_feature (437)..(437): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaaccccccaactcatcattatggtgtcactcgtcggccctcaggagtctctcatcgcttctcaggctcaagtctggcacacggcctccctaacactctctggctccagtttgaggcgagtctacttattactgctagttacctttaaattaggcnccacttctcgttggtttcggcggagcaccgagtcgaccgtcctcggtcacgtcccaaggctcgccccctcggtcacctctccg

SEQ ID NO: 130457 - DNA, 522 bp, Homo sapiens
  misc_feature: GYAE6OF02HVMFC.22.36.D03.1.454.CMB.1.raw
  modified_base (216)..(216): a, c, t, g, unknown or other
  misc_feature (216)..(216): n is a, c, g, or t
  modified_base (376)..(376): a, c, t, g, unknown or other
  misc_feature (376)..(376): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacagtgacattgggtcttttgactctgtctcctggtaccaacaacacccaggaccaaaccccccaactcatcatttatggtgtcactcgtcggccctcaggatctctcatcgcttctcaggctccaagtctgcacacgcctcctaacntctctggctcctagttgagacgagtcttacttattactgactagttactttaaattggccacctactcgttcgttcggttttcggcggtacgcaccgtagtcgaccgtctcggtcacgccgagcctcgcccctggtcacctctccg

SEQ ID NO: 130458 - DNA, 514 bp, Homo sapiens
  misc_feature: GYAE6OF02INJVY.22.36.D03.1.454.CMB.1.raw
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacacaccagcaaacccccactcatcattatggtgtcactcgtcggcctcaggagtctctcatcgcttctcagctccaagtctggcaacacggcctcctaaccatctctggctccagtttgaggacgagtctacttattactgctagttaccttaattaggcgtcctactctcgtgttttcggcggtacgcaccgagtcgaccgtccgtcggtcacgccaaggcctcgcccctcggtccactctccg

SEQ ID NO: 130459 - DNA, 508 bp, Homo sapiens
  misc_feature: GYAE6OF02GN35B.22.36.D03.1.454.CMB.1.raw
  modified_base (431)..(431): a, c, t, g, unknown or other
  misc_feature (431)..(431): n is a, c, g, or t
  modified_base (504)..(504): a, c, t, g, unknown or other
  misc_feature (504)..(504): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacacacccagcaaaccccccactcatcattatggtgtcactcgtcggccctcaggagtctctcatcgcttctcagctcaagtctggcaacacgcctccctaacatctctggctcctagttgaggacgagtctacttattactgctagttcctttaaattggcncctactctcgttgtttcgcggagcaccgagtcgaccgtctcggtcacgcccaggcctcgccccgtggctactntccg

SEQ ID NO: 130460 - DNA, 524 bp, Homo sapiens
  misc_feature: GYAE6OF02GGHTO.22.36.D03.1.454.CMB.1.raw
  modified_base (302)..(302): a, c, t, g, unknown or other
  misc_feature (302)..(302): n is a, c, g, or t
tcagacatacgcgtcacgaccggtgctcgatttagctgcgtcacgatctctcttggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaaccccccaatcatcatttanggtgtcactcgtcggccctcaggagtctctcatcgcttctcaggctccaagtctggcaacacggcctcctaaccatctctgggctccagtttgaggacgagtcttacttattactgctagtttaccttaaattggcgtcctactctcgttggtttcgcggtagccacgtagtcgtaccgtctcggtcacgcccaaggcctcgccccctggtccactcgtccg

SEQ ID NO: 130461 - DNA, 592 bp, Homo sapiens
  misc_feature: GYAE6OF02F0YWA.22.36.D03.1.454.CMB.1.raw
tcagacatacgcgtcacgaccggtgctcgatttagctgcgtcacgatctctcttggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtctttgactctgtctcctggtaccaacaacacccaggccaaacccccaactcatcattatggtgtcactcgtcggccctcaggagtctctcatcgcttctcaggctccaagtctggcaacaccggcctaccctaaccactcctcgtcgggtcctccgtagtttcggacggtacgagttcttaactttattactgctacgtttacctttaaagttcggactcctacttcgttcggtttcggttttccggcggtacgccgtaccggtagtcggtaacccgttcccgttcggtaccgacgaccccgtaaggtccgtcccgtcccccgttcggtaccctaccttccgttccccgg

SEQ ID NO: 130462 - DNA, 630 bp, Homo sapiens
  misc_feature: GYAE6OF02JDQ4Z.22.36.D03.1.454.CMB.1.raw
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgactattgggtcttttgactctgtctctggtaccaacaacaccaggaccaaacccccaactcactctactttatggtgtcactcgtccggcctcaggtatctctcatcgtcttctcacggctccaagtctcggaccaaccgaccggtccctaccctaaacctacttcctcgtcgggtccttccgtagtttcggacggtacgtacgttacttaactttacttacgtcgtctacgtttacctttaaagtacggcctaccctacttccgttcggttacggtttccgggacggtaacggtccgtaaccggtagtcgtacccggttccgttcggtactaccgtacccgaacggtcccgttaccggtccccccgttcgggtacctaccgttccgttaccccgg

SEQ ID NO: 130463 - DNA, 536 bp, Homo sapiens
  misc_feature: GYAE6OF02GWYBT.22.36.D03.1.454.CMB.1.raw
  modified_base (395)..(395): a, c, t, g, unknown or other
  misc_feature (395)..(395): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggccaaacccccccaactccatcatttatggtgtcactcgtcggccctcaggatctctcatcgcttctcaggctccaagtctggcaacacggcctccctaaccatctctggcctcngtttgaggacgagtcttacttattactgctagttacctttaaattgcgcctactcttcgttggtttcggcggtagcacgagtcgaccgtcctcggtcacgtcccgaaggcctccggcccctcggtcctaccgtcttcccgg

SEQ ID NO: 130464 - DNA, 528 bp, Homo sapiens
  misc_feature: GYAE6OF02GGLEK.22.36.D03.1.454.CMB.1.raw
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaaccccccaactcatcatttatggtgtcactcgtcggccctcaggagtctctcatcgcttctcaggctccaagtctggcaacacggcctccctaaccatctctgggctccagtttgaggacgagtctacttattactgtctagtttcctttaaattacggcgcctacttcttcgttggttttcggcggtaggcaccgagtgaccgtcctcggtcacgcccaaggctcgcccctggtccactctccg

SEQ ID NO: 130465 - DNA, 561 bp, Homo sapiens
  misc_feature: GYAE6OF02HCPVP.22.36.D03.1.454.CMB.1.raw
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacaccaggaccaaaccccccaactcatcattatggtgtcactcgtcggccctcaggagtctctcatcgcttctcaggctccaagtctggcaacgaccggccctaccctaaccactcctcgtcgggcctccgtagtttcgaggtacgtagtcttaactttattactgactagtttacctttaaagtcggcctcctacttcgttccgttgggttttccggcggacgtcaccgagtcgacccggtctcggtcacgcccaaggcctccgccccgtcggtcctacctcttcccgg

SEQ ID NO: 130466 - DNA, 551 bp, Homo sapiens
  misc_feature: GYAE6OF02IGAHV.22.36.D03.1.454.CMB.1.raw
  modified_base (217)..(217): a, c, t, g, unknown or other
  misc_feature (217)..(217): n is a, c, g, or t
  modified_base (356)..(356): a, c, t, g, unknown or other
  misc_feature (356)..(356): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacagtgacagttggtcttttgactctgtctctggtaccaacacaccagccaaacccccactcatcattatggtgtcactcgtcggcctcaggagtctctcatcgcttctcagctcaagtctgcaacncgcctcctacactctctggctctagttgaggacgagtctacttattactgactagtttacctttaaattacggacgtactacttcgttcggttggtttttccgggacggtacggccaaccggtagtcgtacccggtccgtacggtcaacggcccgaaggcctccgtcccccgtcggtcctaccgttccttcccgg

SEQ ID NO: 130467 - DNA, 543 bp, Homo sapiens
  misc_feature: GYAE6OF02IJYEG.22.36.D03.1.454.CMB.1.raw
  modified_base (302)..(302): a, c, t, g, unknown or other
  misc_feature (302)..(302): n is a, c, g, or t
  modified_base (357)..(357): a, c, t, g, unknown or other
  misc_feature (357)..(357): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacacaccagcaaacccccactcatcattatggtntcactcgtcggccctcaggagtctctcatcgcttctcagctcaagtctggcaacncggcctaccctaacactctctcggctcctagttcgaggacgagtctacttattacgtgctagtttacctttaaagttacggccgtcctacttcgttcgttcggttttcggcggtacggcaccggtagtcgtaccgtcctcggtcacgcccgaaggcctccgccccgtcggtcctaccgtcttcccg

SEQ ID NO: 130468 - DNA, 613 bp, Homo sapiens
  misc_feature: GYAE6OF02GQDWE.22.36.D03.1.454.CMB.1.raw
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattggtcttttgactctgtctcctggtaccaacaacaccaggcaaaccccccaactcatcattatggtgtcactcgtcggccctcaggagtctctcatcgcttctcaggctccaagtctggcaacacggcctaccctaaccatctctgggctcctagtttcgaggtacgagtcgttaacttattactgctagtttacctttaaattaaggtcgtacctaaccgttccttcggtttcggtttttccgggcgggtacgggtccaaccggtaacggttcggtacccggttcccttaaccggggttccgtaaccgtccccgtaaacgggccttaccgggcccccccgttacgggttaccctaccgttccctttcccccggg

SEQ ID NO: 130469 - DNA, 536 bp, Homo sapiens
  misc_feature: GYAE6OF02HD7G1.22.36.D03.1.454.CMB.1.raw
  modified_base (269)..(269): a, c, t, g, unknown or other
  misc_feature (269)..(269): n is a, c, g, or t
  modified_base (372)..(372): a, c, t, g, unknown or other
  misc_feature (372)..(372): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctctggtaccaanaacaccagcaaaccccccactcatcattatggtgtcactcgtcggcctcaggagtctctcatcgcttctcaggctcaagtctggcaacacggcctccctaacntctctggctcagtttgagacgagtctactttattactgctagttaccttaaattcggactccactctcgttgttttcgggcggtacggtcaccggtagtcggtaccgtccctcggtcaacgtcccgaaggtctccggccccgttcggtcctacgtccttcccgg

SEQ ID NO: 130470 - DNA, 536 bp, Homo sapiens
  misc_feature: GYAE6OF02IDE5W.22.36.D03.1.454.CMB.1.raw
  modified_base (216)..(216): a, c, t, g, unknown or other
  misc_feature (216)..(216): n is a, c, g, or t
  modified_base (307)..(307): a, c, t, g, unknown or other
  misc_feature (307)..(307): n is a, c, g, or t
  modified_base (378)..(378): a, c, t, g, unknown or other
  misc_feature (378)..(378): n is a, c, g, or t
  modified_base (449)..(449): a, c, t, g, unknown or other
  misc_feature (449)..(449): n is a, c, g, or t
  modified_base (470)..(470): a, c, t, g, unknown or other
  misc_feature (470)..(470): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacagtgacattggtcttttgactctgtctcctggtaccaacaacacccaggccaaaccccccaactcatcattatggtntcactcgtcggccctcaggagtctctcatcgcttctcaggctccagtctggcaacacgccctccctaaccnctctctcgggcctcgtagtttgaggtacgtagtcttaactttattactgctagttcctttaaattaggtcncctactcttcgttgtttcggnggacgcaccgagtcgaccgtcctcggtcacgcccgaggcctcgccccgtcggtctccgtctcccgg

SEQ ID NO: 130471 - DNA, 578 bp, Homo sapiens
  misc_feature: GYAE6OF02JBCP7.22.36.D03.1.454.CMB.1.raw
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggccaaaccccccaatcatcatttatggtgtcactcgtcggccctcaggagtctctcatcgcttctcaggcctccaagtctggccaacacggccctccctaaccatctctgggctccagtttcgaggacgagttctaacttattactgctagtttacctttaaagttacggccgtcctacttcgttcggttcggtttttccggcggtacggccgtaccgtagtcgtaccggttccgtccggtcgaacgtcccgaaggtccttccggcccccgttcgggtccctaccgttccgttacccgg

SEQ ID NO: 130472 - DNA, 590 bp, Homo sapiens
  misc_feature: GYAE6OF02IGXP7.22.36.D03.1.454.CMB.1.raw
  modified_base (306)..(306): a, c, t, g, unknown or other
  misc_feature (306)..(306): n is a, c, g, or t
  modified_base (374)..(374): a, c, t, g, unknown or other
  misc_feature (374)..(374): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattggtcttttgactctgtctctggtaccaacaacaccaggccaaaccccccactccatcattatggtntcactcgtcgcctcagagtctctcatcgcttctcagctcaagtctgacaacacggcctaccctaaccnctctcgtggcctctagtttcgagtacgagtcttacttattactcgtactacgtttactttaaacgttggaccgtcctacttcgttcggtttcggttttccgggcggtacggtccgtaccggtaagtccggtacccgttccgttccgggtccaacggtccccgaagggtcccgtccggtaccccccgttcgggtaccctacccgttcgttaccccgg

SEQ ID NO: 130473 - DNA, 536 bp, Homo sapiens
  misc_feature: GYAE6OF02HX1WB.22.36.D03.1.454.CMB.1.raw
  modified_base (216)..(216): a, c, t, g, unknown or other
  misc_feature (216)..(216): n is a, c, g, or t
  modified_base (362)..(362): a, c, t, g, unknown or other
  misc_feature (362)..(362): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacagtgacagttgggtcttttgactctgtctcctggtaccaacaacacccaggaccaaaccccccactcatcatttatgtgtcactcgtcggccctcaggacgtctctcatcgcttctcagctcagtctgcacncgcctcctaacatctctcggctctagttcgaggtacgagtctactttacttactgctagttacctttaaattcggacgtcctacttcgtcgttcggtttcggcggtacgcgacgacgtcgtaccgtccgtcggtcacgcccgaggtctccgccccgtcggtcaccgtcttcccg

SEQ ID NO: 130474 - DNA, 530 bp, Homo sapiens
  misc_feature: GYAE6OF02F2AH1.22.36.D03.1.454.CMB.1.raw
  modified_base (364)..(364): a, c, t, g, unknown or other
  misc_feature (364)..(364): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaaccccccaactcatcatttatggtgtcactcgtcggccctcaggagtctctcatcgcttctcaggctcaagtctggcaacncgcctccctaacatctctgggctccagtttgaggacgagtctacttattactgctagtttacctttaaattacggcgtcctacttcttcgttgttttcggcggtaggcaccgtagtcgaccgtcctcggtcacgtcccgaaggcctcgcccctggtccactctccg

SEQ ID NO: 130475 - DNA, 538 bp, Homo sapiens
  misc_feature: GYAE6OF02G21CP.22.36.D03.1.454.CMB.1.raw
  modified_base (436)..(436): a, c, t, g, unknown or other
  misc_feature (436)..(436): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggccaaaccccccactcatcattatggtgtcactcgtcgccctcaggagtctctcatcgcttctcaggctcagtctggcacacgcctccctaaccatctctcggctccagtttgaggacgagtcttacttattactgctagttcctttaaattaggcncctacttctcgttcggtttcggcggtagccaccgagtcgaccggttcctccggtccacgcccgaaggccgtccgtcccccgtccggtctaccgtccttcccg

SEQ ID NO: 130476 - DNA, 723 bp, Homo sapiens
  misc_feature: GYAE6OF02I1S4Z.22.36.D03.1.454.CMB.1.raw
  modified_base (208)..(208): a, c, t, g, unknown or other
  misc_feature (208)..(208): n is a, c, g, or t
  modified_base (217)..(217): a, c, t, g, unknown or other
  misc_feature (217)..(217): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcanctatttccngcacgtgggaccaacagtgactagttggttctttgactctgtctcctgtaccaacaacaccagaccaaacccccaactcactctattatgtcgtcactcgtccggaccctcgacggtacgtcctcctactactcgtcctttcctacgtacggtcctacctaagtccgtcggacctaaaccgacccggtcccttaaccccgtaaccctacttaccgtccgtacggggtcccttaccgtagtttacggaacgggacgtaacgttaccttaacgtttaactttaaccgtcgtacgttaaccgttttaccgttttaaagttaccggtacccgtacccgttaaccgttcccgttcgggtttaccggttttccggggaccggtaaccggggtaccgtaacccgggtaacggttaccgtaacccggttcccggttaccggtacgtaacccggtaccccgtaacggtccgtacccggtacccccgttcggtaccctaccgttcccgttaccccg

SEQ ID NO: 130477 - DNA, 573 bp, Homo sapiens
  misc_feature: GYAE6OF02I8CZH.22.36.D03.1.454.CMB.1.raw
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattggtcttttgactctgtctctggtaccaacacaccagccaacccccactcatcattatggtgtcactcgtcgcctcaggatctctcatcgtcttctcagctccgaagtctggcaacaccggcctccctaactactctcgtcgggctccgtagtttcgaggtacgagtaccttactttacttactgtactacgtttacctttaaagttacggccgtcctacttcgttcggtttcgggttttacggcggtacgaccaccggtacgtcggaccgttccgtcggtccgacgacccgtaaggtccgtccgtccccgtcggtacctaccgtcgttcccgg

SEQ ID NO: 130478 - DNA, 528 bp, Homo sapiens
  misc_feature: GYAE6OF02G7YGR.22.36.D03.1.454.CMB.1.raw
  modified_base (357)..(357): a, c, t, g, unknown or other
  misc_feature (357)..(357): n is a, c, g, or t
  modified_base (372)..(372): a, c, t, g, unknown or other
  misc_feature (372)..(372): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccacaacaccagcaacccccaatcatcattatggtgtcactcgtcgccctcaggagtctctcatcgcttctcaggctccaagtctggcaacncggcctccctaaccntcctctgggctcctagtttgaggtacgagtctactttattactgctagtttacctttaaattacggcgtccacttctcgttcggttttcggcggtaggcaccgagtcgaccgtccgtcggtcacgcccaaggcctcgccccctggtccactctccg

SEQ ID NO: 130479 - DNA, 549 bp, Homo sapiens
  misc_feature: GYAE6OF02I0I1Y.22.36.D03.1.454.CMB.1.raw
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggccaaaccccccaactcatcatttatggtgtcactcgtcggccctcgaggagtctctcatcgcttctcaggctccaagtctggcaacacggccctccctaaccatcctctcgggcctccagtttgaggacgagtcttacttattactgctagtttcctttaaattggcgtccacttcgtcgttggttttcggcggtggtcaccgagtcgaccgtccgtcggtcacgcccgaaggtcctccgtccccgtcggtcctaccgtcgttccccg

SEQ ID NO: 130480 - DNA, 548 bp, Homo sapiens
  misc_feature: GYAE6OF02I0ZV8.22.36.D03.1.454.CMB.1.raw
  modified_base (334)..(334): a, c, t, g, unknown or other
  misc_feature (334)..(334): n is a, c, g, or t
  modified_base (367)..(367): a, c, t, g, unknown or other
  misc_feature (367)..(367): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggccaaaccccccaactcactcatttatggtgtcactcgtcggccctcaggagtcnctcatcgcttctcaggctccaagtctggcaacncggcctccctaaccactctctcgggctccagtttcgacggtacgacgttcttacttattacctgtcctagtttacctttaaagttaggaccgtccacttcgtcgttcggttttcggcggtagcgaccgagtcgaccgtcctcggtcacgcccgaaggcctcgcccctggtccacgtctccg

SEQ ID NO: 130481 - DNA, 592 bp, Homo sapiens
  misc_feature: GYAE6OF02HB7LD.22.36.D03.1.454.CMB.1.raw
  modified_base (306)..(306): a, c, t, g, unknown or other
  misc_feature (306)..(306): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcagtcaccatctcctgcactggaaccagcagtgacgttggtggttacaagtatgtctcctggtaccaacacccaccaggcacacgcccccaaatcatgatttangagtcactaagcggcctcgaggggtccctgactcgcttctctggctcaagtctggcgacacggcctccgtgacccgtctcgtcggcctccgaggctggaggatggacggtcttagtatttacttactgaccttactctaagtagtcgtacgagggccggacctaacgttccgttaggggttcgttccggggacgggtaacggggtaaccctaaagggtccgttaccggtacccggttaccgttaacgggtcccacgggtaccccgtaagggtcccgttaccccggg

SEQ ID NO: 130482 - DNA, 563 bp, Homo sapiens
  misc_feature: GYAE6OF02GV7PV.22.36.D03.1.454.CMB.1.raw
  modified_base (217)..(217): a, c, t, g, unknown or other
  misc_feature (217)..(217): n is a, c, g, or t
  modified_base (310)..(310): a, c, t, g, unknown or other
  misc_feature (310)..(310): n is a, c, g, or t
  modified_base (365)..(365): a, c, t, g, unknown or other
  misc_feature (365)..(365): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacagtgacattggtcttttgactctgtctcctggtaccaacaacacccaggaccaaaccccccaactcatcatttatggtntcactcgtccgccctcaggtacgtctctcatcgcttctcagctcagtctggcacncgcctcctacatctctggctcagttgagtacgagtctacttattactgtctacgttactttaaagtcggctcctacttcgtcggtttcggtttcgggacggtacggcgaccgtagtcgtacccggttcccgtcggtccaacggtacccgaagggtcctaccggtcccccgttcggtccctaccgttccgttaccccgg

SEQ ID NO: 130483 - DNA, 766 bp, Homo sapiens
  misc_feature: GYAE6OF02G5FKL.22.36.D03.1.454.CMB.1.raw
  modified_base (220)..(220): a, c, t, g, unknown or other
  misc_feature (220)..(220): n is a, c, g, or t
tcagacatacgcgtcacgaccggtgctcgatttagctgcgtcacgatctctcttgggggggtctcaggaggcagcgctctcgggacgtctccgaccatggcctgggctctgctattcctcaccttcctcactcagggcacagggtcctgggcccagtctgccctgacccagcctgcctccgtgtctaggatcatcgtggacagtcgatcagctatttccngcacgtcggaaccaacgagtagactagttcggttctttgacttctcgtcctcgtacggtaaccaacaccaccgacgacccaaacccccatcactactattagtcggtacgtacacgtccgtccggacctacgtacggtacgttctcgtacgtacgtccgtcttaccgacggtaacggtcctaccgtaagttccgtaggaccctaaaccgtcccgggtaccccttaacccgtaaccgtaccgttacctccgggttcggtaccgttaccgttacggtttacggacggtacggtacgttaccgttaactttacgttaccgtacgtaccgtttaacgtttaaccgttttaaaacggttccggtaccgtacccgttaaccgtttccggtttaccgggtttaccggttttcccggggaccggtaccggtaccgtaaccggtacggttacccgtacccggttccggttaccggtaccgacccgggtacccgtaaccgggtcccttaccccgggtccccgttaccgggtaccttacccgttaccgttcccccgg

SEQ ID NO: 130484 - DNA, 573 bp, Homo sapiens
  misc_feature: GYAE6OF02GBN5H.22.36.D03.1.454.CMB.1.raw
  modified_base (362)..(362): a, c, t, g, unknown or other
  misc_feature (362)..(362): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtctttgactctgtctcctggtaccaacaacaccaggccaaaccccccaatcatcatttatggtgtcactcgtcgccctcaggagtctctcatcgcttctcaggctcaagtctggcaacnccgcctaccctaaccactctctcgggctccgagtttgaggacgagtctacttattactgtctacgtttacctttaaagttacggcgtcctacttccgttcggttcggttttccggcggtacggtccaaccggtagtcggacccgttccgtccggttaccacggtcccaagggtcctccggtcccccgttcggtccctaccgtccgttcccg

SEQ ID NO: 130485 - DNA, 563 bp, Homo sapiens
  misc_feature: GYAE6OF02JE7LY.22.36.D03.1.454.CMB.1.raw
  modified_base (217)..(217): a, c, t, g, unknown or other
  misc_feature (217)..(217): n is a, c, g, or t
  modified_base (360)..(360): a, c, t, g, unknown or other
  misc_feature (360)..(360): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacagtgacattgggtcttttgactctgtctcctggtaccaacaacaccaggccaaaccccccactcatcatttatgtgtcactcgtcggccctcaggatctctcatccgcttctcagctcaagtctgcacncgcctcctacatctctggctctagttgaggacgagttcttacttattactgactacgtttacctttaaagtacggtcctacctacttaccgttcggttcggttttccgggcggtacggtccaaccggtacgtcggacccggttccgtacggtcgacgtacccgaaggtcctccggcccccgttcggtccctacgttcctcccg

SEQ ID NO: 130486 - DNA, 587 bp, Homo sapiens
  misc_feature: GYAE6OF02IWXAF.22.36.D03.1.454.CMB.1.raw
  modified_base (217)..(217): a, c, t, g, unknown or other
  misc_feature (217)..(217): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagccgatcagcatttccngcactgggaccaacagtgacattggtcttttgactctgtctcctggtaccaacaacacccaggccaaaccccccactcatcattatggtgtcactcgtcggccctcaggagtctctcatcgcttctcaggctccaagtctggacaacgacggccctaccctaaccatcctcgtgggcctctagtttgaggacgagttcttacttattactgtactagtttacctttaaagttacggctaccgtacttccgttcggtttcggttttcggcggtacggccgtaaccggtagttcgtacccggttccgtccggtacacgacccgtaaggtccctaccggtccccccgttcggtccctaccgttccttccccgg

SEQ ID NO: 130487 - DNA, 639 bp, Homo sapiens
  misc_feature: GYAE6OF02JMC20.22.36.D03.1.454.CMB.1.raw
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattggtcttttgactctgtctctggtacaacaacaccagccaaacccccactcatcattatgtgtcactcgtcgcctcaggagtctctcatcgtcttctcacggtctccaagtctggaccaacaccggtccctaccctaacctacttcctcgttcgggccttaccgtaggttttacgacgggtaaccgtacgttaccttaacgtttacttactcgtaccttacgttttaccttttaaaagttcggtaccgacccttaccgttccgttacggtttcgggttttacgggaccggtaaggtccgtaaccggtagttaccggtacccggttccgtacggttaccgtaaccgtacccgtaaggtccgttccggtacccccgttcggtcctaccgttccgttaccccgg

SEQ ID NO: 130488 - DNA, 530 bp, Homo sapiens
  misc_feature: GYAE6OF02F9DCS.22.36.D03.1.454.CMB.1.raw
  modified_base (524)..(524): a, c, t, g, unknown or other
  misc_feature (524)..(524): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaaccccccaatcatcatttatggtgtcactcgtcggccctcaggagtctctcatcgcttctcaggctcaagtctggcaacacggcctccctaaccatctctgggctccagtttgaggacgagtcttacttattactgctagtttcctttaaattaggcgcctactcgttcgttggttttcggcggaggcaccgagtcgaccgtcctcggtcagcccaaggctcggccccctcggtccacctnttccgg

SEQ ID NO: 130489 - DNA, 517 bp, Homo sapiens
  misc_feature: GYAE6OF02FOGDG.22.36.D03.1.454.CMB.1.raw
  modified_base (364)..(364): a, c, t, g, unknown or other
  misc_feature (364)..(364): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaaccccccaactcatcatttatggtgtcactcgtcggccctcaggagtctctcatcgcttctcaggctcaagtctggcaacncggcctcctaaccatctctgggctccagtttgaggacgagtctacttattactgctagttacctttaaattagcgcctactctcgttgtttcggcgagcaccgagtcgaccgtctcggtcacgcccaaggctcgcccctggtcctactctccg

SEQ ID NO: 130490 - DNA, 540 bp, Homo sapiens
  misc_feature: GYAE6OF02ICG6O.22.36.D03.1.454.CMB.1.raw
  modified_base (217)..(217): a, c, t, g, unknown or other
  misc_feature (217)..(217): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacagtgacattgggtctttgactctgtctctgtaccaacaacaccaggccaaacccccactcatcattatgtgtcactcgtcggccctcaggagtctctcatcgtcttctcaggctaccagtctggcaacacggccctaccctaacatcctctggctctagttgaggacgagtcttactttattactgctagttacctttaaattaggtcgccacttccttcggttggttttcggcggtaggtccacgacgtcggaccgtcgtccggtcacgtcccacggcgtcgcccccgttcggtcctacctcttcccg

SEQ ID NO: 130491 - DNA, 609 bp, Homo sapiens
  misc_feature: GYAE6OF02JG4JD.22.36.D03.1.454.CMB.1.raw
  modified_base (304)..(304): a, c, t, g, unknown or other
  misc_feature (304)..(304): n is a, c, g, or t
  modified_base (344)..(344): a, c, t, g, unknown or other
  misc_feature (344)..(344): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctagtaccaacaacacccaggcaaaccccccactcactcatttanggtgtcactcgtcggccctcaggagtctctcatcgcttcncaggctcaagtctggacaacaccggcctaccctaaccatcctcgtacgggtcctaccgtagtttcgacggtaccgtagtacttacttacttactagtctacggtttacctttaaagttacggtacctacctacttccgttcgttcgggttttcgggcggtacgggcctaaccggtacgtcggacccggttcccgttaccggtccgtaacgacccgtaacgggtcctaccggtcccccgttcgggtccctaccgttcgttccccgg

SEQ ID NO: 130492 - DNA, 562 bp, Homo sapiens
  misc_feature: GYAE6OF02I5AHV.22.36.D03.1.454.CMB.1.raw
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggccaaaccccccaactcatcatttatggtgtcactcgtccggccctcaggagtctctcatcgcttctcaggctccaagtctggcaacacggccctccctaaccactctctgggctcctgtttgaggacgagttcttattattactgtcttacgtttactttaagttaggaccgtcctactcgttcgtttcggtttcggcggagccaccgagtcgtaccgtccgttcggtccacgacccgtaggccgtcccgtccccgtcggtcctaccgttccgttccccgg

SEQ ID NO: 130493 - DNA, 671 bp, Homo sapiens
  misc_feature: GYAE6OF02JCI9F.22.36.D03.1.454.CMB.1.raw
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacgagtgactattcggggtcttttgactctgtctctgtaccaacacacccaggacaaacgccccagacctacatacctatttagtcgtctgtacaaagttaacgccggtaccctcgaacgggggttccctaggacttccggcctttcccgtcgtcggtacctacgtacgtcgtaccgaacctaccgtcccgtccctccgacctaactcttccgtcggtccgtaccgaccggtacgtcggtaaacgagtacgggtacgaccgttagttaacgtttatttaacgtcgtccgttcgttaccgttccgtagtttccgttacgaccggtaccggttccctaacgttacggttcgggttcggttaccggggtcccgggtacgggtaacgtaccggacgttaccggtaccgtccgttaccggtacggtaccgacccggtaccggtaccgg

SEQ ID NO: 130494 - DNA, 509 bp, Homo sapiens
  misc_feature: GYAE6OF02JIF0A.22.36.D03.1.454.CMB.1.raw
  modified_base (362)..(362): a, c, t, g, unknown or other
  misc_feature (362)..(362): n is a, c, g, or t
  modified_base (502)..(502): a, c, t, g, unknown or other
  misc_feature (502)..(502): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggccaaaccccccaatcatcatttatggtgtcactcgtcggccctcaggatctctcatcgcttctcagctcaagtctggcaacncggcctccctaaccatctctcgggctccagtttgaggacgagtctacttattactgctagttcctttaaatggctccactctcgttgtttcggcgtagcacgagtcgaccgtctcgtcacgccagcctcgcccctggtcnctctccg

SEQ ID NO: 130495 - DNA, 682 bp, Homo sapiens
  misc_feature: GYAE6OF02GS2YO.22.36.D03.1.454.CMB.1.raw
  modified_base (218)..(218): a, c, t, g, unknown or other
  misc_feature (218)..(218): n is a, c, g, or t
  modified_base (233)..(233): a, c, t, g, unknown or other
  misc_feature (233)..(233): n is a, c, g, or t
tcagacatacgcgtcacgaccggtgctcgatttagctgcgtcacgagtctctcttgggggggtctcacggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacngtgactattgggtctttgacttctgtctcctggtaccaacaacacccaggccaaacccccatcactcatttatggtctcactcgtccggcctcgaggtactcgtctcgactcgcttcacgtacggtcctaccaagtcgtacggacaaccgtaccggcccttaccctaaaccctacttacctccgtacgggtccctaccgttagtttacggacgggtaccgtacgttacttaacctttagtttaccgtacgttccgtaacgttttaaccgtttaaacgttacgggtaccgtacccgtaccttacgttccgggtttacggttttaccgggtcggtaacggtaccgtaaccggtaacgttcggtacccgttaccggtaccggtaccgtaaccgtacccgtaaggtccgtacccggtacccccgttcggtacccgtacgttcccgttccccgg

SEQ ID NO: 130496 - DNA, 749 bp, Homo sapiens
  misc_feature: GYAE6OF02GAX7Z.22.36.D03.1.454.CMB.1.raw
tcagacatacgcgtcacgaccggtgctcgatttagctgcgtcacgaggtactcctcttgggggggggtccttcgagggagggctaggccgctccgggttccgggacgtctccaccactggcctgggctctgctattcctcacctttctacacttacagggcactaggggtccctcgggcccacgtcctggacccgtgacccgagccgtgcctccgtgtcttaggaatcagtcctggaaactagttcgatcgaagtctatttccgaggccacttcggggacccaaactcgtcgacagttgggtactttcgactactcgtctccgtggtaccaacaaccacccagacccaaaacccccgactcagtcgatttacgcggtcgtctcgttcgtccggtccctgacggacgtcgtcctccagttcgcgttcctacgacggtccgtaccgtaaacgttccttacggtacctaaaccgtaccgggtcccgtaccccgtaaccgaacctccgttccgtacgggtcccttccgtacggtttacgacgtaccgtacgttacgttaaccttacttcgtccgtcctacgtttacctttaaacgttcgaccgtacctacgttccgttacggtttcgggtttaccgggacggacgtaccgacccggtacggtccggtaccggttcccgtcggttaccgaccggtacccgtaacggtcccgttaccggtacccccggttcggtacctacccgttccgttcccgg

SEQ ID NO: 130497 - DNA, 534 bp, Homo sapiens
  misc_feature: GYAE6OF02HTBCA.22.36.D03.1.454.CMB.1.raw
  modified_base (308)..(308): a, c, t, g, unknown or other
  misc_feature (308)..(308): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggccaaacccccactcactcatttatggtntcactcgtcggccctcaggagtctctcatcgcttctcagctccaagtctcggacaacacggcctaccctaaccatcctcgtcgggctccgtagtttgacggtacgtagtctactttattactgactagtacctttaaattacggctccacttctcgtgtttcggcgaggcacgagtcgaccgtcctcggtcacgccaaggcctcgccccgtcggtctacgtctccg

SEQ ID NO: 130498 - DNA, 551 bp, Homo sapiens
  misc_feature: GYAE6OF02GB709.22.36.D03.1.454.CMB.1.raw
  modified_base (305)..(305): a, c, t, g, unknown or other
  misc_feature (305)..(305): n is a, c, g, or t
  modified_base (367)..(367): a, c, t, g, unknown or other
  misc_feature (367)..(367): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggccaaaccccccaatcatcatttanggtgtcactcgtcggccctcaggacgtctctcatcgcttctcagctccaagtctggacaacnccggccctaccctaaccactctcgtcgggctcctagtttgaggacgtagtcttacttattactgctactttactttaaagtaggcgtcctaacttcgtcgttcggttttcggcggtacggcgaccgtagtcgaccgtcctcggtacacgacccaaggctccgccccgtggtccacctcttcccg

SEQ ID NO: 130499 - DNA, 595 bp, Homo sapiens
  misc_feature: GYAE6OF02FOB7O.22.36.D03.1.454.CMB.1.raw
  modified_base (217)..(217): a, c, t, g, unknown or other
  misc_feature (217)..(217): n is a, c, g, or t
  modified_base (232)..(232): a, c, t, g, unknown or other
  misc_feature (232)..(232): n is a, c, g, or t
  modified_base (254)..(254): a, c, t, g, unknown or other
  misc_feature (254)..(254): n is a, c, g, or t
  modified_base (366)..(366): a, c, t, g, unknown or other
  misc_feature (366)..(366): n is a, c, g, or t
tcagacatacgcgtcacgaccggtgctcgatttagctgcgtcacgagtctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacngtgacattgggtcttttgactntgtctctggtaccaacaacacccaggaccaaaccccccaatccatcatttatggtgtcactcgtcggccctgaggagtctcgtcatcgcttctcaggctcaagtctggcacncgcctcctaacatctctggctcctagtttgacggacgagttctacttattactgactacgtttccttaaaagttcggactcctaacttcgtcggtttacggttttcggacggtaggcctaaccggtagtcggtaacccgttccggtaccggttaccgaaccggtaccccgtaaaggtcccgttaccggtccccccgttacggggttaccctacccgttccgttccccgg

SEQ ID NO: 130500 - DNA, 623 bp, Homo sapiens
  misc_feature: GYAE6OF02IOK7K.22.36.D03.1.454.CMB.1.raw
  modified_base (217)..(217): a, c, t, g, unknown or other
  misc_feature (217)..(217): n is a, c, g, or t
  modified_base (231)..(231): a, c, t, g, unknown or other
  misc_feature (231)..(231): n is a, c, g, or t
  modified_base (304)..(304): a, c, t, g, unknown or other
  misc_feature (304)..(304): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaanagtgacattgggtcttttgactctgtctcctggtaccaacaacaccaggccaaacccccatcatcattatgtntcactcgtcgcctcaggatctctcatcgtcttctcacggctccaagtctcggacaaccaccggccctaccctaaccattcctctcggaccttcgtagtttcggacggacgtacgtcttaactttacttacttgactacgttacctttaaagttacggtccgtacctacttcgttccggtttcgggttttaccgggcggtaacggtccaaccggttaacgtcggtacccggttccgttaccgggtccgtaccggtaccccgaagggtcccttaccgggtccccccgttacgggtacccgttaccttcccgtttaccccgg

SEQ ID NO: 130501 - DNA, 616 bp, Homo sapiens
  misc_feature: GYAE6OF02GBB71.22.36.D03.1.454.CMB.1.raw
  modified_base (306)..(306): a, c, t, g, unknown or other
  misc_feature (306)..(306): n is a, c, g, or t
  modified_base (310)..(310): a, c, t, g, unknown or other
  misc_feature (310)..(310): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggccaaaccccccaactcatcatttanggtntcactcgtccgccctcaggagtctctcatcgcttctcaggctccaagtctggccaacgaccgcctccctaaccatcctcgtgggtctccagtttcgaggtacgtagtcttacttacttactcgacttacgtttacctttaaagttacggccgtaccctacttccgttcggtttcgggttttccggcggtacggtccgtaccggtacggtccggtacccggttcccgtccggtaccgaccggtacccgtaacgggtcccgtacccggtccccccgttcgggtaccctacccgttccgttacccccgg

SEQ ID NO: 130502 - DNA, 580 bp, Homo sapiens
  misc_feature: GYAE6OF02FXWIA.22.36.D03.1.454.CMB.1.raw
  modified_base (307)..(307): a, c, t, g, unknown or other
  misc_feature (307)..(307): n is a, c, g, or t
  modified_base (327)..(327): a, c, t, g, unknown or other
  misc_feature (327)..(327): n is a, c, g, or t
  modified_base (347)..(347): a, c, t, g, unknown or other
  misc_feature (347)..(347): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcagcctcctcactcagggcacagggtcctgggcccagtctgccctgactcagcctccctccgcgtccgggtctcctggacagtcagtcaccatcctcctgcactggaaccagcagtgacgttggtgttataactatgtctcctggtaccaacaacacccaggcaaacgcccccaaactcatgatttangaggtcactaagcggccctnaggagtctctcatcgcttcncaggctcaagtctggacaacgacggcctaccctaaccactctcgtgggcctcctagtttgaggtacgagtcttaacttattactgactacgtttcctttaaagttcggaccacctactcgttcggttcgggttttcggcggtacggaccgacggtagtcgtaccgtccgtcggtccacggacccgaaggtcccgtccgtcccccgtcggtccctcgttccgtccgttcccccg

SEQ ID NO: 130503 - DNA, 648 bp, Homo sapiens
  misc_feature: GYAE6OF02GRN60.22.36.D03.1.454.CMB.1.raw
  modified_base (319)..(319): a, c, t, g, unknown or other
  misc_feature (319)..(319): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcacgtgggaaccaacagtgactagttgggttcttttgactctgtctcctggtaccaacaaccaccacggacccaaaccccccactcactctatttatggtntcactcgtccgccctcgaggacgtctctcatccgtcttctcgacggtcctaccaagtcgtcggaccaaccgtcccggtacccttacccctaaaccacttcctcgtcgggtcccttccgtaggtttcggaacggtacgtacgttaccttaactttactttacgtcgtacttacgttttacctttaaagttcggaccgtacctacgttcgttcggtttcgggttttccggacggtaggtccgaccggtagtccgtacccggttccgtccggtacgacgtacccgaaggtcccttacccggcccccgttcggtcctaccgtccgttaccccg

SEQ ID NO: 130504 - DNA, 236 bp, Homo sapiens
  misc_feature: GYAE6OF02GFCV7.22.36.D03.1.454.CMB.1.raw
  modified_base (234)..(236): a, c, t, g, unknown or other
  misc_feature (234)..(236): n is a, c, g, or t
tcagacatacgcgtcacgaccggtgctcgatttagctgcgtcacgatctctctgggctccagtttgaggacgagtctacttattactgcagttcctttaaattaggcgccactctcgtggttttcggcggaggcaccgaagtgaccgtcctcggtcagcccaaggctgccccctcggtcactctgttcccaccctcctcacgctatgtctgagcgggctggcaaggcgcatagnnn

SEQ ID NO: 130505 - DNA, 527 bp, Homo sapiens
  misc_feature: GYAE6OF02IPTHH.22.36.D03.1.454.CMB.1.raw
  modified_base (343)..(343): a, c, t, g, unknown or other
  misc_feature (343)..(343): n is a, c, g, or t
  modified_base (520)..(520): a, c, t, g, unknown or other
  misc_feature (520)..(520): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaacccccactcatcatttatggtgtcactcgtcggccctcaggagtctctcatcgcttcnctaggctccaagtctggaccaacgacggccctccctaaccatctctgggctctagtttcgaggacgagtcttaacttattactgctagttacctttaaataggctccactctcgttggtttcggcggtacggcaccgagtgaccgtcgtcggcacgcccaaggctccgccctcgtcnctctccg

SEQ ID NO: 130506 - DNA, 629 bp, Homo sapiens
  misc_feature: GYAE6OF02GN35L.22.36.D03.1.454.CMB.1.raw
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacagttggtcttttgactctgtctcctggtaccaacaacacccaggccaaaccccccaactcatcatttatggtgtcactcgtcggccctcaggagtctctcatcgcttctcacggctcctaagtctggaccaacgaccggccctacccctaaccatcctcgtcgggcctccgtagtttggacggtacgtacgtcttaacgttattactgctagtttaccttaaagttacggcgtccctacgttccgttcgtttcgggtttttccgggacggtacggtccgtaacccggtagttccggtacccggttcccggttccgggttccaaccggtaccccgtaaagggcccttcccggtcccccccgttcgggtacccttacccgttccgtttcccccgg

SEQ ID NO: 130507 - DNA, 525 bp, Homo sapiens
  misc_feature: GYAE6OF02GYW5N.22.36.D03.1.454.CMB.1.raw
  modified_base (380)..(380): a, c, t, g, unknown or other
  misc_feature (380)..(380): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattggggtcttttgactctgtctcctggtaccaacaacacccaggcaaaccccccactcatcatttatggtgtcactcgtcgccctcaggagtctctcatcgcttctcaggctcaagtctggcaacacgcctcctaacatctcngggctcagtttgagacgagtctacttattactgctagtttcctttaaattggctccactcttcgttggtttcggcggtaggcgacgagtcgaccgtccgtcggtcacgcccaaggcctcgcccccgttcggctacctcgttcccg

SEQ ID NO: 130508 - DNA, 674 bp, Homo sapiens
  misc_feature: GYAE6OF02H1NUE.22.36.D03.1.454.CMB.1.raw
  modified_base (302)..(302): a, c, t, g, unknown or other
  misc_feature (302)..(302): n is a, c, g, or t
  modified_base (305)..(305): a, c, t, g, unknown or other
  misc_feature (305)..(305): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcacgtgggaccaacagtgacattgggtcttttgacttctgtctctggtaccaacaacaccaggccaaacccccactcatcattangtntcactcgcgcctcagcgtctctcatcgtcttctcacggtcctacctaacgttctcggtaccaacgaccggtccccttaccctaaccgtacttcctcgtcgggtcctaccgtagtttcggacggtacgtacgttaccgttaactttacttacttcgtaccttaacgtttacccttttaaaagttccgggtacctacccgttaaccgttccgtttccgggttttcgggttttccggggacgggtaacggtacccgaaccggtaggttccggttacccggtcccggttaccggtaccgaaccggtaccccgtaagggtcccgttacccggccccccgtttacgggtacccttacccgttccgtttcccccgg

SEQ ID NO: 130509 - DNA, 553 bp, Homo sapiens
  misc_feature: GYAE6OF02FRM8P.22.36.D03.1.454.CMB.1.raw
  modified_base (310)..(310): a, c, t, g, unknown or other
  misc_feature (310)..(310): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgaaattgggtcttttgactctgtctcctggtaccaacaacacccaggccaaaccccccaactcatcatttatggtntcactcgtcggccctcaggagtctctcatcgcttctcaggctcaagtctggcaacacggccctaccctaaccatctctcgggctcctagtttgaggtacgagtctacttattactgtctagtttacctttaaattacggccacctactcgttcggttggttttcggcggtaggcctaccgagtcgaccgtccgtcggtaccacggcccaaggcctcgcccctcggtcctacgtctcgtccccg

SEQ ID NO: 130510 - DNA, 636 bp, Homo sapiens
  misc_feature: GYAE6OF02IXCTO.22.36.D03.1.454.CMB.1.raw
  modified_base (217)..(217): a, c, t, g, unknown or other
  misc_feature (217)..(217): n is a, c, g, or t
  modified_base (322)..(322): a, c, t, g, unknown or other
  misc_feature (322)..(322): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacagtgacagttgggtcttttgactctgtctcctggtaccaacacaccaggccaaacccccaatcatcattatggtgtcactcgtcggccctnaggagtctctcatcgcttctcaggctcaagtctcggaccaacgaccggcctaccctaacctactcctcgtcgggccttccgtagtttgacggtacgtagttaccttaactttacttactcgtctacgtttacctttaaaagttcggacctcctacgttccgttccggtttgggtttttccgggcggtaacggtccgtaaccggtacggttacggtaccccggtttcccggtaccggttaccgaaccggtaccccgaagggtcccttacccggtaccccccggttccggtaccctacccgttccgttaaccccgg

SEQ ID NO: 130511 - DNA, 572 bp, Homo sapiens
  misc_feature: GYAE6OF02GN959.22.36.D03.1.454.CMB.1.raw
  modified_base (383)..(383): a, c, t, g, unknown or other
  misc_feature (383)..(383): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacaccaggccaaaccccccatcactcattatggtgtcactcgtcggccctcgaggatctctcatccgcttctcaggcctccaagtctgaccaacgccggcctacccaaccnctctcgtgggctccgtagtttcgacggacgtagtcttaactttacttactgacttagtttacctttaaattcggacctcctacttcttcgttgggtttccggacggtagccgaacgtagtcgtacccggtccttacggtcgacgcccgaaggtcctccggtccccctcggtacctaccgttcttccccg

SEQ ID NO: 130512 - DNA, 554 bp, Homo sapiens
  misc_feature: GYAE6OF02FQT1H.22.36.D03.1.454.CMB.1.raw
  modified_base (310)..(310): a, c, t, g, unknown or other
  misc_feature (310)..(310): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggccaaaccccccaactcatcatttatggtntcactcgtcggccctcaggatctctcatcgcttctcaggctccaagtctggccaacgaccggccctaccctaaccactcctcgtcgggcctccgtagtttgacggtacgagttcttaacttattactgactagtttacctttaagttacggcgtccacttctcgttggtttcggcggtagcgaccgagtcgaccgtccgtcggtcacgcccgaaggcctcgcccccgtggtccacgtcctcccg

SEQ ID NO: 130513 - DNA, 680 bp, Homo sapiens
  misc_feature: GYAE6OF02FIFUN.22.36.D03.1.454.CMB.1.raw
  modified_base (217)..(217): a, c, t, g, unknown or other
  misc_feature (217)..(217): n is a, c, g, or t
  modified_base (232)..(232): a, c, t, g, unknown or other
  misc_feature (232)..(232): n is a, c, g, or t
  modified_base (253)..(253): a, c, t, g, unknown or other
  misc_feature (253)..(253): n is a, c, g, or t
tcagacatacgcgtcacgaccggtgctcgatttagctgcgtcacgatctctcttgggggggtctcaggaggcagcgctctcgggacgtctccgaccatggcctgggctctgctattcctcaccttcctcactcagggcacagggtcctgggcccagtctgccctgacccagcctgcctccgtgtctggatcatctggacagtcgatcagcatttccngcactgggaccaacngtgactattggtctttgactntgtctctggtaccaacaacaccaggccaacccccatcactcattatggtgtcactcgtcgccctcaggagtctctcatcgcttctcgaggtctaccaagttcgtggccaacgtaccggccctaccctaaccactcctcgtcgggtccttcccgtagttttacggacgggtaccgtagttaccttaactttactttacctcgtacttaacgttttacccttttaaaacgttacgggcccgttacccgtaacctttccgttaccggtttccgggttttccgggaccgggttacggtacccgtaaccgggtaggttaccggtacccggtttcccggttaccgggtacccgtaccggtaccccgtaacgggtcccgttacccggttaccccccgttccgggtacccgttacccgttccgtttacccccggg

SEQ ID NO: 130514 - DNA, 662 bp, Homo sapiens
  misc_feature: GYAE6OF02H62QN.22.36.D03.1.454.CMB.1.raw
  modified_base (232)..(232): a, c, t, g, unknown or other
  misc_feature (232)..(232): n is a, c, g, or t
  modified_base (306)..(306): a, c, t, g, unknown or other
  misc_feature (306)..(306): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacngtgactattgggtctttgactctgtctcctggtaccaacaacaccagaccaaacccccactcatcattatggtntcactcgtacggccctcgaggacgtctctcatcgtcttcctcacggtctaccaagtctggaccaacaccggtccctaccctaaccactctacgtcggtcctaccgtagtttcgacggtacgtacgttcttaacgtttattacctgtactaacgttttaccgtttaaagttacggtaccgtccctaaccgttccgtttacgggtttcgggtttttaccgggacgggtaacggtaccgtaacccggtaggttaccggtacccggttcccgttaccgggtcccaacgggtaccccgtaaacgggtcccgttacccggtccccccgttacgggttaccctaccggttacccgttccccgg

SEQ ID NO: 130515 - DNA, 714 bp, Homo sapiens
  misc_feature: GYAE6OF02GT0M7.22.36.D03.1.454.CMB.1.raw
  modified_base (218)..(218): a, c, t, g, unknown or other
  misc_feature (218)..(218): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcacgtgggaccaacagtgactagttgggtcttttgacttctgtctcctgtaccaacaacacccacgaccaaacccccaactcactctatttatggtctctacctcgtccggccctcgagtacgtctctctactccgtcttctcgacggtctacctaagtcgtacggaccaacgtccggtaccctaccctaaccctacttccgttaccgtcggggtaccttccgttacggtttacgacgttacggaacgttacgttacctttaactttaacttaccttacgtacttacgttttaaccgttttaaaagttccgggtacctacccgtacctttccgtttaccgggtttccgggttttacggaccgggtacgggtaccgtaccgggtaacggttaccggtaacccggttcccggtaccgggtaccgtaacccggtaccccgaacgggttccccgttacccggtcccccccggttacggttaccctacccgtttccccgg

SEQ ID NO: 130516 - DNA, 637 bp, Homo sapiens
  misc_feature: GYAE6OF02FKEN4.22.36.D03.1.454.CMB.1.raw
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattggggtcttttgactctgtctcctggtaccaacaacacccacggccaaaccccccaactcatcatttatggtgtcactcgtcggccctcaggagtctctcatcgcttctcaggctccaagtctggacaacacggccctaccctaacctatcctcgtcgggcctccgtagtttcgacggtacgacgttccttaactttactttacgtcgactacgtttaccttttaaagttacggtaccgtaccctaccttccgttcggtttacgggtttttccggacgggtacggtccgtaacccggtaggttccggtacccggttccgttaccgggtaccgtaaccggtaccccgaagggtccctaccggccccccgttaccgggtccctaccttaccgttccccgg

SEQ ID NO: 130517 - DNA, 794 bp, Homo sapiens
  misc_feature: GYAE6OF02I75FY.22.36.D03.1.454.CMB.1.raw
tcagacatacgcgtcacgaccggtgctcgatttagctgcgtcacgatctctcgttgggggggtctcaggaggcagcgctctcgggacgtctccaccatggcctgggctctgctattcctcaccttcctcactcagggcacagggtcctgggcccagtctgccctgaccagcctgcctcgtgtctggatcatctggacagtcgatcagctatttcctgcacgtcgggaccaacagtgactagttgggtcttttgactctgtctcctggttaccaacaacaccacggaccaaacccccaactcatctaatttataggtgtctactcgtccgccctcacggtacgtctctactactcgtacttctacgtagtcctctaacgtcgtcggtaccaaccgtaccggtaccctaccctaaccgtactccgttacgtcgggtacccttaccgttacggttttacggaacggttaaccggtacgtttacctttaaccgttttaacgtttaccgtcggtacctttacgggtttttaaacccgttttaaaacgtttaccgggtacccgttacccgttaaacgtttccccgttttacggggttttacggggttttttacccgggaacggggttaaccggtaaccggttaacccgggttaaaggttttcccggtaaccccgggttttcccgttaccgggttaacccggtaaccgggtacccccggtaaacggggttcccgtttaccccgggtacccccccggtttacgggtaccccttaaccccggttttcccgtttaacccccggg

SEQ ID NO: 130518 - DNA, 624 bp, Homo sapiens
  misc_feature: GYAE6OF02HY5JB.22.36.D03.1.454.CMB.1.raw
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacaccaggccaaacccccatcatcattatggtgtcactcgtcggcctcgagagtctctcatcgtcttctcaggtctaccgaagtcctaggaccaaaccgaccgggtacccctacccctaacctacttcctacgttcgggcctaccgtagtttacgacgggtaccgtagttacttaacgtttatttactcgtcttaacgtttacctttaaagttacggaccgtacctaacttccgttacggtttcgggttttcggacggtacggtccgtaccggtagtccggtaccggtcccgtacggttccacggtacccgaaggtcctacccggtccccgtccggtcctaccgtcttacccg

SEQ ID NO: 130519 - DNA, 672 bp, Homo sapiens
  misc_feature: GYAE6OF02ICI5I.22.36.D03.1.454.CMB.1.raw
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggactcatctggacaggtcgatcagcatttccagcacgtggggaacccaagagtggactagttgggtctttgactctgtctctgtaccaacaaccaccagaccaaaccccccactcactcattactgtagtcactcgtcgcctcaggacgtctctcactcgtcttctccacggtcctaccgtaacgtccgttacggaccaaccgtacccgggaccccttacccgttaaaccctcgtttaccgttacccgttcgggcccttaccgtaaggttttacgggaaccgggacgtacggttacttaacctttattaacgttcgtacgtacgtttaacctttaaacggttacggtaccgaccctacgttccgttaccggtttggtttccgggacgtacgggacctaccggtaagtccggtaaccgtcccgtaccggtacaccggtcccaacgggtccctcgcccccgttaggtacctaccgtccgttccccgg

SEQ ID NO: 130520 - DNA, 531 bp, Homo sapiens
  misc_feature: GYAE6OF02GG5SY.22.36.D03.1.454.CMB.1.raw
  modified_base (309)..(309): a, c, t, g, unknown or other
  misc_feature (309)..(309): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaaccccccaactcatcatttatggtntcactcgtcggccctcaggagtctctcatcgcttctcagctcagtctgcacacggcctaccctacatctcgtcggctccgtagttcgaggacgagtacttacttattactgctagtttacctttaaattaggccgcctacttctcgttcgtttcggcggtagccacgagtcgaccgtccgtcggtcacgccgaggcgtcgtccccgtcgtctacctctcccg

SEQ ID NO: 130521 - DNA, 675 bp, Homo sapiens
  misc_feature: GYAE6OF02H50DX.22.36.D03.1.454.CMB.1.raw
  modified_base (307)..(307): a, c, t, g, unknown or other
  misc_feature (307)..(307): n is a, c, g, or t
  modified_base (321)..(321): a, c, t, g, unknown or other
  misc_feature (321)..(321): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacagtttgggtcttttgactctgtctctggtaccaacaacaccacgaccaaacccccactcatcattatgtntcactcgtcgcctnaggatctctcatcgtcttctcaggctaccaagtctacggacaaaccgaccggtcccttaccctaaccacttcctccgtcgggtcccttccgtaggtttcggaacggtaccgtagttaccttaactttaattaccttgtacttacgtttaacctttaaagttacggtaccgtacctaccgtttccgttaccgggtttcgggtttttaccgggacgggtacgggtacccgtaaccggtaacggttccggtaaccccggttccggttacccgggttcccgaaccggtaccccgtaacgggtcccgttacccgggtcccccccgttcgggtacccttacccgttccgtttacccccgg

SEQ ID NO: 130522 - DNA, 642 bp, Homo sapiens
  misc_feature: GYAE6OF02HVOU3.22.36.D03.1.454.CMB.1.raw
  modified_base (218)..(218): a, c, t, g, unknown or other
  misc_feature (218)..(218): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcacgtcgggaccaacagtgactagttgggtcttttgactctgtctctggtaccaacaacaccacgaccaaaccccccactcactctatttatgtctctactcgtcggccctcgaggtactctctcatccgtcttctcacggtctaccaacgtctacgggaccaaccgtccggcccttaccctaaccactcctacgtcgggacctaccgtaggtttcggaacgggtacgtacgttccttaaacgtttactacgttgtacttaacgtttacctttaaagtaccggtccgttaccctacgttccgttacggtttcgggtttccgggacggtacgtaccgaaccgtacggtcgtacccgtccggtccggtacaccggtacccgaacggtcctccggtcccccgtacggtcctaccgttccttacccg

SEQ ID NO: 130523 - DNA, 622 bp, Homo sapiens
  misc_feature: GYAE6OF02FMPQI.22.36.D03.1.454.CMB.1.raw
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaaccaccacggaccaaaccccccaactcatcatttatggtgtcactcgtcggccctcaggagtctctcatcgtcttctcaggtctaccaagtcgtcggacaaaccaccgggtccctacccctaacctaactcctcgtacgggtccttccgtagtttcggaagggtaccgagttcttaactttattactgtctacgtttaccttttaaagttacggcgtacctaccttcgttcgtttcggggttttcggcggtacggtccgaccggtagtacggacccgttccgtcggtaccgtacggtaccccgaagggtccctccggccccccgttcgggtccctaccgttcttccccgg

SEQ ID NO: 130524 - DNA, 551 bp, Homo sapiens
  misc_feature: GYAE6OF02IWSQY.22.36.D03.1.454.CMB.1.raw
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaaccccccatcatcattatggtgtcactcgtcgcctcaggtacgtctctcactcgcttctcaggctcaagtctggccaacgacggcctccctaaccatctctcgggcctccgtagtttcggaggacgtagtccttacttattaacctgctagtttcctttaaagttacggctaccacttcgtacgttcggtttcggcggtaagccgtacgagtcgaccgtccgtcgtcacgtcccgaaggtcctcggcccccttggtccacctctcccg

SEQ ID NO: 130525 - DNA, 594 bp, Homo sapiens
  misc_feature: GYAE6OF02JKJLI.22.36.D03.1.454.CMB.1.raw
  modified_base (271)..(271): a, c, t, g, unknown or other
  misc_feature (271)..(271): n is a, c, g, or t
  modified_base (368)..(368): a, c, t, g, unknown or other
  misc_feature (368)..(368): n is a, c, g, or t
tcagacatacgcgtcacgaccggtgctcgatttagctgcgtcacgatctctcttgggggggtcgtcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccctgcactgggaccaacagtgacattggtctttgactctgtctctgtaccacaacncccaggaccaaacccccaactcactacactttatgtcgtcactcggtccgccctccaggacgttctctctatcgtccttctcacggtctccaagtcnggacaaccacggtccctaccctaacactcctcgtcgggtccctcgtagtttcgacgggtaccacttcttactttattacctgcttagtttccctttaaaagttcggactccctaatccgttacggttcggttttcggccggaagtccgtaccgtagtcgtccgtccgttacggcaccggtacccgaggtacctccggtaccccctggtaccaccgttccgtcccgg

SEQ ID NO: 130526 - DNA, 537 bp, Homo sapiens
  misc_feature: GYAE6OF02JKHBB.22.36.D03.1.454.CMB.1.raw
  modified_base (232)..(232): a, c, t, g, unknown or other
  misc_feature (232)..(232): n is a, c, g, or t
tcagacatacgcgtcacgaccggtgctcgatttagctgcgtcacgatctctcttgggggggtcgtcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacngtgacattggtctttgactctgtctcctggtaccaacaacacccaggccaaaccccccaactccactctattatggtgtcactcgtcggccctcaggagtctctcatcgcttctcgaggctccaagtctggcaacgacggcctaccctaaccatcctcgtcgggcctccgtagtttcgaggtaccgagttctactttattactgctagttcctttaaatggctcctactctcgttgtttcggcgagcacgtagtcgaccgtccgtcgtcacgcccaggctccggccccttggcctactcgtcccg

SEQ ID NO: 130527 - DNA, 564 bp, Homo sapiens
  misc_feature: GYAE6OF02H38ML.22.36.D03.1.454.CMB.1.raw
  modified_base (217)..(217): a, c, t, g, unknown or other
  misc_feature (217)..(217): n is a, c, g, or t
  modified_base (232)..(232): a, c, t, g, unknown or other
  misc_feature (232)..(232): n is a, c, g, or t
  modified_base (312)..(312): a, c, t, g, unknown or other
  misc_feature (312)..(312): n is a, c, g, or t
  modified_base (348)..(348): a, c, t, g, unknown or other
  misc_feature (348)..(348): n is a, c, g, or t
  modified_base (365)..(365): a, c, t, g, unknown or other
  misc_feature (365)..(365): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacngtgacagtttggggtcttttgactctgtctcctggtaccaacaacaccaggccaaaaccccccactcatctattatggtntcactcgtcgccctcaggacgtctctcatcgcttcncagctcagtctgcaacncgcctaccaacatctctggctcctagtttgaggacgagttctactttattactgtctagtttacctttaaattcggcctacccacttccgtcgtttggttttccgggcggtacggccgtacgtacgtcgtacccggtcgttccggtcacgtcccgtaacggccgtacccgccccgttccggtcctaccgtccttccccg

SEQ ID NO: 130528 - DNA, 533 bp, Homo sapiens
  misc_feature: GYAE6OF02HLH87.22.36.D03.1.454.CMB.1.raw
  modified_base (271)..(271): a, c, t, g, unknown or other
  misc_feature (271)..(271): n is a, c, g, or t
  modified_base (455)..(455): a, c, t, g, unknown or other
  misc_feature (455)..(455): n is a, c, g, or t
  modified_base (470)..(470): a, c, t, g, unknown or other
  misc_feature (470)..(470): n is a, c, g, or t
tcagacatacgcgtcacgaccggtgctcgatttagctgcgtcacgatctctcttggggggggtcgtcaggaggcagcgctctcgggacgtctccaccatggcctgggctctgctattcctcaccttcctcactcagggcacagggtcctgggcccagtctgccctgacccagcctgactccgtgtctggatcatctggacagtcgatcagcatttcctgcactgggaccaacagtgacattggtcttttgactctgtctcctggtaccaanaacacccaggaccaaaccccccaactcatcattatggtgtcactcgtcgccctcaggacgtctctcatcgtcttctcacggctccaagtctcggacaacacggccctaccctaaccactcctcgtgggcctccgagtttcgaggacgagtcttacttatactgctattactttaatcgctaccnctctgttgtttcggngacgcacgagcgtacccggtctcggtcacgccaaggtcctcgccccgttcggcacctctcccg

SEQ ID NO: 130529 - DNA, 567 bp, Homo sapiens
  misc_feature: GYAE6OF02F9OLD.22.36.D03.1.454.CMB.1.raw
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaaccccccaactcatcatttatggtgtcactcgtcggccctcaggagtctctcatcgtcttctcaggctccaagtctggcaacacggcctaccctaaccactcctcgtcggcctccgagtttgacgggtacgacgttcttactttattactgtactagtttacctttaaattacggtacctcctacttcgttcgttgggttttccggcggtaggccgaccgagttcgaccgttccgtcgtcgtacgccgaaggtctcgccccgttccggtcaccgtcgttcccg

SEQ ID NO: 130530 - DNA, 605 bp, Homo sapiens
  misc_feature: GYAE6OF02IZKMB.22.36.D03.1.454.CMB.1.raw
  modified_base (383)..(383): a, c, t, g, unknown or other
  misc_feature (383)..(383): n is a, c, g, or t
  modified_base (390)..(390): a, c, t, g, unknown or other
  misc_feature (390)..(390): n is a, c, g, or t
  modified_base (409)..(409): a, c, t, g, unknown or other
  misc_feature (409)..(409): n is a, c, g, or t
  modified_base (487)..(487): a, c, t, g, unknown or other
  misc_feature (487)..(487): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcacgtcgggaccaacagtgactagttgggttcttttgactctgtcctcctggtaccaacaaccacccacggacccaaaccccccaactccatctactttagtggtctcactcgtccggccctcgaggacgtctctcatcgtccttctcacggctaccgagtcgngacaacnccggtccctaccctaaccnctctctcggccttcgtagtttcggagtacgattcttaacttattactgtacttacgtttacctttaaagtcggtaccncctactttaccgttcgttcgggttttcggcggtacgccgtaacgtacgtcgacccgttccgtaccgtacgacgacccgagtccgtcccggtccccgttcggtcctacgtccgtccccg

SEQ ID NO: 130531 - DNA, 710 bp, Homo sapiens
  misc_feature: GYAE6OF02HC645.22.36.D03.1.454.CMB.1.raw
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcacgtgggaccaacagtgacagttgggtcttttgactctgtctcctggtaccaacaacacccacggccaaaccccccaactcatctattatggtgtcactcgtcggccctcaggtacgtctctcatcgtcttctcacgctcctaagtcgtggaccaacgaccggtaccctacccctaaccctactcctaccgtacgggtcctacccgttaggtttacggtaacggtaccgtaacggttaccttaacgttttaactttaccttacggtaccttaacgttttaaccctttttaaaagttacgggtacccgtaccctaccgttaccgttccggtttcggggtttttccgggaccgggtacgggtaccgtaacccggtacggttaccggtacccggttcccgtaccgggttacccgaccggtaccccgtaacgggtcccttacccggtacccccccgtttaccgggtaccccgttaccgttcccgtttacccccgg

SEQ ID NO: 130532 - DNA, 743 bp, Homo sapiens
  misc_feature: GYAE6OF02H7M7H.22.36.D03.1.454.CMB.1.raw
  modified_base (171)..(171): a, c, t, g, unknown or other
  misc_feature (171)..(171): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgaccccngcctcgcctccgtgtcgtggactcatcgtggacagtacgatcgacgctactttccgtgacctacggtacgggaaccaacgtacggtagaccttaggtttcggggttttcttttacgacttcgttcgttccttccgtacggtaacccaaacaaccacccgacggaacccccaaaacccccctactacctacttaccttaagtttacgttgggttaccgtcctaacccggtttccggtccccggaccccttacggtacggtacgttccttacctacgtaccgttccgtacctttcgtacgacggtcctaccgtaacgtcgtacggacccaacgtaccggtaccccttaccctaactcgtccgtccggtcggtacctcgttagttacgggacgtacgtacgttaccttacgttacttacgtgttacgttacgtttaacctttaaaggttccggtacctcctacgtttcgttcggtttcgggttcggacggtacgtccgacgtacgtccgtaccgtcgtacgtcgaccgtaccgacgtccgtacccggtcccgttacgcttacccgtgttaccccg

SEQ ID NO: 130533 - DNA, 673 bp, Homo sapiens
  misc_feature: GYAE6OF02HTQCC.22.36.D03.1.454.CMB.1.raw
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcacgtacgggaacctaacgaggtcgacagtttgggtcttttcgactctgtctcctggtaccaacaacacccagaccaaacccccatccatcattagtgtgtcactcgtcgcctcaggtactctctcatcgtcttctcacgctacaagtctggacacgacggtccctaccctaacactccgtacgtcgggaccttccgtaggtttcggaacggaccgtacgttaccttaactttacttaacgtcgtacttaacgtttaaccgttttaaagttaaccgggtccgtacccgtacgttaccgttcggtttcgggttttcgggacggtacggtaccgaccgggtacgttcccggtaccggttcccgtccgggttaccacccggtaaccccgttaaccggtacccgttccccggtacccccgttaccgggtttacctacccggttcccgtttacccccgg

SEQ ID NO: 130534 - DNA, 691 bp, Homo sapiens
  misc_feature: GYAE6OF02HSLV5.22.36.D03.1.454.CMB.1.raw
  modified_base (217)..(217): a, c, t, g, unknown or other
  misc_feature (217)..(217): n is a, c, g, or t
  modified_base (233)..(233): a, c, t, g, unknown or other
  misc_feature (233)..(233): n is a, c, g, or t
  modified_base (305)..(305): a, c, t, g, unknown or other
  misc_feature (305)..(305): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcacgtgggaccaacngtgactagttggtctttgactctgtctctggtaccaacacaccagacccaaacccccatcatctattatgtntcactcgtccgccctcgaggtacgtctctacacgtccgtctttcgacgtacggccttaccgaacgttcgtacggaccaaccgtaccggtcccccttaaccctaaccgtacttccgttaccgtcgggcccttaccgtaggtttacggaacggtacgtacgttcttaaacttttactacgtcgtacgttacgtttaaccgtttaaagttcggacccgtacctaccgttcgttaccggtttcgggtttaccgggacgggtaccggtaccgtaaccggtacggttaccggttaccccggtccggttacccggtaccgtaccggtaccccgtaaggttcccgtcccggttaccccccgttccgggttacctacccgttccgttacccccgg

SEQ ID NO: 130535 - DNA, 587 bp, Homo sapiens
  misc_feature: GYAE6OF02HG5XO.22.36.D03.1.454.CMB.1.raw
  modified_base (365)..(365): a, c, t, g, unknown or other
  misc_feature (365)..(365): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggccaaaccccccaactcatcattatggtgtcactcgtcggccctcaggagtctctcatcgcttctcaggctccaagtctgcaacncgcctccctaacatctctcggctcctagtttgaggtacgagtcttacttattactgctagtttacctttaaagtcggccgtcctaacttccgttacggttcgggttttccggcggtacggtcctaccggtagttcggacccggttccgtccgggtaccacggtaccccgaagggtcccgttaccggccccccgttcggtaccctaccgttcccgttccccgg

SEQ ID NO: 130536 - DNA, 580 bp, Homo sapiens
  misc_feature: GYAE6OF02IZWQ6.22.36.D03.1.454.CMB.1.raw
  modified_base (463)..(463): a, c, t, g, unknown or other
  misc_feature (463)..(463): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacagttggtcttttgactctgtctcctggtaccaacaacaccaggccaaacccccaactcatcattatgtgtcactcgtcgccctcaggagtctctcatcgcttctcagctccaagtctggcaacgaccggtccctaccctaacctactctcgtcgggtcctccgtaagtttcgacggacgtagttccttactttattactgtctacgtttacctttaaagttcggcncctacttcttccgttggttttcggcggtacggactaccggtagtcggtaccgttctccggtcgacgaccgaacggtcctccggtacccccgttcggtcctaccgttccttaccccgg

SEQ ID NO: 130537 - DNA, 617 bp, Homo sapiens
  misc_feature: GYAE6OF02I3MBM.22.36.D03.1.454.CMB.1.raw
  modified_base (360)..(360): a, c, t, g, unknown or other
  misc_feature (360)..(360): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattggtcttttgactctgtctcctggtaccaacaacaccaggccaaaccccccaactcatcatttatggtgtcactcgtccggcctcaggatctctcatcgcttctcagctcaagtctgcaacncgcctacctaaccatctcgtcggcctcctagtttgacggacgtagtcttaacttacttactgtactacgtttacctttaaagttacggtccgtacctacgttcgttccggttcgggtttttccgggacggtacggtaccgtaacccggtaggtccgtacccggttccggttaccggtacccgtaaccggtaccccgtaacgggtccgttcccggtccccccgttaccgggtaccctacccgttcccgtttaccccgg

SEQ ID NO: 130538 - DNA, 629 bp, Homo sapiens
  misc_feature: GYAE6OF02IEDFR.22.36.D03.1.454.CMB.1.raw
  modified_base (216)..(216): a, c, t, g, unknown or other
  misc_feature (216)..(216): n is a, c, g, or t
  modified_base (231)..(231): a, c, t, g, unknown or other
  misc_feature (231)..(231): n is a, c, g, or t
  modified_base (303)..(303): a, c, t, g, unknown or other
  misc_feature (303)..(303): n is a, c, g, or t
  modified_base (331)..(331): a, c, t, g, unknown or other
  misc_feature (331)..(331): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcacgtgggaccaangtgacagttggtctttgactctgtctctgtaccaacaacaccagccaaacccccactcactcacttatggtntcactcgtcgcctcgagcgtctctacgntcgtctctcagctacgaacgtctggacctaacacggtccctaccctaacctaactccgtcgtcgggtacctccttagtttcgacggtaccgtaagtccttacgtttagttactcggtacttacgttacctttttaaagtacggtctaccctactccttccggtttcggttttccggacggtaaccggtcgtaaacccgggattaccggtacccggttccgtaccggttccaacgtaacccgtaacggtccgtccggtaccccccgttccggggtaccctaccgttccgtttaccccgg

SEQ ID NO: 130539 - DNA, 626 bp, Homo sapiens
  misc_feature: GYAE6OF02JJJ2S.22.36.D03.1.454.CMB.1.raw
  modified_base (301)..(301): a, c, t, g, unknown or other
  misc_feature (301)..(301): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattggtcttttgactctgtctctggtaccaacacaccagaccaaacccccatcatcattatggtntcactcgtccgcctcaggagtctctcatcgtcttctcgacggtctaccgtaagtcgtcggaccaaaccgaccggtcccttaccccgtaacctacttcctcgttcgggaccttccgtagtttcgaacggacgtacgtacttaactttacgttaccgtgtacgtacgtttacctttaaagtcggaccgtaccctacgttccgttcgtttcgggtttccggcggtaacgtccgtaaccgtaggtccgtacccgtccggtccggtacgaccgtacccgtaaggtcccttaccggtacccccgttcggtaccctaccgttccttacccgg

SEQ ID NO: 130540 - DNA, 650 bp, Homo sapiens
  misc_feature: GYAE6OF02I9QD0.22.36.D03.1.454.CMB.1.raw
  modified_base (217)..(217): a, c, t, g, unknown or other
  misc_feature (217)..(217): n is a, c, g, or t
  modified_base (307)..(307): a, c, t, g, unknown or other
  misc_feature (307)..(307): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcacgtgggaccaacagtgacagttgggtcttttgactctgtctcctggtaccaacaccaccagaccaaacccccatcatcattatggtntcactcgtcggccctcaggactctctcactcgtcttctcacggtctaccgaagtctacggaccaaccgaccggtacctacccctaacctacttccgtcgtcgggtccttaccgtaggtttacgaacggtaaccgtacgttaccttaactttagttacgttcgtaccgtacgttttaccgtttaaagttacggtaccgtaccctacgttaccgttcggtttacgggttttccgggcggtaacggtcgaccggtagtcggtacccggttcgtaccggtcgaaccggtacccgtaacgggccgttaccggtacccccgttacggtccctaccgttccgttaccccg

SEQ ID NO: 130541 - DNA, 586 bp, Homo sapiens
  misc_feature: GYAE6OF02I2GBP.22.36.D03.1.454.CMB.1.raw
  modified_base (233)..(233): a, c, t, g, unknown or other
  misc_feature (233)..(233): n is a, c, g, or t
  modified_base (370)..(370): a, c, t, g, unknown or other
  misc_feature (370)..(370): n is a, c, g, or t
  modified_base (434)..(434): a, c, t, g, unknown or other
  misc_feature (434)..(434): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactcgggaccaacngtgacagttgggtcttttgactctgtctcctggtaccaacaacacccaggaccaaaccccccaactcatcattatggtgtcactcgtcggccctcaggagtctctcactcgtcttctcagctcaagtctcgacaacnccggcctaccctaaccactctcgtcgggtcctccgtagtttgaggacgtagttccttaactttnttactcgtctacgtttacctttaaagttggtacctcctacgtcgttcgttggttttcggcggacgcctaccggacgtcgtacccggtcctccgggtacacggacccgaaggtccgtaccgtcccccgttggtcctaccgtccgttaccccgg

SEQ ID NO: 130542 - DNA, 678 bp, Homo sapiens
  misc_feature: GYAE6OF02H6AO3.22.36.D03.1.454.CMB.1.raw
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactcgggaaccaacgagtgactagttgggttctttgactctgtctcctggtaaccaacaaccaccgagacccaaacccccactcatctattatgtctcactcgtccgcctcgacgtagtctctcactcgtcttctcgacggtcctaccgtaacgtcgtcggaccaaccgaccggtccctaccctaacactccgtacgtcgggcctcgtacgtttggaacggacgtacgtaccttacgtttaacttacgtcgtaccttacgtttaaccttttaaaggttaaccgggtcccgtaccctaccgttcggtttccggtttcgggttttccggggacggtaacggtaccgtaacggtacggttccggtacccgttccggtaccggtaccgtaccgtaccccggtaacggtccttaccccggtccccgttacccggttaccgtacccgttcccgtttaccccccgg

SEQ ID NO: 130543 - DNA, 633 bp, Homo sapiens
  misc_feature: GYAE6OF02ICQZW.22.36.D03.1.454.CMB.1.raw
  modified_base (310)..(310): a, c, t, g, unknown or other
  misc_feature (310)..(310): n is a, c, g, or t
  modified_base (346)..(346): a, c, t, g, unknown or other
  misc_feature (346)..(346): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacagttgggtcttttgacttctgtctcctggtaccaacaacaccacggaccaaacccccactcatctattatgtntcactcgtcggccctcaggagtctctcatcgcttcncaggctccaagtctggccacgacggccctcctaaccatcctcgtcgggcctcctagtttcgaggacgtagtcttactttattacgtcgactagtttacctttaaagttacggtaccgtccctaacttccgttcggtttacggttttccgggacggtacgggtactaacccggtacggttacggttacccgtcccggttaccgggtaccgtaaccggtaccccgtaaacgggtccgttcccggtacccccccggtttcgggtaccctacccgttccctttaccccggg

SEQ ID NO: 130544 - DNA, 562 bp, Homo sapiens
  misc_feature: GYAE6OF02H8GCO.22.36.D03.1.454.CMB.1.raw
  modified_base (217)..(217): a, c, t, g, unknown or other
  misc_feature (217)..(217): n is a, c, g, or t
  modified_base (348)..(348): a, c, t, g, unknown or other
  misc_feature (348)..(348): n is a, c, g, or t
  modified_base (378)..(378): a, c, t, g, unknown or other
  misc_feature (378)..(378): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgccctccgtgtctggatcatctggacagtcgatcagcatttccngcactgggaccaacagtgacattgggtcttttgactctgtctcctggtaccaacaacaccaggaccaaacccccaactcatctatttatggtctcactcgtccggccctcaggcgtctctcactcgcttcncagctcagtctgcacacggcctcctaaccntctctcgggctcgtagttgacgacgtacgtcttaactttattactgtctacgtttaccctttaaagttacgccgtacctacttcgttccggttggttttcggcggtacgccgacgtacgtcgaccgtcgtaccggtcacgtcccgaacggccgtccgtccccgtcggtcctaccgtcttacccg

SEQ ID NO: 130545 - DNA, 733 bp, Homo sapiens
  misc_feature: GYAE6OF02G7TOU.22.36.D03.1.454.CMB.1.raw
  modified_base (233)..(233): a, c, t, g, unknown or other
  misc_feature (233)..(233): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcacgtgggaccaacngtgacagttgggtcttttgactctgtctcctggtaccaacaacaccagaccaacccccatccatctattatggtgtcactcgtccggccctcgacggagtcctctctactccgtcctttccgtcgtacggccttaccgtaacgttccgttcggaccaaacccgtacccgggtaccccttacccctaaaccctacctttcccgttaccggttcggggtacccttaccccgttaaggttttacggaacgggttacccgtacggttaccttaaccgtttaactttaccgtacgttaccgtttaaccgttttaaccgttttaaacgttacggtaccgtacctaaccgtttccgtttaccgggtttacgggttttccgggacggtaccggtaccgtaaccgtacggttccgtacccgttcccggtaccggtaccgacccggtacccggtacggtcccgtacccggttacccccggtaccggtccgttacccttccgttcccccgg

SEQ ID NO: 130546 - DNA, 676 bp, Homo sapiens
  misc_feature: GYAE6OF02JAE0K.22.36.D03.1.454.CMB.1.raw
  modified_base (218)..(218): a, c, t, g, unknown or other
  misc_feature (218)..(218): n is a, c, g, or t
  modified_base (233)..(233): a, c, t, g, unknown or other
  misc_feature (233)..(233): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcacgtgggaccaanagtgactagttgggtctttgactctgtctctggtaaccaacaacaccaggacccaaacccccatcatctattactggtctcactcgtcgcctacgaggacgtctctcacttcgcttctcgacggctcctagtctaggacctaaccgccggtcccttccgtacgaaaccctcttccgtaccggttccgggtaccctaccgtaacggtacgttacgaaacggacgttaacgggacggttacgttacggttaaacttttaccgttaacggtcgttccgttacgggtccttacgttagttttcggaaccggtcggtacccgtacctaacccgtttacgggttcggggttaaccgtccggggtaaccggggaaccggtaacctaacgggtccctacgggtacccgtttaccggtagggtaccaaccggtacccggaacggttccccgg

SEQ ID NO: 130547 - DNA, 616 bp, Homo sapiens
  misc_feature: GYAE6OF02H07VT.22.36.D03.1.454.CMB.1.raw
  modified_base (217)..(217): a, c, t, g, unknown or other
  misc_feature (217)..(217): n is a, c, g, or t
  modified_base (313)..(313): a, c, t, g, unknown or other
  misc_feature (313)..(313): n is a, c, g, or t
  modified_base (333)..(333): a, c, t, g, unknown or other
  misc_feature (333)..(333): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcacgtgggaccaacagtgactagttgggtcttttgacttctgtctctgtaccaacaacacccaggcccaaaccccccactacactctattatgtntcactcgtcgccctcgaggngtctctctatcgtctctctaggcctactaagtctggacacgacggtccctaccctaacactctcgtcggcctcgtagttgacggactacgtcttactttacttacgtcgtactacgtttacctttaaagttcggaccgtacctaccgttcgttacggtttcggttttccgggacggtacggtacccgaaccggtacgttcgtaccccggttccgtccggttaccgaacggtcccgaacggtccctaccgtcccccggttacggtcctaccgttccttaccccg

SEQ ID NO: 130548 - DNA, 641 bp, Homo sapiens
  misc_feature: GYAE6OF02HHV7O.22.36.D03.1.454.CMB.1.raw
  modified_base (300)..(300): a, c, t, g, unknown or other
  misc_feature (300)..(300): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaaacagtgacattggtcttttgactctgtctctggtaacaacaacaccagacaaacccccatcatcatttangtgtcactcgtcggccctcaggactctctcatccgcttctcaaggtctacctaacgtcgtcggaccaaacgtacggtccctaccctaaaccaacttctccgtcgggtcccttccgtagtttacggaacggtacggtaacgttacttaacttaatttactacgtacttacgtttaaccttttaaaagttaccggacgtacctaccttccgtcgtttacgggttttccgggacggttacggaccgtaaccggtaagtacgtacccggttccgtccgttacgaaccggacccgaaaggccgtacccggcccccgttcccggtacgtacccttacgttaccccgg

SEQ ID NO: 130549 - DNA, 610 bp, Homo sapiens
  misc_feature: GYAE6OF02HAGOT.22.36.D03.1.454.CMB.1.raw
  modified_base (217)..(217): a, c, t, g, unknown or other
  misc_feature (217)..(217): n is a, c, g, or t
  modified_base (389)..(389): a, c, t, g, unknown or other
  misc_feature (389)..(389): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacagtgacattgggtctttgactctgtctctggtaccaacaacaccagccaaacccccaactcatcattatgtgtcacttcgtcggccctcgacggtacgtctctctatcgtcttctcaggcctcaacgtctggcaacgaccggtccctacccgtaaccnctccgtacgtcgggccttccgagtttcgacggtacgagttccttaacttattactgtctacgtttacctttaaagttcggtaccgtcctacttcgttaccgtttcgggttttaccgggcggtacggtccaaccggtagttcggacccgttccgtccggtaccaccggtacccgtaaggtcccgttccggcccccttacggtcctaccgtcccgttacccgg

SEQ ID NO: 130550 - DNA, 596 bp, Homo sapiens
  misc_feature: GYAE6OF02GQ4PW.22.36.D03.1.454.CMB.1.raw
  modified_base (218)..(218): a, c, t, g, unknown or other
  misc_feature (218)..(218): n is a, c, g, or t
  modified_base (301)..(301): a, c, t, g, unknown or other
  misc_feature (301)..(301): n is a, c, g, or t
  modified_base (304)..(304): a, c, t, g, unknown or other
  misc_feature (304)..(304): n is a, c, g, or t
  modified_base (321)..(321): a, c, t, g, unknown or other
  misc_feature (321)..(321): n is a, c, g, or t
  modified_base (326)..(326): a, c, t, g, unknown or other
  misc_feature (326)..(326): n is a, c, g, or t
  modified_base (336)..(336): a, c, t, g, unknown or other
  misc_feature (336)..(336): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcacgtggaccaacagtgactagttggtctttgactctgtctctgtaccaacacaccagaccaaaccccccatcatctattangtntcactcgtcgcctgagntctcncatcgcttcncagctacgagtctgacaacgccgtcctaccctaacactcctcgtcggcctaccgtagtttggacgtaccgtagttccttaacttagttacctgtactacgttttacctttaaagtcggtccgtacctacttcgttcggtttcgggtttccggacggtacggaccgtaccggtacggtccgtaacccggtccgttaccggtccaaccggtacccgaacggtcctcccggtcccccgttcggtaccttcctcgttacccccg

SEQ ID NO: 130551 - DNA, 596 bp, Homo sapiens
  misc_feature: GYAE6OF02GNEPG.22.36.D03.1.454.CMB.1.raw
  modified_base (312)..(312): a, c, t, g, unknown or other
  misc_feature (312)..(312): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcccaaaccccccaactcatctatttatggtntcactcgtcgccctcaggagtctctcatcgcttcgtcgggctccaagtctggacaaccgacggcccttaccctaacctactctccgtgggcctccgtagtttgaggacgtagtcttacttacttactgtactacgtttactttaagttacggctcctacttcttcggttcggttttcgggcggtacggctaccgagtccgtaccgtccgtcgggtaccacggtcccgaacggtcctacccggtcccccgttcggtaccctaccgttccgtaccgttaccccccg

SEQ ID NO: 130552 - DNA, 675 bp, Homo sapiens
  misc_feature: GYAE6OF02F8DQY.22.36.D03.1.454.CMB.1.raw
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggccaaaccccccaactcactcactttatggtctcactcgtccggccctcgaggagtctctcatcgcttcctcgacgtcctacctacgtcgtcggaccaaccgaccggtccctaccctaacctactccgtcggtcggtccttccgttagttacggtaacgggtaccgtagtacctttaacgtttacttactcgtacttacgttttaaccgtttaaacgttacggacccgtacccttacgttccggttcggttttccgggtttacgggtacgggtacgggtaccgtaccggtacggttccggtacccggttcccgttaccggtaccgtacccggtacccgtaaggtccccgtcccggtcccccggttaccggtacccgttaccgttccgttccccgg

SEQ ID NO: 130553 - DNA, 624 bp, Homo sapiens
  misc_feature: GYAE6OF02JFHAI.22.36.D03.1.454.CMB.1.raw
  modified_base (389)..(389): a, c, t, g, unknown or other
  misc_feature (389)..(389): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacagttgggtcttttgactctgtctcctggtaccaacaacacccaggccaaaccccccaactcatcatttatggtgtcactcgtcggccctcaggagtctctcactcgcttctcacggctccaagtctggcaaccgaccggccctccctaaccnctcctcgtcgggctccctagtttcgaggacgagttcttacttattactcgctacgtttacctttaaagttacggccgtacctaccttccgttccgggtttcgggtttttccgggaccgggtaacggtccgtaaccggtacggtccggtacccggttcccgttccggtaccgaacggtaccccgaacgggtcccttaccggccccccgttcggtcctacccgttcctttaccccgg

SEQ ID NO: 130554 - DNA, 528 bp, Homo sapiens
  misc_feature: GYAE6OF02G6JV2.22.36.D03.1.454.CMB.1.raw
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggaccaaaccccccaactcatcatttatggtgtcactcgtcgcctcaggacgtctctcatcgcttctcaggctccaagtctggcaacacggcctccctaacactctctgggctccgtagtttgaggacgagtcttacttattactgctagttcctttaaatcggtcgtccacttcgtcgttggtttcggcggtagcaccgagtcgaccgtcctcggtcacgcccgagcctcgcccctcggtcactctccg

SEQ ID NO: 130555 - DNA, 669 bp, Homo sapiens
  misc_feature: GYAE6OF02GMK72.22.36.D03.1.454.CMB.1.raw
  modified_base (351)..(351): a, c, t, g, unknown or other
  misc_feature (351)..(351): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacagttggtcttttgactctgtctcctggtaccaacaacaccacggaccaaaccccccactcatcatttatggtgtcacgtccgtcggccctcgaggacgtctctcatcgtcttcncacggctaccaagtctggaccaacgaccggtccctaccctaaccactcctcgtcgggccttcccgtaggtttcggaacggtaccgtacgttccttaactttactttactcgtaccttaacgttttacctttaaagttacggtcccgtacctacttccgtttacgggtttcgggtttttccgggacggtacggtccgtaaccgggtagttccggtacccggttccggttaccgggtacccgtaaccggaccccggtaagggtcccttcccggtacccccccgtttacgggtacccttacccgttccgtttaacccccgg

SEQ ID NO: 130556 - DNA, 818 bp, Homo sapiens
  misc_feature: GYAE6OF02JFPGZ.22.36.D03.1.454.CMB.1.raw
  modified_base (169)..(169): a, c, t, g, unknown or other
  misc_feature (169)..(169): n is a, c, g, or t
  modified_base (215)..(215): a, c, t, g, unknown or other
  misc_feature (215)..(215): n is a, c, g, or t
  modified_base (305)..(305): a, c, t, g, unknown or other
  misc_feature (305)..(305): n is a, c, g, or t
tcagacatacgcgtcacgaccggtgctcgatttagctgcgtcacgatctctcttgggggggtctcaggaggcagcgctctcgggacgtctccgaccatggcctgggctctgctattcctcacttcctcactcagggcacagggtcctgggcccagtctgccctgacccngcctgcctcgtgtctggatcatctggacagtcgatcagcatttccngcacgtcgggaacctaacgcgttgacctagttcgggtctttgactctgtctctgtaccaacacaccagccaaaccccatcactcatttancgtgtctactcgtcgcctcaggactctctcgactcgtcttctaccgaggtcctacaacgttctacgggtaccaaaccgtaccggtcccttacccgtaaaccctaacgttccgtaccgttcggggtacccttaccgtaacgggtttttaccggaaagggttaacccggtaaacgggttttcctttaaacccgtttttaaccgtttaaccggttaccggtaccgtttaaaaccgggttttttaacccttttttaaaaaaccgggtttccggggtaacccggtttacccccgttaaacccgttttccccggttttacccggggtttttccgggggtttttttaacccggggacggggtaaacccgggtttaccgaaacccgggttaacggtttaccggacccccgggtttaacccgggttcccggtttaaccgaacccggtaacccggttaaaccggtcccggttcccggtaccccccgtttcggggttaccccttacgtttcccggttaccccgg

SEQ ID NO: 130557 - DNA, 700 bp, Homo sapiens
  misc_feature: GYAE6OF02JLKDL.22.36.D03.1.454.CMB.1.raw
  modified_base (140)..(140): a, c, t, g, unknown or other
  misc_feature (140)..(140): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacngggtcctgggcccaggtctgccctgcccagcctgcctccgtgtctggatcatctggacagtcgatcagctatttcccgtgcctacgtcgggaccaacgagtcgaacgtagttcgggttcttttcggaccttctcgttcctcgtacggtaccaacaaccgaacccacggaaccaaacccccccaactccactacctatttaagtcggttagtccaacgttccgtccggtacccgtacgtaggacgtcttctacctagtcgtactcctaccgtaggccttaccgaacgttccgtacggtacaacgtacccgggtcctaccctaaccacgttctaccggtcgggtccctacgtaggtttacgaccgggtactaacgtcttaacgtttacttaaccgtgaccttaacggtttacctttaaaacgtcgggtaccctctaacgttccgtacggtttcgggtttacgccggtaacgttacaccggacggttcgtaacccgttccgtacggtctaccggtcccaagggtcctacccggcccgttacggccgtactcccgtttaacccg

SEQ ID NO: 130558 - DNA, 683 bp, Homo sapiens
  misc_feature: GYAE6OF02FYJPZ.22.36.D03.1.454.CMB.1.raw
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacagttggtctttgactctgtctcctgtaccaacacaccagccaacccccaactcatctattatgtgtcactcgtcgcctcaggacgtctctcactcgtcttctcaggctccaagtctggccaacgaccggccctaccctaaacccactccttcgtcgggccttaccgtaggttttcggaacggtacgtaaggttccttaacctttacgtttacctcgtaccttaacggttttacccttttaaaacgtttacgggtaccgtaccctaacccgtttcgttcggtttacgggtttttccgggaccgggtaacgggtacccgtaacccggtaaggtccggtaacccggtttcccggttaccgggtttacccgaaccggtacccccggaagggtcccgttaccgggtcccccccgttacgggtacccttacccgttacccggtttcccccgg

SEQ ID NO: 130559 - DNA, 660 bp, Homo sapiens
  misc_feature: GYAE6OF02JZ6BW.22.36.D03.1.454.CMB.1.raw
  modified_base (237)..(237): a, c, t, g, unknown or other
  misc_feature (237)..(237): n is a, c, g, or t
tcagacatacgcgtcacgaccggtgctcgatttagctgcgtcacgatctctcttgggggggtcgtcaggaggcagcgctctcgggacgtctccaccatggcctgggctctgctattcctcaccttcctcactcagggcacagggtcctgggcccagtctgccctgacccagcctgcctcgtgtctggatcatctggacagtcgatcagctatttcccggcacgtacggaaccaaacnggtcaactgtttcggttctttagtactcgtgtcttccgtacgtaaccaaacctaaccaacccgaaccggaaccccaaaaccccccaactacctaacctactaactttacgtacggtacgtactaccgttcgtacccggtccctaccgacggtacgtcctacctactacgttccgtcttctcgacgtacctaccgtacgtccgtacgaccaaccgaccgtaccctaccctaactctcctacgtcggtcctacgtacgtcgacggtactgtactacttactctcgtacttacttacttaagtcgtccaccttcgtcgttcggttaccggttcggacggtaggtccgacgtacgtccgtaccggtccgtacgtaccgaccgtaccgacgtacctcccggtacccgtccggtacctccgtccgttcc

SEQ ID NO: 130560 - DNA, 650 bp, Homo sapiens
  misc_feature: GYAE6OF02ISMWV.22.36.D03.1.454.CMB.1.raw
  modified_base (236)..(236): a, c, t, g, unknown or other
  misc_feature (236)..(236): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcacgtcgggaccaaacngtgacattgggttcttttgactctgtctcctggtaccaacaacaccacggccaaaaccccccactcactctatttatggtgtcactcgtccggtcctcgaggacgtctctcatcgtcttctcacggctcctaacgtctcggacaaccgaccgtccctaccctaaccactacctccgtcgggcctccgtagttacggacggtacgtacgtcttaacttacttactcgtactacgtttacctttaagttacgtccgtaccctacgttccgttcggttacgggtttttccgggacggtacggtaccgtaaccggtacggttccggtacccggtcccggttaccggtacctaacccggacccgtaacggtcccgtacccggtccccccgttacggtcccctaccgttcccgttacccg

SEQ ID NO: 130561 - DNA, 699 bp, Homo sapiens
  misc_feature: GYAE6OF02H1FZB.22.36.D03.1.454.CMB.1.raw
  modified_base (130)..(130): a, c, t, g, unknown or other
  misc_feature (130)..(130): n is a, c, g, or t
  modified_base (219)..(219): a, c, t, g, unknown or other
  misc_feature (219)..(219): n is a, c, g, or t
tcagacatacgcgtcacgaccggtgctcgatttagctgcgtcacgatctctcttgggggggggtctcaggaggcagcgctctcgggacgtctccaccatggcctgggctctgctattcctcaccttcctnactcagggcacagggtcctgggcccagtctgccctgacccagcctgcctccgtgtctggatcatctggacagtcgatcagctatttccngcactggggaaccaacagtcgactagtttgggtcttttgactctgtctccgtgtaaccaacaacaccacggacccaaaccccccatcatctaatttagtcggtacgtctacgttcgtccggccctacgaggtacgtctctacacgttcgtcttcctacgtacggtcctactaacgttcgtcggaccaacgtaccggtacccctaccctaacctactcttcgtcgggtcctaccgtagtttacgacggtacgtagttaccttaactttatttacgtacgttacttacgtttaaccttttaaagttaccggaccgtaccctaccgttccgttaccggtttcgggttttaccgggacggtacggtaccgtaaccggtaggttacccggtacccggtcccggttccggttaccgacccggtaacccggaacgggcccgttcccggtcccccgttaccgggtaccttacccgtccgtttaccccg

SEQ ID NO: 130562 - DNA, 605 bp, Homo sapiens
  misc_feature: GYAE6OF02I89RT.22.36.D03.1.454.CMB.1.raw
  modified_base (50)..(50): a, c, t, g, unknown or other
  misc_feature (50)..(50): n is a, c, g, or t
  modified_base (246)..(246): a, c, t, g, unknown or other
  misc_feature (246)..(246): n is a, c, g, or t
  modified_base (537)..(537): a, c, t, g, unknown or other
  misc_feature (537)..(537): n is a, c, g, or t
tcagacatacgcgtcacgaccggtgctcgatttagctgcgtcacgatctnctcgttggggggtctcaggaggcagcgctctcgggacgtctccaccatgcctggctctgctattcctcaccttcctcactcaggcacgaggtccgtcggcccgacgtcgtcgccctcgaccgacgccgtcgccgtccgtcgtcgtggatcatcgtgacagtacgactacacgactacttcgtcgactacgtacggnaaccaacgtaggtacgaactagttggtcctttagtactctgtctcctggtaccaacaacaccagaccaaaccccaactcactacattatgtgtcactcgtcgcctcaggacgtctctcactcgtcttctcacgtctacaacgtcgtacgacaacgaccgacctaccctaacctactactacgtacggtcctaccgtacgttacgtacggacgtacgtacttacttacttactacgtacgtacgttactttaacttaggtacgtacctacgtactacgtacggtttacggtncggtacggtaccgtaaccgtaacggtacgtaccggtacccgtaccggtaccgtacgtacccgtaacgg

SEQ ID NO: 130563 - DNA, 590 bp, Homo sapiens
  misc_feature: GYAE6OF02FTIWD.22.36.D03.1.454.CMB.1.raw
  modified_base (303)..(303): a, c, t, g, unknown or other
  misc_feature (303)..(303): n is a, c, g, or t
  modified_base (345)..(345): a, c, t, g, unknown or other
  misc_feature (345)..(345): n is a, c, g, or t
  modified_base (358)..(358): a, c, t, g, unknown or other
  misc_feature (358)..(358): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattggggtcttttgactctgtctcctggtaccaacacaccaggccaaaccccccatcatcatttanggtgtcactcgtcggccctcgaggacgtctctcatcgcttcncaggctcaagtcngcaacacgcctccctaccactctcgtggcctcctagtttgacggtcgagttcttacttattactcgtactactttacctttaaagttacggcctacctacttcgttccggttgggttttccggcggtacgaccgtaccggtacgtcggtacccgttcccgttaccggtaccgacgtaccccgaagggtcctcccggtcccccgtaccggttcctacccgttccgttccccgg

SEQ ID NO: 130564 - DNA, 647 bp, Homo sapiens
  misc_feature: GYAE6OF02HZBS6.22.36.D03.1.454.CMB.1.raw
  modified_base (275)..(275): a, c, t, g, unknown or other
  misc_feature (275)..(275): n is a, c, g, or t
  modified_base (299)..(299): a, c, t, g, unknown or other
  misc_feature (299)..(299): n is a, c, g, or t
  modified_base (317)..(317): a, c, t, g, unknown or other
  misc_feature (317)..(317): n is a, c, g, or t
  modified_base (321)..(321): a, c, t, g, unknown or other
  misc_feature (321)..(321): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcacgtgggaccaacagtgacattgggtcttttgactctgtctctggtaccaacaacnccagaccaacccccatcatcattntgtgtcactcgtcgcctnaggntctctcatcgtcttctcaggtctacgagtctggaccaacgaccggccctaccctaacctactcgtcgtcgggccttaccgtaggtttcggacggtacgtacgttaccttaactttattacgttgtacttaacgttttacctttaaagttacggccgtaccctaccgttcgttccggtttcgggttttccgggacggtacggtaccgtaaccggtaaggttccggtaacccggttcccgttaccgggtaccgtaaccgtaccccgtaagggtcccgttcccggtcccccccgttacgggttaccctacccgttccgtttacccccgg

SEQ ID NO: 130565 - DNA, 551 bp, Homo sapiens
  misc_feature: GYAE6OF02H16WX.22.36.D03.1.454.CMB.1.raw
  modified_base (236)..(236): a, c, t, g, unknown or other
  misc_feature (236)..(236): n is a, c, g, or t
  modified_base (306)..(306): a, c, t, g, unknown or other
  misc_feature (306)..(306): n is a, c, g, or t
  modified_base (338)..(338): a, c, t, g, unknown or other
  misc_feature (338)..(338): n is a, c, g, or t
  modified_base (346)..(346): a, c, t, g, unknown or other
  misc_feature (346)..(346): n is a, c, g, or t
  modified_base (369)..(369): a, c, t, g, unknown or other
  misc_feature (369)..(369): n is a, c, g, or t
  modified_base (441)..(441): a, c, t, g, unknown or other
  misc_feature (441)..(441): n is a, c, g, or t
  modified_base (522)..(522): a, c, t, g, unknown or other
  misc_feature (522)..(522): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcacgtcgggaaccaacngtgactagtttgggttcttttgacttctgtctcctggtaccaacaaccacccaggacccaaacccccacncatctatttatgtgtcactcgtcggcctgagngtctctcntcgcttctcaggtctccgaatcncggacaccgacgtccctaccctaacactctcgtcggcctcgtagttcgaggacgtagtcttacttattactnactcgttactttaagcgctccacttcgtcgttgtttcggcgtagcgacgagtcgtccgtcgtccgtcacgcccgaggtccnccggacccctcggacctctccgttcccgg

SEQ ID NO: 130566 - DNA, 550 bp, Homo sapiens
  misc_feature: GYAE6OF02GTGVM.22.36.D03.1.454.CMB.1.raw
  modified_base (350)..(350): a, c, t, g, unknown or other
  misc_feature (350)..(350): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacagttgggtcttttgactctgtctcctggtaccaacaacacccaggccaaaccccccaactccatcatttatggtgtcactcgtccggccctcaggatctctcatcgcttctcnggctccaagtctggcaacgacgcctaccctaaccatctctgggcctcagtttcgaggacgagttctaactttattactgctacgtttacctttaaagttacggccgtacctactcgtcgttggtttcggcggtagcgaccgtagtcgaccgtcctcggtcacgccgtaaggcctccggccccttcggtctacctctcccg

SEQ ID NO: 130567 - DNA, 513 bp, Homo sapiens
  misc_feature: GYAE6OF02F2KJT.22.36.D03.1.454.CMB.1.raw
  modified_base (383)..(383): a, c, t, g, unknown or other
  misc_feature (383)..(383): n is a, c, g, or t
  modified_base (463)..(463): a, c, t, g, unknown or other
  misc_feature (463)..(463): n is a, c, g, or t
tcagacatacgcgtcacgaccggtgctcgatttagctgcgtcacgatctctcttgggggggtctcaggaggcagcgctctcaggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaaacagtgacattgggtcttttgactctgtctcctggtaccaacaacacccaggcaaaaccccccaactcatcatttatgtgtcactcgtcgccctcaggagtctctcatcgcttctcaggctccaagtctggcaacacggcctcctaaaccatcnctgggctccagtttcgaggacgagtctacttattacctgctagttcctttaaataggcgcctactctcgttgttttcggngaggcacgatgaaccgtctcggtcagccaaggctggcccctcggtccatc

SEQ ID NO: 130568 - DNA, 806 bp, Homo sapiens
  misc_feature: GYAE6OF02ITD4Y.22.36.D03.1.454.CMB.1.raw
  modified_base (141)..(141): a, c, t, g, unknown or other
  misc_feature (141)..(141): n is a, c, g, or t
  modified_base (218)..(218): a, c, t, g, unknown or other
  misc_feature (218)..(218): n is a, c, g, or t
  modified_base (236)..(236): a, c, t, g, unknown or other
  misc_feature (236)..(236): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacngggtcctgggcccagtctgccctgacccagcctgcctccgtgtctggatcatctggacagtcgatcagctatttccngcacgtcgggaccaaacngtgaactagtttcgggttcttttgacttctcgtctcctggtaacccaacaaaccacccaggacccaaaacccccccaactacactctaatttatcggtagtccactccgtccggcccctcgaggtacgtccttctctacttccgtcctttcctccgacggtccttaccctaaggttcgtcgggacccaaaccgtacccgggtcccctaaccccgtaaaccctacgttccgtttccggtacgggtaccccttacccgttaacgggttttacgggaacggggtaaccggtaaacgtttaccgttaaacgtttttaacgtttaccgttacgttaccgttaaacgtttttaacccgtttttaaaacggtaccggttaccccgggtacccttaaccgttccggttttaaccgggtttcggggttttttaccgggaccgggtaacggtacccgtaaacccgggtaagttcccggtacccggtttccgttcccgggtacctaaccgggtacccgtaaccggggtccctcccgggtacccccgttccgggtaccttacccgttaccgtttcccccggg

SEQ ID NO: 130569 - DNA, 639 bp, Homo sapiens
  misc_feature: GYAE6OF02G54JY.22.36.D03.1.454.CMB.1.raw
  modified_base (232)..(232): a, c, t, g, unknown or other
  misc_feature (232)..(232): n is a, c, g, or t
  modified_base (253)..(253): a, c, t, g, unknown or other
  misc_feature (253)..(253): n is a, c, g, or t
  modified_base (269)..(269): a, c, t, g, unknown or other
  misc_feature (269)..(269): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcgaggcacagggtcctgggcccagtctgccctgacccagcctgcctccgtgtctggatcatctggacagtcgatcagctattcctgcacgtgggaccaacngtgacagttggtctttgactntgtctctggtaccaanaacacccagaccaaaccccccactcactcattactgtgtcactcgtcggccctgacgagtctctcgactccgtcttctccgaggcctccaaagttctcggacctaaaccgaccggtccctacccctaaccacttcctacgtcgggtcctacctacggtttacgacggtaacgtcggtacttaactttacgttactagcttacggttaccttttaaagttcggtaacctccgtaacgttcccgttagtttacgggttttccgggacggttacgggaccgtaacccgtagtaccggtacccggtcccgttccgggtcctaacgcccgtaacgggcctacggtcccccgttacggtccctacgtccttcccgg

SEQ ID NO: 130570 - DNA, 578 bp, Homo sapiens
  misc_feature: GYAE6OF02FHLXS.22.36.D03.1.454.CMB.1.raw
  modified_base (259)..(259): a, c, t, g, unknown or other
  misc_feature (259)..(259): n is a, c, g, or t
  modified_base (304)..(304): a, c, t, g, unknown or other
  misc_feature (304)..(304): n is a, c, g, or t
  modified_base (308)..(308): a, c, t, g, unknown or other
  misc_feature (308)..(308): n is a, c, g, or t
  modified_base (543)..(543): a, c, t, g, unknown or other
  misc_feature (543)..(543): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgccactgggaccaacagtgacattgggtctttgactctgtcncctggtaccaacaacacccagccaaaccccccaatcatcatttanggtntcactcgtcggccctcgaggtacgtcttctcatcgtcttctcacggtcctaccaaggttcctgggaccaaccgtaccggcccctaccccgtaacctactcctcgtcgggccttccagtttcggacggtacgagttccttaacttattacgtgtactacgtttaccttaaagttcggccacctacttcgttacgttcggttcggcggacgctaccgtagtcgtaccgtcgtcgacncgacccgaggctccgaccccgtgcctctcgtcccg

SEQ ID NO: 130571 - DNA, 675 bp, Homo sapiens
  misc_feature: GYAE6OF02GCX6J.22.36.D03.1.454.CMB.1.raw
  modified_base (289)..(289): a, c, t, g, unknown or other
  misc_feature (289)..(289): n is a, c, g, or t
  modified_base (338)..(338): a, c, t, g, unknown or other
  misc_feature (338)..(338): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcacgtgggaccaacagtgacagttgggttctttgactctgtctctgtaccaacacaccagccaacccccancatctattatgtgtcactcgtcgcctcgagagtctctcactcgtcttcncacggcctccaagttccgtacggaccaaccgaccggtccctacccgtaacctacttcctcgttcgggtcctaccgtaggtttacggacggtacgtacgttaccttaactttacgtttacgtgtaccttaacgttttaccttttaaagttaccgggaccgtaccctaccgtttccgttccgggttttcgggttttccggggtaccggtacggtaccgtaccgggtaacggttccggtaccccgttccggttacccggttccgaacccggtaccccgtaagggttcccgtacccggtccccccggttacgggttaccctacccgttcccgttacccccg

SEQ ID NO: 130572 - DNA, 559 bp, Homo sapiens
  misc_feature: GYAE6OF02I6OEN.22.36.D03.1.454.CMB.1.raw
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggccaaaccccccaactcatcatttatggtgtcactcgtcggccctcaggagtctctcatcgcttctcaggctcaagtctggcaacacggcctcctaaccatctctggctcagttgagacgagtcttacttattactcgctacgtttcctttaaattggtccgtacctacttcgtcgttcggttttcgggcggtaggaccgaccgaggtcgtacccgtccgtcggtccgacggacccctaagggcctcggtccccccgtcggtacctaccgtcttacccg

SEQ ID NO: 130573 - DNA, 554 bp, Homo sapiens
  misc_feature: GYAE6OF02GGY4I.22.36.D03.1.454.CMB.1.raw
  modified_base (310)..(310): a, c, t, g, unknown or other
  misc_feature (310)..(310): n is a, c, g, or t
  modified_base (348)..(348): a, c, t, g, unknown or other
  misc_feature (348)..(348): n is a, c, g, or t
  modified_base (523)..(523): a, c, t, g, unknown or other
  misc_feature (523)..(523): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtctttgactctgtctcctggtaccaacaacacccacggaccaaaccccccactcatcatttatggtntcactcgtccgcctcaggagtctctcatcgtcttctcngctccaagtctgaccaacgaccgtcctaccctaaccactctcgtcggtctccgtagtttgacgacgagtcttacttattactgctagtttaccttaaattcggacgtccactcgtcgtttcggtttcggcggtagcgaccgtagtcgaccgtcgtcgtccacgtccgaaggtccncggtcccccgtcggtctaccgtcgttcccgg

SEQ ID NO: 130574 - DNA, 742 bp, Homo sapiens
  misc_feature: GYAE6OF02FQFL4.22.36.D03.1.454.CMB.1.raw
tcagacatacgcgtcacgaccggtgctcgatttagctgcgtcacgatctctcttggggggggtctcaggaggcagcgccctcgggacgtctccaccatggcctgggctctgctattcctcaccttcctcactcagggcacagggtcctgggcccagtctgccctgacccagcctgcctccgtgtctggatcatctggacagtcgatcagctatttcctgccacgtcgggaaccaacgagtgactagttgggttcttttgactctgtctccgtacgtaaccaacaaccacccgacgacccaaaccccccatacactctatttagtggtctactactcggtccggccctacgacggtacgtctctctactccgtcttcctcgacggtcctacgaacgttcgtcggaccaaccgcccggtaccccttaacccgtaacctacttccgtccgtcgggtcccttaccgttaggttacggaacggtacgtacgttacctttaactttacgttacgttcgtacttaacgttttaccttttaaaggttcggtacctacctacgttccgtttacgggtttacgggttttccgggacgggtacggtaccgtaaccggtacggttaccggtacccggttccggttaccgggtacctacccgggtaaccccgtaacgggttaccccgttccccgggttaccccccggttaccgggtaccctacccgtttacccgttccccgtttaaccccccccg

SEQ ID NO: 130575 - DNA, 695 bp, Homo sapiens
  misc_feature: GYAE6OF02G2Z6R.22.36.D03.1.454.CMB.1.raw
  modified_base (239)..(239): a, c, t, g, unknown or other
  misc_feature (239)..(239): n is a, c, g, or t
tcagacatacgcgtcacgaccggtgctcgatttagctgcgtcacgagtctcgtcttggggggggtctctaggacggcaggcgctctaccgggacgtttccaccatggcctgggctctgctattcctcaccttcctcactcagggcacaggtcctgggcccagtctgccctgaccagcctgcctccgtgtctggatcatcctggacagtcgagtcagcatttcctgcactgggaccaacncgtgacattggtctttagactctgtctctgtaccaacacaccagccaaacccccatcatctattatggtgtcactcgtcgccctgagtagtctcgtctactcgtcttcgctagtcctcctaagtctggacaacgaccggtccctacctacactccgtacgtcggtctcgtagttcgacgtacgtacgttccttaacgttaacgtcgtacgtacgttacggtttaccctttaaaagttcggtacccgtacccttaacggttacccgttacgggttaccggtttttaccggggacgggtaaacggtccccgtaaacgggttaacggtccggtaacccggttacccggttccgggtaacccgtaacccgggtaccccgttaaaccgggtcccttaccccgggttaccccccttcggggttaacccctaccggtttacccgttccccgtttaaccccccg

SEQ ID NO: 130576 - DNA, 622 bp, Homo sapiens
  misc_feature: GYAE6OF02F611O.22.36.D03.1.454.CMB.1.raw
  modified_base (231)..(231): a, c, t, g, unknown or other
  misc_feature (231)..(231): n is a, c, g, or t
  modified_base (303)..(303): a, c, t, g, unknown or other
  misc_feature (303)..(303): n is a, c, g, or t
  modified_base (362)..(362): a, c, t, g, unknown or other
  misc_feature (362)..(362): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacngtgacattgggtcttttgactctgtctcctggtaccaacacacccaggccaaaccccccaatcatcatttanggtgtcactcgtcgccctcaggatctctcatcgcttctcaggctccaagtctggcaacnccggcctccctaaccatcctctcgggtctccgagtttcggaggtacggagttccttaacgtttattaccgtgtcgtatttacctttaaagttacggtccgtcctaaccgttccttacggtttgggttttccggtacggtacggtccgtaaccgggagtacggaacccgttcccggttccggttaccgaacggtaccccgtaacggggtccttacccggtccccccgttccgggtacccgtacccgttcccgttaccccgg

SEQ ID NO: 130577 - DNA, 746 bp, Homo sapiens
  misc_feature: GYAE6OF02G7QY8.22.36.D03.1.454.CMB.1.raw
  modified_base (170)..(170): a, c, t, g, unknown or other
  misc_feature (170)..(170): n is a, c, g, or t
  modified_base (202)..(202): a, c, t, g, unknown or other
  misc_feature (202)..(202): n is a, c, g, or t
  modified_base (223)..(223): a, c, t, g, unknown or other
  misc_feature (223)..(223): n is a, c, g, or t
  modified_base (243)..(243): a, c, t, g, unknown or other
  misc_feature (243)..(243): n is a, c, g, or t
tcagacatacgcgtcacgaccggtgctcgatttagctgcgtcacgatctctcttgggggggtctcaggaggcagcgctctcgggacgtctccgaccatggcctgggctctgctattcctcaccttcctcactcagggcacagggtcctgggcccagtctgccctgacccngcctgcctccggtgtctggatcatcgtggacngtcgatcgagctatttccgtnacacgtacgggaaccaacgngtcacgtagttcgggttcttttggaccttcgtcgtctccgtaggtacccaacaaccaccgtacggacccaaacccccctactcgactctattacgtgggtctacgactcggtccgccctacgaggtcgtctcgtcacgtcgtcgttctacgacgtcctacgaagttctacggaccacgtacccggtccctacccgtaactcgtaccgttccgtggtcccttccggttaggttacggtacgggtaccggtacggttacctttaacttacgtttaacttcggtaccttaaccgttttaccgtttaaacgttacgggtacccttaccgtaccgtttaccggttccggtttcgggtttcccggggaccggtacgggtccgtaaccggtacggtacccgggttacccggttcccggtaccgggtaccgtaacccgtaccggtaacccggtcccgttcccggacccccggtttaccggtacccgttacccgttaccgtttccccccggg

SEQ ID NO: 130578 - DNA, 635 bp, Homo sapiens
  misc_feature: GYAE6OF02H2AA0.22.36.D03.1.454.CMB.1.raw
  modified_base (218)..(218): a, c, t, g, unknown or other
  misc_feature (218)..(218): n is a, c, g, or t
  modified_base (234)..(234): a, c, t, g, unknown or other
  misc_feature (234)..(234): n is a, c, g, or t
  modified_base (301)..(301): a, c, t, g, unknown or other
  misc_feature (301)..(301): n is a, c, g, or t
  modified_base (323)..(323): a, c, t, g, unknown or other
  misc_feature (323)..(323): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcacgtcgggaccaangtgacagttggtcttttgactctgtctctgtacaacacaccagaccaacccccatcatcattatgtncactcgtcgcctgagtctctcncatcgtcttctcacgctactagtcgtgactaacgaccgtccctacctaaccatccgtcgtcggcctacgtagttgacggtacgtacgttcttaactttacttacgtcgtcgttaaccgtttacctttaaaggttccggccgtaccctaccgttcgttccggtttacgggttttccgggacggttacggaccgtaaccggtacggttaccgtacccggttcccgttccggtaccgaaccggtaccccgtaacggttcccgttacccggtaccccccgtttccggtaccctacccgtttccggtttacccccgg

SEQ ID NO: 130579 - DNA, 636 bp, Homo sapiens
  misc_feature: GYAE6OF02JOQPT.22.36.D03.1.454.CMB.1.raw
  modified_base (170)..(170): a, c, t, g, unknown or other
  misc_feature (170)..(170): n is a, c, g, or t
  modified_base (218)..(218): a, c, t, g, unknown or other
  misc_feature (218)..(218): n is a, c, g, or t
  modified_base (234)..(234): a, c, t, g, unknown or other
  misc_feature (234)..(234): n is a, c, g, or t
  modified_base (309)..(309): a, c, t, g, unknown or other
  misc_feature (309)..(309): n is a, c, g, or t
  modified_base (349)..(349): a, c, t, g, unknown or other
  misc_feature (349)..(349): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccngcctgcctccgtgtctggatcatctggacagtcgatcagctatttccngcacgtcgggaccaanagtgactagttggtcttttgactctgtctctgtacaacacaccagaccaaacccccatcatcattactgtgtacnctcgtccggccctcaggtcgtctctcatccgtcttacctnacggcctacctaagtcctggaccaaacgccggtccctaccctaaccactcctcgtcgggtccttaccgtagtttacgagaccgtattccgttaactttacttacgtcgtactacggtttacctttaaagttacggtcctacctacttccgttacggtttcgggttttccgggacggtcggaccgtaaccggtagttccggtaacccgttcccgttacggtacccgacggtaccccgtaagggttccctaccggtcccccgttacggtcccttacgtccgttccccgg

SEQ ID NO: 130580 - DNA, 621 bp, Homo sapiens
  misc_feature: GYAE6OF02GPGTA.22.36.D03.1.454.CMB.1.raw
  modified_base (375)..(375): a, c, t, g, unknown or other
  misc_feature (375)..(375): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcacgtgggaccaacagtgactattggtctttgactctgtctcctggtaccaacaacaccaggaccaacccccatcatcattatgtgtcactcgtcgcctcaggatctctcatcgcttctcaggctcaagtcgtgcaacgccgtccctaccctaaccnctctcgtcggtctcctagtttcggacgtacgtacgttcttaactttacttactcgtacttaacgtttacctttaaagttccggaccgtccctacttccgttcggtttcgggttttccgggacggtacggtacccgtaaccggtacggtacgtacccggttccgttaccgggttaccgacccggtaccccggtaggcccgttcccggtcccccgttccgggtaccttacccgttcccttacccccgg

SEQ ID NO: 130581 - DNA, 626 bp, Homo sapiens
  misc_feature: GYAE6OF02GMWOP.22.36.D03.1.454.CMB.1.raw
  modified_base (220)..(220): a, c, t, g, unknown or other
  misc_feature (220)..(220): n is a, c, g, or t
  modified_base (238)..(238): a, c, t, g, unknown or other
  misc_feature (238)..(238): n is a, c, g, or t
  modified_base (370)..(370): a, c, t, g, unknown or other
  misc_feature (370)..(370): n is a, c, g, or t
  modified_base (404)..(404): a, c, t, g, unknown or other
  misc_feature (404)..(404): n is a, c, g, or t
  modified_base (447)..(447): a, c, t, g, unknown or other
  misc_feature (447)..(447): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtccctgggcccagtctgccctgacccagcctgcctccgtgtctggatcatctggacagtcgatcagctattttccngcacgtcgggaaccaacngtagactagttgggttcttttgacttctgtcctcctggtaccaaacaaccacccgacgacccaaaccccccaactcactctatttatcggtgtcactcgtcggtccctgaggtactctctcactcgtcttcncaggtctacagtctgacacgcgtcctacccaacntctcgtggtcctctgtttagagacgtagtacttactattactnactagtttacctttaagtcgacgtcctacgttcgttcggtttacgtttcgggaccggtacgtacccgaaccgtacggttaccgtacccggttccggttcccggtacgtacccggtaccccggtaaggtcccgttcccggtccccccgttacgggtcccttaccggtccctttaccccgg

SEQ ID NO: 130582 - DNA, 601 bp, Homo sapiens
  misc_feature: GYAE6OF02GLMSR.22.36.D03.1.454.CMB.1.raw
  modified_base (304)..(304): a, c, t, g, unknown or other
  misc_feature (304)..(304): n is a, c, g, or t
  modified_base (308)..(308): a, c, t, g, unknown or other
  misc_feature (308)..(308): n is a, c, g, or t
  modified_base (324)..(324): a, c, t, g, unknown or other
  misc_feature (324)..(324): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcacgtgggaccaacagtgacattgggtcttttgactctgtctcctggtaccaacacacccaggccaaaccccccatcatcatttanggtntcactcgtcggccctnaggagtctctcatcgcttctcagctcaatctggcaacgaccggcctaccctaaccatcctcgtcgggctccgtagtttcgacggtaccgagtcttaacttagttactgactagtttacctttaaagttcggaccgtacctacttccgttcgtttcgggttttccggcggtacggccgtaaccggtacgtcggtaacccggttccgtaccggtccgacgtaccccgtaaggtcccgttaccggccccccgttgggtaccctaccgttccgttaccccg

SEQ ID NO: 130583 - DNA, 627 bp, Homo sapiens
  misc_feature: GYAE6OF02HJUEY.22.36.D03.1.454.CMB.1.raw
  modified_base (316)..(316): a, c, t, g, unknown or other
  misc_feature (316)..(316): n is a, c, g, or t
  modified_base (323)..(323): a, c, t, g, unknown or other
  misc_feature (323)..(323): n is a, c, g, or t
  modified_base (410)..(410): a, c, t, g, unknown or other
  misc_feature (410)..(410): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctactttcctgcacgtgggaaccaacagtgactagttgggttctttgactctgtctcgtcgtaaccaacaaccaccgacgacccaaacccccatcactctatttagnggtctcncgtcgcgtcctcgagcgtctctcacgtcgtcttctcgacgtcctacgtacgtcgtacggaccaacgcccggtccctacctaacccgntccgtacggtcggccttcgtaggtttacggacgggtaacgtcgttacttacgttacttacgtgtactactttacctttaagtcggtacctacctacttcgttacgtttcgggttcggacggtacgtaccgtacggacgtaccggtacccgttcggtccgtacgaaccgtccgaacgtcccgtccggtccccgttcggtacctaccgtccgttcccgg

SEQ ID NO: 130584 - DNA, 636 bp, Homo sapiens
  misc_feature: GYAE6OF02JP0PK.22.36.D03.1.454.CMB.1.raw
  modified_base (219)..(219): a, c, t, g, unknown or other
  misc_feature (219)..(219): n is a, c, g, or t
  modified_base (236)..(236): a, c, t, g, unknown or other
  misc_feature (236)..(236): n is a, c, g, or t
  modified_base (262)..(262): a, c, t, g, unknown or other
  misc_feature (262)..(262): n is a, c, g, or t
  modified_base (278)..(278): a, c, t, g, unknown or other
  misc_feature (278)..(278): n is a, c, g, or t
  modified_base (339)..(339): a, c, t, g, unknown or other
  misc_feature (339)..(339): n is a, c, g, or t
tcagacatacgcgtcacgaccggtgctcgatttagctgcgtcacgatctctcttgggggggtcgtcaggaggcagcgctctcgggacgtctccaccatggcctgggctctgctattcctcaccttcctcactcagggcacagggtcctgggcccagtctgccctgacccagcctgccctccgtgtctggatcatctggacagtcgatcagctatttccngtcacgtgggacccaanagtgacagttggtctttgtactcgtntctctcgtacacaacnccagaccaacccccatcactcattatgtgtcactgtccgaccctcgaggcgtactcgtacntcgtcttctacgagctacaacgtctggacaaccaccggccttacccgaacctactcctcgtacgggccttaccgtagttcgaaggaccgtagttccgttactttactactagtctagtttacctttaaagtacggtaccgtccgtacttaccggttcgtttacgggtttccggtacgggtacggccgtaacccggtaggttaccgacccggtttccgtaccggttcgaacccggtcccgtaacggtccctaccggtccccccggttcggtaccccgttccgttccccgttaccccgg

SEQ ID NO: 130585 - DNA, 622 bp, Homo sapiens
  misc_feature: GYAE6OF02GJA6L.22.36.D03.1.454.CMB.1.raw
  modified_base (217)..(217): a, c, t, g, unknown or other
  misc_feature (217)..(217): n is a, c, g, or t
  modified_base (312)..(312): a, c, t, g, unknown or other
  misc_feature (312)..(312): n is a, c, g, or t
  modified_base (328)..(328): a, c, t, g, unknown or other
  misc_feature (328)..(328): n is a, c, g, or t
  modified_base (347)..(347): a, c, t, g, unknown or other
  misc_feature (347)..(347): n is a, c, g, or t
  modified_base (366)..(366): a, c, t, g, unknown or other
  misc_feature (366)..(366): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacagtgacagttgggtcttttgactctgtctcctggtaccaacaacacccacggccaaaccccccaatcatctatttatggtntcactcgtcggccctnaggatctctcatcgcttcncaggctcagtctgccaacnccggcctaccctaaccactctcgtcgggtccttccagtttggacggacgtagttcttacttattactagttaacgtttacctttaaagttacggtccgtacctacgttccgttacggtttcggttttcgggcggtaggtaccgaccggtaagttcggtacccgttccgtccggttaccgaccggtccccgtaaggtcccgttacccggtccccccgttcgggttcccaaccgtttccgttccggtttcccccccgg

SEQ ID NO: 130586 - DNA, 606 bp, Homo sapiens
  misc_feature: GYAE6OF02GO3UE.22.36.D03.1.454.CMB.1.raw
  modified_base (218)..(218): a, c, t, g, unknown or other
  misc_feature (218)..(218): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcacgtgggaccaacagtgactagttggtcttttgactctgtctctgtaccaacacaccacgaccaaacccccatcatctattatgtgtcactcgtcgcctgacggtatctctcactcgtcttctcacggtcctaccgaagtctcggacaaccgccgtacccttaccctaacctactcctcgtcggtcctccgtagtttaggacggtacgtagttccttaactttacttactgtaccttagtttaccgtttaaagttcggtactactaccttcgttcggtttggtttaccggcggtacggtccgaaccggtagtccgtaccggtccgtacggtaccaccgaccgtaaggtccgtcccgtccccgtcggtcctaccgtccgttccccgg

SEQ ID NO: 130587 - DNA, 614 bp, Homo sapiens
  misc_feature: GYAE6OF02GZ733.22.36.D03.1.454.CMB.1.raw
  modified_base (276)..(276): a, c, t, g, unknown or other
  misc_feature (276)..(276): n is a, c, g, or t
  modified_base (305)..(305): a, c, t, g, unknown or other
  misc_feature (305)..(305): n is a, c, g, or t
  modified_base (328)..(328): a, c, t, g, unknown or other
  misc_feature (328)..(328): n is a, c, g, or t
  modified_base (337)..(337): a, c, t, g, unknown or other
  misc_feature (337)..(337): n is a, c, g, or t
  modified_base (349)..(349): a, c, t, g, unknown or other
  misc_feature (349)..(349): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcacgtgggaccaacagtgacagttgggttcttttgactctgtctctgtaccacaacnccacgaccaacccccatcatcattatgtntcactcgcgcctcaggatctctnatcgcttcncacgctcagtcngacaacgaccgtccctaccctaacctctcctcgtcggtcctccgtagtttcgacggtacgtacgttacttacttacttacgtgtacttacgtttacctttaaagttacggtcctacctaccgttacgttcggtttacgggtttccggacgggtacgtaccgtaaccggtacgtccggacccggttcccgtacggttaccgaccggtacccgaacggtccgtcccggtcccccgttaccggtccgtacccgttccgttacccccgg

SEQ ID NO: 130588 - DNA, 581 bp, Homo sapiens
  misc_feature: GYAE6OF02JE097.22.36.D03.1.454.CMB.1.raw
  modified_base (307)..(307): a, c, t, g, unknown or other
  misc_feature (307)..(307): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctcgtgtctggatcatctggacagtcgatcagcatttcctgcactgggaccaacagtgacattgggtcttttgactctgtctcctggtaccaacaacaccaggaccaaaccccccaatcatcatttatggtntcactcgtcggcctgaggatctctcatcgtcttctacgaggtcctccgaagtctggaccaacctacggccctaccctaaccactacctcgtcgggtctcctagttgacgcgtacgtcttacttattactgtctacgttacctttaaagttacggaccgtcctaacgttcgttcggttcggttttcggcggtacggtcaccgtacgtcgtaccgtccgtacggtcacgtcccgaagtcccttaccccgtcgtacctaccttccgtaccctccccg

SEQ ID NO: 130589 - DNA, 673 bp, Homo sapiens
  misc_feature: GYAE6OF02I4V1O.22.36.D03.1.454.CMB.1.raw
  modified_base (143)..(143): a, c, t, g, unknown or other
  misc_feature (143)..(143): n is a, c, g, or t
  modified_base (222)..(222): a, c, t, g, unknown or other
  misc_feature (222)..(222): n is a, c, g, or t
  modified_base (330)..(330): a, c, t, g, unknown or other
  misc_feature (330)..(330): n is a, c, g, or t
  modified_base (334)..(334): a, c, t, g, unknown or other
  misc_feature (334)..(334): n is a, c, g, or t
tcagacatacgcgtcacgaccggtgctcgatttagctgcgtcacgatctctcgttgggggggtttcaggaggcagcgctctcgggacgtctccaccatggcctgggctctgctattcctcaccttcctcactcgagggcacgngggtcctgggcccagtctcgccctgacccagcctgcctccgtgtctggactcatctggacagtcgatcagctatttccngcacgtcgggaccaacagtgaactgtttgggttctttagacttctgtctcctaggtaaccaacaacacccgacgtaccccaaaccccctatacacttctaatttacgngtcncctacgtcgtccggcctcgaacggtctcctctctactcgtcttcgtcgcggtactaccgtaagtccgtacggaccaaaccgtcccgtacccttacccgaacgtactccgtcgtcggccttacgtaggttgaacggtacgtaacgttacttaccttagttaccgtcgttaccgttaagttttaaccttaaaggttccgtccgtaccgtacgtttccggttcggtttcgggtttaccgggacggtacggtaccgtaccgtacgtcggtaccggttccgtacggtacgaccgtacgacggtcctccggtccccgtagttcccgtacgttccgtcgttccccg

SEQ ID NO: 130590 - DNA, 663 bp, Homo sapiens
  misc_feature: GYAE6OF02GMKUT.22.36.D03.1.454.CMB.1.raw
tcagacatacgcgtcacgaccggtgctcgatttagctgcgtcacgatctctcttggggggggtctcaggaggcagcgctctcgggacgtctccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgtacgtggtggttataactatgtctctgtaccaacacaccagcaaacgccccaaactcatgtatttagtgaggtacactaacgccggccctcgacggggtccctagactcgcttctcgtggcctacgaagtctggacaacgtccgccctcccgtcgacccgtctccgtcgggtcctccggaggctaggacggagtggacggtctaggtaactttagttaccgtgacacgtaccttcgaagttagtcgggacggaccgtaagcgtaaaccgtttaaggtttcggggttacgggtttaccggggacgggtaacggggtaaccctaaggggtacccgtacggggtaaccccgttacccgggttaacgggtaaccgaccgggtaaccccggtaaacgggtccccgttacccggtaccccccggttaccccggg

SEQ ID NO: 130591 - DNA, 599 bp, Homo sapiens
  misc_feature: GYAE6OF02FVAKG.22.36.D03.1.454.CMB.1.raw
  modified_base (440)..(440): a, c, t, g, unknown or other
  misc_feature (440)..(440): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtcctcgtacgaacaacaccacgccgaacccccaacctacatctacttatgtgtcactcgtcgcctcagagtctctcactcgtcttctcacggctcctacgtacgtcgacgaacgacgcccgtaccctaaccgacttcctcgtcggctcctacgttgacggacgtacgtacttacttacttactntaccgtactttacctttaacgttaaggtccgacctccgtcgttcgttcggttttccgggcggtacggcgaccgagttacggaccgttccgtccggtacgtaccgaccgacgtccgtccgcccccgttaccggtcctcccgttacttcccgttacccccg

SEQ ID NO: 130592 - DNA, 645 bp, Homo sapiens
  misc_feature: GYAE6OF02ICDU9.22.36.D03.1.454.CMB.1.raw
  modified_base (151)..(151): a, c, t, g, unknown or other
  misc_feature (151)..(151): n is a, c, g, or t
  modified_base (329)..(329): a, c, t, g, unknown or other
  misc_feature (329)..(329): n is a, c, g, or t
  modified_base (333)..(333): a, c, t, g, unknown or other
  misc_feature (333)..(333): n is a, c, g, or t
tcagacatacgcgtcacgaccggtgctcgatttagctgcgtcacgatctctcgttggggggggtctcaggaggcagcgctctcgggacgtcctccaccatggcctgggctctgctattcctcaccttcctcactcagggcacgagggtccngggcccagtctcgccctgacccagcctcgcctccgtgtctggatcatctggacagtcgatcagtctacttttcctgctacgtcgggaacccaatggtgtacggttgggtaggttaacaagtatgtctccgtcgtaccaacaccaccacggaccaaacccccatacactactatttagngtcncacgtcgtccgcctgacggactctctcactcgtacttctacgagtacctaccgtaacgttctacgaccaaccgaccgtcctaccctaacacttctcgtcggtcctccgttaggttacgacggtacgagttacttacgttaacttactagtacttaacgtttactttaaacgtacggtcccgaccgttaccttacgttccggtttcgggttttacggacgggttacggaccgtacggtaacgtaccgtaccgttccgtacggtacacgacccgtagtccaccgtccccgtagtccgtactccgtaccgtcccc

SEQ ID NO: 130593 - DNA, 648 bp, Homo sapiens
  misc_feature: GYAE6OF02H0V15.22.36.D03.1.454.CMB.1.raw
  modified_base (219)..(219): a, c, t, g, unknown or other
  misc_feature (219)..(219): n is a, c, g, or t
  modified_base (234)..(234): a, c, t, g, unknown or other
  misc_feature (234)..(234): n is a, c, g, or t
  modified_base (314)..(314): a, c, t, g, unknown or other
  misc_feature (314)..(314): n is a, c, g, or t
  modified_base (317)..(317): a, c, t, g, unknown or other
  misc_feature (317)..(317): n is a, c, g, or t
  modified_base (355)..(355): a, c, t, g, unknown or other
  misc_feature (355)..(355): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctcgccctgacccagcctgcctccgtgtctggatcatctggacagtcgatcagctatttccngcactgggaaccaanagtgacattgggtcttttgactctgtctccgtaggtaaccaacaacacccacggacccaaaccccccaatcatctattangtntcactcgtccgcctcgaggactctctcatccgtcttcncgtacggctaccaacgtcgtacggacctaacgaccggtccctaccctaacctactccgtacgtcgggtacctccgtaaggttacggacggtacgtagttacttaactttactttacctagtacgttacgtttaaccgttttaaagtacggtcctaccctaacgttccgttacggtttcggttttccgggacggtacggtaccgaaccgtaggtccgtacccgttccgtaccggtcgtaacgacccgtaacggtcctcccggtccccgttcggtacctaccgtccgttacccgg

SEQ ID NO: 130594 - DNA, 696 bp, Homo sapiens
  misc_feature: GYAE6OF02GHYHC.22.36.D03.1.454.CMB.1.raw
  modified_base (237)..(237): a, c, t, g, unknown or other
  misc_feature (237)..(237): n is a, c, g, or t
  modified_base (442)..(442): a, c, t, g, unknown or other
  misc_feature (442)..(442): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctactttccgtgcacgtcgggaccaacngtagactagttgggttacttttgacctctgtcctcgtacgtaccaacaaccaccgacgaccccaaacccccatcactactattagtcggtctccacgtcggtccgccctagacggtatcctctctacgtccgtcttcgacgtacgtcctacgtaacgtcgtacggaacccgaaccgtacccggtaccccttaaccccgttaaccnccgttccttaccgggttcggtacccttacgttaggtttacggaacgggttaccgtacgttacctttaacttaacttcggtacttaccgtttaagttttaaccgtttaaagtccgtaccgtaccttcgttaccgtttcgggttttcgggttccggacggtacggtaccgtaacgtacgtcggtacccgtccggttacggtacaccggtaccgtacgtccgtcccgtcccgttaccggtacctccgttcttccccg

SEQ ID NO: 130595 - DNA, 617 bp, Homo sapiens
  misc_feature: GYAE6OF02HFKOE.22.36.D03.1.454.CMB.1.raw
  modified_base (313)..(313): a, c, t, g, unknown or other
  misc_feature (313)..(313): n is a, c, g, or t
  modified_base (522)..(522): a, c, t, g, unknown or other
  misc_feature (522)..(522): n is a, c, g, or t
  modified_base (582)..(582): a, c, t, g, unknown or other
  misc_feature (582)..(582): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcacgtgggaccaacgagtgactagttgggtcttttgactctgtctcctggtaccaacaacacccacggaccaaaccccccaactcatcattagngtctcactcgtccgccctcgaggtactctctcactcgtcttctcacggctaccgaagttcctacggaccaaaccgacccgggtccccttaaccccgtaaacctacttcccgttaccgtcgggtccttacccgtaggtttacggaacgggtacgtacgttaccgttaactttacgttacctgtacttacgtttacctttaaagtacgccncctaccgttcgttcgtttcgggtttcggcggtagcgacgtagtcgtaccgtcgtccgtcncgaccgagcctccgccctcgtcctactccgtcccg

SEQ ID NO: 130596 - DNA, 621 bp, Homo sapiens
  misc_feature: GYAE6OF02JS1B7.22.36.D03.1.454.CMB.1.raw
  modified_base (269)..(269): a, c, t, g, unknown or other
  misc_feature (269)..(269): n is a, c, g, or t
  modified_base (296)..(296): a, c, t, g, unknown or other
  misc_feature (296)..(296): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcactgggaccaacagtgacagttggtctttgactctgtctctgtaccaanacaccagccaacccccatcatcattangtgtcactcgtcgcctcaggacgtctctcatcgtcttcgtcacggtcctacgtaacgtccgttaggccaaaccgaccggtccctaccctaaccacttccgtcgtcggtccttccctaggttttcggaacggtaccgtagttccttaacgtttaattaccgtgtacttacgtttaccgtttaaagtacggtccgtacctacgttccgttcggtttccggtttcgggccggtacgtccgaaccgttagtccggtaacccgttccgtccggtgaccgtacccgaaggtccgttacccgccccgttacggtcctaccgtccttccccgg

SEQ ID NO: 130597 - DNA, 631 bp, Homo sapiens
  misc_feature: GYAE6OF02IFWQV.22.36.D03.1.454.CMB.1.raw
  modified_base (217)..(217): a, c, t, g, unknown or other
  misc_feature (217)..(217): n is a, c, g, or t
  modified_base (231)..(231): a, c, t, g, unknown or other
  misc_feature (231)..(231): n is a, c, g, or t
  modified_base (312)..(312): a, c, t, g, unknown or other
  misc_feature (312)..(312): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaangtgacattgggtcttttgactctgtctcctggtaccaacaacacccaggacccaaaacccccaactcaatctatttatgtntcactcgtcgcctcaggagtctctcatcgtcttctcaggctaccagtctggacaacgaccggccttaccctaaaccactcctcgtcgggccttccgtagtttgaggtacgtagtcttaactttattactgtacctaagtttacctttaaagttacggaccgtacctaacgttcgttacggtttcgggttttccggacgggtacgtaccgtaccgtaaggttccggtaacccggttcccgtacggttaccgaaccggtacccgaacgggtccgttcccggtaccccccgttcgggtaccctacccgttccgttaccccgg

SEQ ID NO: 130598 - DNA, 634 bp, Homo sapiens
  misc_feature: GYAE6OF02FPNGB.22.36.D03.1.454.CMB.1.raw
  modified_base (236)..(236): a, c, t, g, unknown or other
  misc_feature (236)..(236): n is a, c, g, or t
tcagacatacgcgtcacgaccggtgctcgatttagctgcgtcacgatctctcgttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtnactagttggtcttttgactctgtctcctggtaccaacaaccaccaggccaaacccccccaactccatcatttatggtgtcactcgtcgccctcaggatctctcatcgcttctcagctccagtctgcaacgcgcctccctaaccactctctggcctccgagtttgacgggacgtacgtcttaactttacgttactacgtctacgttttaccctttaaagttacggtcgtccctaacgttccgttccggtttgggttttaccgggccgggtaacggtcccgtaaccgggtacgttacggaccccggttaccgttaccgggttccctaaccggtaccccgtaacgggtcccttacccggtccccccgttaccggttcctacccgttccgtttaccccccgg

SEQ ID NO: 130599 - DNA, 660 bp, Homo sapiens
  misc_feature: GYAE6OF02JI18M.22.36.D03.1.454.CMB.1.raw
  modified_base (218)..(218): a, c, t, g, unknown or other
  misc_feature (218)..(218): n is a, c, g, or t
  modified_base (234)..(234): a, c, t, g, unknown or other
  misc_feature (234)..(234): n is a, c, g, or t
  modified_base (313)..(313): a, c, t, g, unknown or other
  misc_feature (313)..(313): n is a, c, g, or t
  modified_base (417)..(417): a, c, t, g, unknown or other
  misc_feature (417)..(417): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcacgtgggaccaacngtgactagttcgggttcttttgactcgtgtctcctggtaccaactaacacccaggacccaaaccccccatcatcattangtcgtcactcgtcgccctcgacggtatcctctcactccgcttcctcgacgtcctaccgaacgtcttacggaccaaaccgtccgtccctaccctaacactcctcncgggtcctccgtagttacggacggtacgtacgttccgttactttaattccgtagacgttaccgtttaaccttttaaacgtcggtaccctccgtacctttcccgttacggtttcgggttttaccgggaccggtacggtacctaaccgggtattccggacccgttcccggtacggttaccgaccgtacccggtaaggtccctacccggtcccccgttcggtaccctacccgttcgttacccccgg

SEQ ID NO: 130600 - DNA, 543 bp, Homo sapiens
  misc_feature: GYAE6OF02F8KKC.22.36.D03.1.454.CMB.1.raw
  modified_base (232)..(232): a, c, t, g, unknown or other
  misc_feature (232)..(232): n is a, c, g, or t
  modified_base (405)..(405): a, c, t, g, unknown or other
  misc_feature (405)..(405): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacngtgacagttggtctttgactctgtctcctgtaccaacaccaccaggcacacgccccaaactcatgatttatgagtcactaagcggcctcgacggggtcctgatcgcttctctggctcctagtcgtggcgacgaccggcctcccgtcgacccgtctcgtggctccgagctgagngtgagctgtattatactgctactcatatgacgaggcgctacgtacgttgggttcgtcggcgggaacgggaccgtaacggtcgttacgtacccggttaccgttacggtaccgaccggacccgtacggtccgtaccccgg

SEQ ID NO: 130601 - DNA, 730 bp, Homo sapiens
  misc_feature: GYAE6OF02JQR46.22.36.D03.1.454.CMB.1.raw
  modified_base (171)..(171): a, c, t, g, unknown or other
  misc_feature (171)..(171): n is a, c, g, or t
  modified_base (194)..(194): a, c, t, g, unknown or other
  misc_feature (194)..(194): n is a, c, g, or t
  modified_base (425)..(425): a, c, t, g, unknown or other
  misc_feature (425)..(425): n is a, c, g, or t
tcagacatacgcgtcacgaccggtgctcgatttagctgcgtcacgatctctcttgggggggtcgtcgaggaggcagcgctctcgggacgtctccaccatggcctgggctctgctattcctcaccttcctcactcaggcacagggtcctgggcccagtctgccctagacccngtcctgccctcgtgtctggatcntctggacagtcgatcagctactttcctgccacgtcggggacccaacgtagtacgactagtttcggggtcctttttaggaccttctcggttccttcgttccggtaacctaaccgactacccaggacccaaaccccccctaaactcacttacatttaacgtggtactcctaaccgttgtacccggtacccctagtaccgggaagttcctccttacacgttcctcctttaccgntaccgggtcctaccggtaacttccgtggaccttaaccgaccgggttacccctacccctaaccgaactccttacgttaccggaccttacccgttagttaccggacggtaaccgtacggttacttaaccgtttaactttacgtacgttccttaacgttaccttttttaaacgaccggtttacctacccgtaacttccggttacgtttcggttttccgggacgtaaccgcggtaccgtacgtcggtacccgttccgtcgtcgtaaccgcgtaacgtccgcgtaccccgtcgtactaccttcgtacccg

SEQ ID NO: 130602 - DNA, 600 bp, Homo sapiens
  misc_feature: GYAE6OF02G433Z.22.36.D03.1.454.CMB.1.raw
  modified_base (218)..(218): a, c, t, g, unknown or other
  misc_feature (218)..(218): n is a, c, g, or t
  modified_base (232)..(232): a, c, t, g, unknown or other
  misc_feature (232)..(232): n is a, c, g, or t
  modified_base (316)..(316): a, c, t, g, unknown or other
  misc_feature (316)..(316): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcactgggaccaangtgactagttcggggttcttttgacttcgtgtctcctcggtaaccaacaaccacccaggacccaaaccccccatcatctatttnggtctcactcgtccgccctgaggacgttctctcacgtccgtcttctcgacggtctaccgtaacgtcgtcgaccaacgtaccgtccctaccctaccacttcctcgtcgggtccttaccgtaggtttcgacggtaccgtacgttaccttaactttacttactcgtacttaccgtttactttaaagtcgtccgtacctcttcgttcgttcggtttcggacggtacgcgacgtagtcgtaccgtcgtacgcgccgacgacgtcgccgtcccgtcgcctctccgtcccg

SEQ ID NO: 130603 - DNA, 540 bp, Homo sapiens
  misc_feature: GYAE6OF02FNHWN.22.36.D03.1.454.CMB.1.raw
  modified_base (254)..(254): a, c, t, g, unknown or other
  misc_feature (254)..(254): n is a, c, g, or t
  modified_base (361)..(361): a, c, t, g, unknown or other
  misc_feature (361)..(361): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactntgtctctggtaccaacacacccagccaaccccccactcatctatttatggtgtcactcgtcgccctcaggagtctctcatcgcttctcaggctcagtctggacaacncgcctcctaaccatctctgactcagtttagagacgagtctacttattacgtgtactagtttacctttaaagttacggcgtcctacttcgttcggttaggtttccggcggaggccacgtagcgtaccgtccgtcgtacacgacccgaaggctcggacccctcggtcctacctcttacccg

SEQ ID NO: 130604 - DNA, 705 bp, Homo sapiens
  misc_feature: GYAE6OF02IEPRC.22.36.D03.1.454.CMB.1.raw
  modified_base (321)..(321): a, c, t, g, unknown or other
  misc_feature (321)..(321): n is a, c, g, or t
  modified_base (324)..(324): a, c, t, g, unknown or other
  misc_feature (324)..(324): n is a, c, g, or t
  modified_base (340)..(340): a, c, t, g, unknown or other
  misc_feature (340)..(340): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcactcggggaccaacagtcgacagttgggtcttttgactctgtctcctggtaccacacaccagaccaaacccccatcatcattatgtgtcactcgtcgcctnagntctctcatcgcttccncacggtctaccgaagttcgtggaccaaaccgaccgcccttacccaactacttccgtcgttcgggccttcctaggttttacgacgggtaccgtagttccttaactttacgtttaccgtacggtaccttaacggttttacccttttaaaacgtttacgggacccttacccgtaaccgtttcccgttaccgggttttaccggggtttttaccgggaccggggttaacgggtacccgtaacccggttaaggttccggttaacccccggttccgtttacccggggtactaccggaccccgtaaacgggtcccgttacccggtacccccccggtttacgggtacccttacccgttcccggtttaaccccgg

SEQ ID NO: 130605 - DNA, 641 bp, Homo sapiens
  misc_feature: GYAE6OF02FG5IZ.22.36.D03.1.454.CMB.1.raw
  modified_base (232)..(232): a, c, t, g, unknown or other
  misc_feature (232)..(232): n is a, c, g, or t
  modified_base (338)..(338): a, c, t, g, unknown or other
  misc_feature (338)..(338): n is a, c, g, or t
  modified_base (361)..(361): a, c, t, g, unknown or other
  misc_feature (361)..(361): n is a, c, g, or t
tcagacatacgcgtcacgaccggtgctcgatttagctgcgtcacgatctctcttgggggggtcgtcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacngtgactagttgggttctttgactctgttctccttggtaccaacaacacccgacggaccaaacccccccaactcaatctatttatggtgtacactcgtccggccctnagggtactctctcatccgcttcncgaggctaccaagtctcggaccaacgaccgccctaccctaaccactacctcgtcgggtccttccgagtttcggaacggtacgtaggttcttaactttacttactcgtcttacgtttacctttaaagttacggccgtaccctacttcgttacggtttcgggtttcggacggtacgtacgtaccggagtacggtacccgttcccgtaccgggtacctacggaccccgtaacgggtccgttaccgtcccccccgttcggtcccgtaccgttccgttaccccgg

SEQ ID NO: 130606 - DNA, 734 bp, Homo sapiens
  misc_feature: GYAE6OF02G18TI.22.36.D03.1.454.CMB.1.raw
  modified_base (320)..(320): a, c, t, g, unknown or other
  misc_feature (320)..(320): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcacgtagggaccaacagtagactattgggttcttttgactctgtctcctaggtaaccaacaaccacccaggacaaaaccgcccccaaatcatagtatttanggtaggtcaactaacggccgaccctcgacgggtccctagactcgtcttctcgtcggcctaccgaagtcgtacggaccaaccgaccggtcccttcccgtacgcccgttacgtccggtcgggccctaccgtacgggtacgtaggaacgggtagtacggtacgggtcttaggttaactttacttaccgtggaccgtaacggtcttaaccgtaaggtttaggacgggacggtaccgtaagggtacctaaacgggttttaacggttttgggggttaccggggttaccggggtaaccggggggtaaaccgggttaaacccggtaacggttccggtaccgggttaacccccgtttaccgggttaacgggtacccgaacccgggtttaacccgggtaaccggggtcccttaaccccccgggg

SEQ ID NO: 130607 - DNA, 551 bp, Homo sapiens
  misc_feature: GYAE6OF02II2AY.22.36.D03.1.454.CMB.1.raw
  modified_base (268)..(268): a, c, t, g, unknown or other
  misc_feature (268)..(268): n is a, c, g, or t
  modified_base (300)..(300): a, c, t, g, unknown or other
  misc_feature (300)..(300): n is a, c, g, or t
  modified_base (336)..(336): a, c, t, g, unknown or other
  misc_feature (336)..(336): n is a, c, g, or t
  modified_base (367)..(367): a, c, t, g, unknown or other
  misc_feature (367)..(367): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcactgggaccaacagtgacattggtcttttgactctgtctctgtaccaanacaccagccaaacccccatcatcattatggtntcactcgtcggccctcaggagtctctcatcgcttcncagctccaagtctgcacacgcctacctaccntctctggctctagttgacgtcgagttctacttatactgtactacgttactttaagttacggacgtactaccttcgttcgttcggttttccggcgggtacgaccgtaccggtacgtcgtacccggtccgtccggtacacggtcccaaggccgtccgtcccccgttggtccctacctccgttcccg

SEQ ID NO: 130608 - DNA, 683 bp, Homo sapiens
  misc_feature: GYAE6OF02GBGCW.22.36.D03.1.454.CMB.1.raw
  modified_base (328)..(328): a, c, t, g, unknown or other
  misc_feature (328)..(328): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcacgtcgggaccaacgagtgactagttgggtcttttgactctgtcctcctggtaccaacaaccacccgacggacccaaaccccccatcactctatttacgtggtctacncctcggtccgcccgtacgaggtacgtctcgtcacgtccgtctttaccgtcgtacggtcctaccgtaagttccgtacgggacccaaccgacccggtacccctacccgtaacctcttccgtccggtacggtcccttaccgttaggttacggaacggtaccgtagttaccgttaacgtttaacttacgtcgtacgttaacgtttaccgtttaaagttccggtacctccgtaacgttccgttacggtttcggtttcggacggtacgaccgtaccgtacgtcggtacccggtcgtacggtaccgccgtaccgaaccggtccgtcccggtaccccgtcggtcctaccgttcccgttacccg

SEQ ID NO: 130609 - DNA, 650 bp, Homo sapiens
  misc_feature: GYAE6OF02F9NW1.22.36.D03.1.454.CMB.1.raw
  modified_base (321)..(321): a, c, t, g, unknown or other
  misc_feature (321)..(321): n is a, c, g, or t
  modified_base (325)..(325): a, c, t, g, unknown or other
  misc_feature (325)..(325): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcacgtgggaaccaacagtgacagtttgggttcttttgacttctcgtctccgtggtaaccaacaaccacccacggacccaaaccccccaactcactctatttanggtntcacgtcgtcggcctcgacggtatctctctatcgtcttctcgacgctcaacgtctcggacaacgccgtcctaccctaaccactcctccgtcgggtccttaccgtaggtttacggacggaccgtacggttaccttaactttactttacttacgtcttaacgttttaacctttaaagttacggtacctacctaacgttccgttcggtttacgggtttcggacggtaacggtacgaccggtacgtcggtacccggttccggtacggtaccgacgacccgtaacggccgtacccggtcccccgttacggtccttacccgttccgtcccg

SEQ ID NO: 130610 - DNA, 586 bp, Homo sapiens
  misc_feature: GYAE6OF02G5PLS.22.36.D03.1.454.CMB.1.raw
  modified_base (339)..(339): a, c, t, g, unknown or other
  misc_feature (339)..(339): n is a, c, g, or t
  modified_base (341)..(341): a, c, t, g, unknown or other
  misc_feature (341)..(341): n is a, c, g, or t
  modified_base (355)..(355): a, c, t, g, unknown or other
  misc_feature (355)..(355): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgactagttgggtcttttgactctgtctctgtaccaacacaccagccaacccccatcatcattatggtgtcactcgtccggcctcgaggagtctctcatcgcttcncngctcagtctgcacncgcctcctacatctcgtggctctagttgaggtacagtcttacttattactcgctagttacctttaaagtacggtccgtacctacttccgttacgtttcgggttttccgggcggtacggtccgaaccggtacgttcgtacccggttccgtaccgggttaccaccggtaccccgtaagggtcccgttacccggtccccccgttcgggttaccctaccgttccgtttaccccgg

SEQ ID NO: 130611 - DNA, 647 bp, Homo sapiens
  misc_feature: GYAE6OF02FPV95.22.36.D03.1.454.CMB.1.raw
  modified_base (270)..(270): a, c, t, g, unknown or other
  misc_feature (270)..(270): n is a, c, g, or t
  modified_base (288)..(288): a, c, t, g, unknown or other
  misc_feature (288)..(288): n is a, c, g, or t
  modified_base (296)..(296): a, c, t, g, unknown or other
  misc_feature (296)..(296): n is a, c, g, or t
  modified_base (299)..(299): a, c, t, g, unknown or other
  misc_feature (299)..(299): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgactattgggtctttgactctgtctcctgtaccaanacaccagccaacccccancatcattngtntcactcgtccgcctcaggtagtctctctatcgtcttctcaggtctcaagtcgtcggacaaacgccgccctacccctaactactcctacgtcggccttccgtagtttcgacggtaacgtacgttacttaaccttattaccgtgtctttaacgtttaccgttttaaagtacggaccgtaccgtaacctttccgttacggtttcgggttttccggaccgggtaacgggtaccgtaaccggtaggttacgtaaccgtttccggttaccctaccggggttccctaaccgggtaaccccgtacgggttaccttccccgggaccccccgtttcggtaccctaccccgtttcccgg

SEQ ID NO: 130612 - DNA, 676 bp, Homo sapiens
  misc_feature: GYAE6OF02JXM9C.22.36.D03.1.454.CMB.1.raw
  modified_base (217)..(217): a, c, t, g, unknown or other
  misc_feature (217)..(217): n is a, c, g, or t
  modified_base (324)..(324): a, c, t, g, unknown or other
  misc_feature (324)..(324): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggattcatctggacagtcgatcagcatttccngcactgggacctaacagtgacagtttgggtctttgtactctgtctctcggtaccaactaacacccacggacctaaaccccccaactaccactcctatttactcggtntcacgttcgtccggcccttaccgaggtacgtcttctcgactccgtcttcttcgacgtcctacctaagcttggaccaacgaccggtccctaccctaactacgtacctcgtcgggcctaccgtacgttcggacggtaccggtacgtaccttaccgtttaatttaccgtacgtaccttaggtttacctttttaaacgtacggtccctaccgttaaccgttcgttcccggttttagggttttcccgggtacggtaacgggtccgtaacccggtaggttaccgtcccgtccggttaaccggtcgaccgtccgaaccggtctccggacccccgttcggtccctacgttccttaccccg

SEQ ID NO: 130613 - DNA, 857 bp, Homo sapiens
  misc_feature: GYAE6OF02I0IPT.22.36.D03.1.454.CMB.1.raw
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatcctggacagtcgatcagctatttccctgctacgtgggaaccaacgagtgactagttggtcttttgactctgtctcctggtaccaacaacacccaggacccaaaccccccgaactccactcctaatttagtcggttcgctaacgtcgtccggcccctcgacggtacgttcctctaccgaacttccggtacctttccgtaccgacgggtcccttacccgtaaacggttccgtaacgggtaccctaaaccggacccggggtcccccttaaccccgttaaaacccgtaacgtttccccttaaccgggtttccgggggacccctttaccccggtaacgggtttttccgggaaacggggtaaccggttaaccgggttactttaaacgttttaacgtttacccggtagttacccgttacgttttaaacccgttttaaacgttcgggaacccgttccctaaccgttaccgttacgggttttccggttttaccggggaccgggtaacgggttacccgtaaccggggttaaccggtcccggttaaccccggggtttcccgttaccccggggttaccggaaacccggttaccccggaagggttaccccgtttaccccggggtcccccgttaccgggttaccccggtaaccccgtttcccgttttaaccccccggg

SEQ ID NO: 130614 - DNA, 609 bp, Homo sapiens
  misc_feature: GYAE6OF02FE3LP.22.36.D03.1.454.CMB.1.raw
  modified_base (308)..(308): a, c, t, g, unknown or other
  misc_feature (308)..(308): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgactagttggggtcttttgactctgtctctggtaccaacaacacccaggccaaaccccccaatcatctatttangtgtcactcgtcgccctcaggtatctctcatcgcttctcaggtctcaagtctggacaaccgaccggcctaccccgtaaccatcctcgtcgggtaccttcccgaggttttacggaaggacgtacgttccttaacttactttactcgacttacgtttaccttttaaaagttcgacgtacctacgttcctacggtttcgggtttcgcggtacggccaaccggtagtcggacccggttccgtccggtacaccggtacccaagggtcctccggccccccgttggtccctaccgttccttaccccgg

SEQ ID NO: 130615 - DNA, 751 bp, Homo sapiens
  misc_feature: GYAE6OF02I4Q6X.22.36.D03.1.454.CMB.1.raw
  modified_base (215)..(215): a, c, t, g, unknown or other
  misc_feature (215)..(215): n is a, c, g, or t
  modified_base (236)..(236): a, c, t, g, unknown or other
  misc_feature (236)..(236): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctcgtgtctggatcatctggacagtcgatcagcatttccngccacgttgggacccaaacgngtgaacagtttgggtcttttgactctgtctcctgtaccaacaacaccaggaccaacccccaactcatcatttatgtgtcacgtcgtcggcctcgaggacgtctcgtacactcgtcttcgtcacggtctacctaaacgtccttcgggacctaaacgacccgggtacctaccccgttaaacctaacgtttccttaccggttcgggtacccttacccgtaagggtttttcgaaacgggtacgtaacggttacttaacgtttaacgttaccgttgtacccgttaagttttacccgttttaaaaagtttaccgggtacccgtaacccgtacctttccggttacggttttaccgggtttttaccgggggtaccggtagggtacccgtaaacccggttaacgggttccggacccgggtttaaccggttcccgggtaaccggtaaccggtaaccccgttaacgggtacccgttacccggtcccccgtttaccggggttaccctacccgtttccggttaccccg

SEQ ID NO: 130616 - DNA, 529 bp, Homo sapiens
  misc_feature: GYAE6OF02JQKSR.22.36.D03.1.454.CMB.1.raw
  modified_base (216)..(216): a, c, t, g, unknown or other
  misc_feature (216)..(216): n is a, c, g, or t
  modified_base (364)..(364): a, c, t, g, unknown or other
  misc_feature (364)..(364): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacagtgacattgggtcttttgactctgtctcctggtaccaacaacacccaggcaaaccccccaatccaatccattatgtagtcactcgtcggccctcaggagtctctcatcgcttctcaggctcaagtctggcacncggcctcctaaccatctctggctccagtttgaggacagtctacttatactgctagtttcctttaaatggctccaactctcgttgtttcggcggtagctaccgagtcgaccgtcctcggtctacgcccgaaggccgtacgccccctcggtccctagtccttcccgg

SEQ ID NO: 130617 - DNA, 720 bp, Homo sapiens
  misc_feature: GYAE6OF02FTZFZ.22.36.D03.1.454.CMB.1.raw
tcagacatacgcgtcacgaccggtgctcgatttagctgcgtcacgatctctcttgggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcacgtgggaccaaacgtgtgactagttgggttcttttgactctgtctctcggtaccaacaaccaccacggacccaaacccccataccactctattagtggtgtcactcgtcgccctcaggactctctctactccgtacttcctcgacggtcctaccgaagttccgtcggaccaaccgtaccgggtccccttaacccctaaacctaccgttccttaccgtcgggtacccttacccgtacggttttacggaacgggaaccgtacggttacttaacgtttacgttacgttcgtactaacgttttaacctttaaacgttcgggtaccgtccctaacttaccggtttcgggttagggtttttcccgggacgggtaccggtaccgtaacccggtacggttaccggtacccggtttcccggttaccggtaccgtacccggtaacccgacggttacccggtcccgttaccccccggttacggtacccttacccgttcccgttccccgg

SEQ ID NO: 130618 - DNA, 654 bp, Homo sapiens
  misc_feature: GYAE6OF02G0KEF.22.36.D03.1.454.CMB.1.raw
  modified_base (217)..(217): a, c, t, g, unknown or other
  misc_feature (217)..(217): n is a, c, g, or t
  modified_base (232)..(232): a, c, t, g, unknown or other
  misc_feature (232)..(232): n is a, c, g, or t
  modified_base (238)..(238): a, c, t, g, unknown or other
  misc_feature (238)..(238): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcactgggaccaacngtgacngttggtcttttgactctgtctcctggtaccaacaacacccaggccaaaccccccatcatctatttatggtgtcactcgtcggccctcaggtagtcctctactactcgcgttcctctagggcctccgtaacgttctcggaccaaacgtccgggccttaccccgtaaccacttcctcgtcgggtcctaccgttagttcggaacggtacgacgttacttactttaattacctcgtacttacgtttaccttttaaacgtttacgggcccgttacccgtaacgttccttttcggttacgggttttttaccggccgggtaacgtccgaaccgggtacgtaccgtaccgtcccgttaccggtcctaccggtacctaacggcccttccggtacccccgttcggtaccctacgttccttccccgg

SEQ ID NO: 130619 - DNA, 850 bp, Homo sapiens
  misc_feature: GYAE6OF02IV7XJ.22.36.D03.1.454.CMB.1.raw
  modified_base (218)..(218): a, c, t, g, unknown or other
  misc_feature (218)..(218): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngacacgtgggacccaacgagtgacagttgggtcttttgactctgtctccgtggtaaccaacaaccacccacggacccaaaccccccaactccatacctattacgtggtcgtcctacgtccgtcggcccttacgacggtacttcgtctcgtacgttccgtccttcttccggacggtccttaccgtaaacgttccgtacggtacccaaacccgtacccggtaccccttaccccgtaaaccctcgtttaccctccggttaccgggtcccttacccggttaacgggttttacggaaccggggttaaccgttaacggtttacccgtttaaaccgttttaacgtttaaccgttcgttaacccgtttaaaccggttttttaaacccgttttttaaaacgggttaccgggttacccgttaaccccgttaaccgtttcccggttttaacggggttttccgggggttttttaccggggaccggggttaaaccgggttacccgtaaacccggggttaacggtttccggtaacccccggtttcccggtttaacccgggtaccggtacccggtaacccggtaacggtccccgttacccggtccccccgttaccgggttcccctaacccgttcccgttacccccgg

SEQ ID NO: 130620 - DNA, 603 bp, Homo sapiens
  misc_feature: GYAE6OF02HK9C0.22.36.D03.1.454.CMB.1.raw
  modified_base (170)..(170): a, c, t, g, unknown or other
  misc_feature (170)..(170): n is a, c, g, or t
  modified_base (218)..(218): a, c, t, g, unknown or other
  misc_feature (218)..(218): n is a, c, g, or t
  modified_base (305)..(305): a, c, t, g, unknown or other
  misc_feature (305)..(305): n is a, c, g, or t
  modified_base (318)..(318): a, c, t, g, unknown or other
  misc_feature (318)..(318): n is a, c, g, or t
  modified_base (321)..(321): a, c, t, g, unknown or other
  misc_feature (321)..(321): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccngcctgcctccgtgtctggatcatctggacagtcgatcagctatttccngcacgtgggaccaacagtgactagttggtcttttgactctgtctctgtaccaacaacaccagaccaaacccccatcatcattatgtncactcgtcgcctnagngtctctcatcgcttctcacggtcctccgtaagtcctaggacaaccgtaccggacccttaccgtaaacccacttaccgtcgtcgggtctacccgtagtttacgaggacgtacgtcttaactttattacttacgtcgttaacgtttacctttaaagttcggccgtaccacttccgttcgttgggttttccgggcggtacggcgtaccgtagtcggtaccgtcgtaccggtcaccgtacccgacggcctcccggccccgttcggtaccctacgtcccgttcccgg

SEQ ID NO: 130621 - DNA, 654 bp, Homo sapiens
  misc_feature: GYAE6OF02HH6JT.22.36.D03.1.454.CMB.1.raw
  modified_base (217)..(217): a, c, t, g, unknown or other
  misc_feature (217)..(217): n is a, c, g, or t
  modified_base (234)..(234): a, c, t, g, unknown or other
  misc_feature (234)..(234): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcacgtcgggaaccaangtgactagtttgggttcttttgactcgtgttcctccgtacggtaaccaactaaccacccgaacggaccccaaaaccccccactcatcctaatttagtggtcgtccacttcggtcccgccttcgaggtctcctcctgtactctcttctacgacgtctacctagtcgtacgacaccgtaccggtccctaccctactacgtctccgtacgggtcctacgtgttcggacgtaccgtattcttacgttataccgtgtaccttagttacctttaagacggtacctaccttacgtcctttacgggttcgtttccgggacgtaccgtacgtacccgtagttacccgtaccggtccgtttacgggcctaacggtacccgacgtcccgtccccggtaccccgttccggtaccttcgtacccgttccccgg

SEQ ID NO: 130622 - DNA, 805 bp, Homo sapiens
  misc_feature: GYAE6OF02I7W7M.22.36.D03.1.454.CMB.1.raw
tcagacatacgcgtcacgaccggtgctcgatttagctgcgtcacgagtctctcgttggggggtctcaggaggcagcgctctcgggacgtctccgaccagtggcctgggctctgctacttcctcaccttcctcactcgagggcacagggtcctggacccgagtccgttcgccctacgacccacgccttcgcccgtccggtgtcgtggactctacgttcgtacgggacgtacggtacggaactccgtagaccttactttaccctacggaccgtaccggttacgggaacccaaccgtacggttacgtaacgttacggtttcggggtttacttttacggaccttacgttccgtaccgtccgttaacggtaaccccaaaccaaccaacccgtaccggaacccctaaaaccccccgtataccggacttacgttaacgtttacggtcggtcggtaactaccgttaccggtcccggtaccgtccgaacggttgttcctacgtcgtaacggttcctacgtcgtacgacggttctaaccggatcgttacgaccacgtaccggtcccttacctaccgacgtccttacggcggtacccttacgtacggtttacggacggtaccgttaacttccgttaactttccgttagtccttacgttacgttttaaccgtttaaacgtccggacccgttccgtaaccgttcgttacggttccgggttttcggacggttacgaccgtaccgagttccgaccgggttcctaacggcctaaccgtccggacgttccgaccttcccgtacgccttacctcggttccccg

SEQ ID NO: 130623 - DNA, 667 bp, Homo sapiens
  misc_feature: GYAE6OF02FIMW4.22.36.D03.1.454.CMB.1.raw
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacagttgggttctttgactctgtctcctggtaccaacaaccacccacggaccaaaccccccaactcatctatttagtggtgtcactcgtccggccctcgaggagtctctcactcgtcttctcaggtctaccaagtcgtggaccaaccgaccggccctccccgtaacctactcctccgtcgggtcctccgtagtttacggacggtacgtacgttacctttaactttactttaccgtacgtcgttaacgttttacccttttaaaagttcggaccgtaccctacgttccgttccggtttcgggttttccggtacgggtacggtaccgtaaccgtacggtccggtacccggttcccggtacggttcccgaccggtaccccgtaacgggtccgtacccgtccccccggttccggtaccctacgttcccgttaccccg

SEQ ID NO: 130624 - DNA, 743 bp, Homo sapiens
  misc_feature: GYAE6OF02GAX9X.22.36.D03.1.454.CMB.1.raw
  modified_base (224)..(224): a, c, t, g, unknown or other
  misc_feature (224)..(224): n is a, c, g, or t
  modified_base (244)..(244): a, c, t, g, unknown or other
  misc_feature (244)..(244): n is a, c, g, or t
  modified_base (337)..(337): a, c, t, g, unknown or other
  misc_feature (337)..(337): n is a, c, g, or t
tcagacatacgcgtcacgaccggtgctcgatttagctgcgtcacggtagtctctcgttggggggggtctcaggaggcagcgctctcgggacgtctccaccatggcctgggctcgtgctattcctcaccttcctcactcgagggcacgagggtcctgggcccagtctgccctgacccagcctgcctccgtgtctggatcatctgacagtcgatcagctatttccngcacgtggaccaacgtagtnactagttcgggttctttgacttctcgttctaccgtcggtaaccaaacaaccgacccacggaccccaaacccccccatccaatcctaatttacngggttcgactactccggttcggcccttacgacggggtatcctcgtcctaatcgtccttacgtacgcgggacctaccgtaagtcgtacggaaccaaaccgtcccggacccttaccctaaactactccgtcgtccgggtaccttacgtacgggtttaggaaccgggtacgtaacggtttcctttaaaacgtttactttaaccgttgaaccgttttaacggtttaacccgtttttaaaagttaccgggtaccgttaaccctaaccggtttcccggttacggttttcggggttttacgggaccgggtaagtaccggaccgtaaacggttccggaacccggttccgttacggaacgtaccgaccgtacggctcccggtaccccgttacggtacctaccggtcttcccccgg

SEQ ID NO: 130625 - DNA, 614 bp, Homo sapiens
  misc_feature: GYAE6OF02G5ER6.22.36.D03.1.454.CMB.1.raw
  modified_base (170)..(170): a, c, t, g, unknown or other
  misc_feature (170)..(170): n is a, c, g, or t
  modified_base (210)..(210): a, c, t, g, unknown or other
  misc_feature (210)..(210): n is a, c, g, or t
  modified_base (366)..(366): a, c, t, g, unknown or other
  misc_feature (366)..(366): n is a, c, g, or t
  modified_base (563)..(563): a, c, t, g, unknown or other
  misc_feature (563)..(563): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccngcctgcctccgtgtctggatcatctggacagtcgatcganctactttcctcgcaccgtcgggaaccaacgtgtacgactagtttggggtcttttcgacttctgttctccgtcggtaccaacaaccacccacggacccaaaccccccaactacactctattatcggtctcactcgttcgcctacgaggctctctacnctcgtcttctcgtacgctacacgtcgtacgacgactaccggtcctacctaacctctctccgtcggtccgtacttcggttacgacggtacgtacgttacttactattacgtcgtacgtactttacttaaagtcgacctcgttacttccttggttcggttaacggtcggtaacgcgtaacgtcgtaccgtaccggttcncggttcacggaccctgtcgacccggttcccgacggtccttcgtctaccccg

SEQ ID NO: 130626 - DNA, 795 bp, Homo sapiens
  misc_feature: GYAE6OF02JPPNF.22.36.D03.1.454.CMB.1.raw
  modified_base (215)..(215): a, c, t, g, unknown or other
  misc_feature (215)..(215): n is a, c, g, or t
  modified_base (240)..(240): a, c, t, g, unknown or other
  misc_feature (240)..(240): n is a, c, g, or t
  modified_base (355)..(355): a, c, t, g, unknown or other
  misc_feature (355)..(355): n is a, c, g, or t
tcagacatacgcgtcacgaccggtgctcgatttagctgcgtcacgatctctcttggggggggtctcaggaggcagcgctctcgggacgtctccaccatggcctggggctctgctattcctcaccttcctcactcagggcacagggtcctgggcccagtctgccctgacccagcctgccctccgtgtctggatcatctggacagtcgatcagactntttccagcacgtcgggaccaaacgngtacggactaggtttcgggttcttttgacttctcgtccttccgtacggtaccaaaccaacctaccgacggtaaccccaaaccccccaactcaactacctattagtggtcgtaccncgtccgtccgtcccgtacgacggtactccgtctacgtctccgtacttcctacgacgtctacctacgtcgtacgaccaaccgtaccggtaccctacccgtaacctcctccgtttacgggtccgtaccgttaccgttaacggttacgggtaacgggtaccgttacgttaccgtttaacctttacggttaaccttcggtaacctttaacgtttacccgttttaaaaggttaccggacccgtttaaacgtccgtttacgtttcccgggttttacgggtttcccgggttaacgggtacccgggtaccgtaaacccgggttaacgtcccggtttacccgtacccgggtttaccgtaccggttaacccggacccggttaaccgggtccccgtacccggttccccccggtaacggttacccctttccggttacccgtttaccccccgg

SEQ ID NO: 130627 - DNA, 716 bp, Homo sapiens
  misc_feature: GYAE6OF02ICC33.22.36.D03.1.454.CMB.1.raw
  modified_base (681)..(681): a, c, t, g, unknown or other
  misc_feature (681)..(681): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcgagggcacgagggtcctgggcccagtctcgccctgacccagcctgcctccgtgtctggatcatcgtggacagtcgatcagctatttcctgcacgtacgggaacccaacgtacggtagactagtttcgggtttcttttgaacctttcgtcgttccttccgtacggtaaccaaaacccaaaccgacccccgtaacggaacccccaaaaaccccccctaactaccgtaacttacctaagttttacgtacggtttacgtacctaaccgttccggtacccggccccgttacgtaagggtaccgttcctaccgtacgtacgttcctccgttctaccgtacggacccttaacgtaacggtcgtacggaacccaaccgtacccgtaccccttaaccctactactcgttcgtacggtccctcgttaaggttagaaccggacgttactactttaacgttacttatcgtaacttagttaaccttaagtcgggacctaccgtccttgtccgtttagttccggggagaacgctacggagtccgtaccgtcgtactcgaccnccgagtcccaccgcccgttctcgacttcgtacccg

SEQ ID NO: 130628 - DNA, 791 bp, Homo sapiens
  misc_feature: GYAE6OF02ISG8T.22.36.D03.1.454.CMB.1.raw
tcagacatacgcgtcacgaccggtgctcgatttagctgcgtcacgatctctcttggggggggtctcaggaggcagcgctctcaggacgtcaccaccatggcctgggctctgctcctcctcagcctcctcactcagggcacagggtcctgggcccagtctgccctgactcagtcctccctccgcgtccgggtctccgtgacagtcacgtcaccatcctctcgcacgtacggaaccagcagtgtacggttggtaggttataactagtcgttccgtacctaggtaacccaaacgaaccacccgaaggaccaaacgtacccccaaaacttcagtacgtatttacgaggtacggtaccaacggttaacggcccggtaccgtaccgggtacgggggttcccctaggtaccgttccgtaccgtttctaccggtcggtccctaaccgtaacggttccggtacgggtacccgaccggtaaccccgggtcccttacccgggtaccggtcccggttacgtccggtacggggtcccttaccggacgggtccgtagggaaccgggtgtacggggtacccggtcgttagttaagttttccgttaaccgtcggttaaccttacctagttaacttacggcgtacgtacgggtacgtaccgtttacggttcggtttacgggggttgggtacccgggggtcggaaccggggtacccgaacggtacccggttacgtacccgggttaaccgttaccgggaccgtaccggtacccggacggttacccgtccccccgggtacccgttaccggg

SEQ ID NO: 130629 - DNA, 598 bp, Homo sapiens
  misc_feature: GYAE6OF02HI663.22.36.D03.1.454.CMB.1.raw
  modified_base (220)..(220): a, c, t, g, unknown or other
  misc_feature (220)..(220): n is a, c, g, or t
  modified_base (235)..(235): a, c, t, g, unknown or other
  misc_feature (235)..(235): n is a, c, g, or t
  modified_base (306)..(306): a, c, t, g, unknown or other
  misc_feature (306)..(306): n is a, c, g, or t
  modified_base (348)..(348): a, c, t, g, unknown or other
  misc_feature (348)..(348): n is a, c, g, or t
  modified_base (358)..(358): a, c, t, g, unknown or other
  misc_feature (358)..(358): n is a, c, g, or t
tcagacatacgcgtcacgaccggtgctcgatttagctgcgtcacgatctcctcttggggggggtctcaggaggcagcgctcgtcgggacgtctccaccatggcctgggctctgctattcctcacctttcctcactcagggcacagggtcctgggcccagtctgccctgacccagcctgcctccgtgtctggatcatctggacagtcgatcagcatttccngcactgggaccaacngtgacagttggtcttttgactctgtctcctggtaccaacaacaccaggccaaacccccactcatcatttanggtgtcactcgtcggcctcaggacgtctctcatcgcttctcngcctcagtcncggcacgaccgctcccacactctctcgggcttccagtttcgaggacgagttacttacttattacgtgtctacgtttacctttaaagtcggtcctccgtacttccgttcggttcggttttccggcggtacgtaccgtaccggacgttcggtacccggtccgttccggtaccgacggtaccccgtaacggtcccgttacccggtcccccgttaccggtaccgtaccgtcccgttaccccggg

SEQ ID NO: 130630 - DNA, 637 bp, Homo sapiens
  misc_feature: GYAE6OF02IV9R8.22.36.D03.1.454.CMB.1.raw
  modified_base (218)..(218): a, c, t, g, unknown or other
  misc_feature (218)..(218): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctcgccctgacccagcctgccctcgtgtctggatcatctggacagtcgatcagctacttcgngcacgtcggaccactgtcgatgttcgtcttgctctctcctcgtacgacacaccaccgacgaccccaacccctatcatactattcgtgtctctctcgcgcctcgagtctctctagctctctcgactcgtccgtcgtacgtcgacgaccgtaaccgccgtacctaccgtacctcgtccgtcgtacgtacctaggtacgttacggagtacgtaccgttacttacgtattaccgtacttaccgtttaacgtttaaccgtaacggtcgtaccctacgtttccgtttcggttaccgggtttcggtacgggtaccgtaccggacgttaaccggtcggttaccgtcccggttaccggactccggtaaccgccggttacgtcccgtccccggttcgtacccgtacccgttcggttaccccctccccgg

SEQ ID NO: 130631 - DNA, 745 bp, Homo sapiens
  misc_feature: GYAE6OF02H6LQ7.22.36.D03.1.454.CMB.1.raw
  modified_base (222)..(222): a, c, t, g, unknown or other
  misc_feature (222)..(222): n is a, c, g, or t
  modified_base (235)..(235): a, c, t, g, unknown or other
  misc_feature (235)..(235): n is a, c, g, or t
  modified_base (276)..(276): a, c, t, g, unknown or other
  misc_feature (276)..(276): n is a, c, g, or t
  modified_base (311)..(311): a, c, t, g, unknown or other
  misc_feature (311)..(311): n is a, c, g, or t
tcagacatacgcgtcacgaccggtgctcgatttagctgcgtcacgatctctcgttgggggggtctcaggaggcagcgctctcgggacgtctccaccatggcctgggctctgctattccgtcaccttcctcactcgagggcacagggtcctgggcccagtctgccctgacccagcctgcctccgtgtctggatcatctggacagtcgatcgagctactttccngcacgtggaccangtgactagttcggtctttgactctgtctctgtaccaacacnccaggaccaaacccccaatcactctattactggtntccactccgtcgccctgaggtactctcgtcacgtcgtcttctcgacgtcctacgaagttcgacggacaaccgtccgggtccctaccctaacactccgtacgtcggtccttaccgtagtttacgacgggtaccgtaggttaccttaacttttacgttacgttaccggtactttaaccggtttaccgttttaaaacggttccggtacccgtacccgtttaccgttccggtttaccgggtttttcgggttttcccgggtaacggggttaaccggtacccggtaacccgggttaacggtttcccgggtacccggtttaacccggttccccgggtaaccgtaccccgggttaaccccggtaaccggttccccgggttacccgggtaccccccgtttaccggggttaccccttacccggttccccgtttaaccccccggg

SEQ ID NO: 130632 - DNA, 768 bp, Homo sapiens
  misc_feature: GYAE6OF02G0YOI.22.36.D03.1.454.CMB.1.raw
  modified_base (325)..(325): a, c, t, g, unknown or other
  misc_feature (325)..(325): n is a, c, g, or t
tcagacatacgcgtcacgaccggtgctcgatttagctgcgtcacgatctctcgttgggggggggtctcaggaggcagcgctctcgggacgtctccaccatggcctgggctctgctattcctcaccttcctcactcagggcacgagggtcctcgggcccagtctgccctgacccagcctgcctccgtgtctggatcatctggacagtcgatcagctatttcctcgcgacgtacgggaaccaaagagtagactagttgggttacttttgacttctcgtctccgtacggtaaccaaacaaccacccacggaaccccaaaacccccaanctaactactatttaagtcggtcgtaccacgttccgccggccctacgacggtacttctcgtactagtcgttcttccacgacggtcctacgtaacgtcgttacggacctaaccgacccggtaccctaccctaacacttaccgtcgtacgggtccttaccgttaggtttacggaagggtaaccgtacgtttaccgttaacttttacgttacgtacgttacgttaaccttttaaaccgtttaaacgttaccgggtaccgtacccttaacgttccgtttacgggtttcggtttacgggaccggggtaacgtaccgtaccccgggtaaggttcccggttaacccggttaccgggtttccggaaaccgtacccgggtaacccgttaaccgggtcccgttacccgggtcccccggttacccggttacctacccggttcccgttacccccgg

SEQ ID NO: 130633 - DNA, 933 bp, Homo sapiens
  misc_feature: GYAE6OF02FFAHY.22.36.D03.1.454.CMB.1.raw
tcagacatacgcgtcacgaccggtgctcgatttagctgcgtcacgaggtcgtactcgtggggggtctcgtaggacggcaggaccgctcgtacgggaccgtctccaccgagtcggtcctcgggtcctctgcttacttcctcgaccttccacgacgtcgacgggactaacggtcggtccgtcgggacccagttcttcgccgtaccgacccgtagtccttcggccctcgtaggtcgtacggacttccacgtcgtacgacgtacgcggtactacgacgtcgttacgtttcgacgaccgtacgtacggtaacctaccgtaggtaaccgtagttacggttcggttccttacggaccttcgtcgtccgtacgtaccgtaccaacgtaaccgaccgtacgtaaccctaaccccgtagttacctaacgtacgttacgttacgtaccggtacgtaccgtaccgggtacgtacccggttaccgtacggtaacgggttccgtacgttaccggtacgttaaccgggtccggtaacgttcccgtttaccggaccggttacccgtaaccgtaacgttaccgtaaacccggtaacccgtaaaccccggttaccccggttaaccctaacccgtaacccgttaccggtaccggttacccgggttaccgggttaccctttaaccgggtaacgggtttaaccggtacggtaaccgtaaccgttttaccgtaacgttaccgttacgtaccgttaaccggtttaccgttttaacccggtacggtttaccgtccggttaccgttaccggttcggtttacgggttaaccgggtcgaaacgggtccttaaccggaacccggttagaccggtccggtaaccggttacggaacctccggtacctttaaccggccgtttacccgtaccggttacctcccgttaccggtttcccctaacccg

SEQ ID NO: 130634 - DNA, 901 bp, Homo sapiens
  misc_feature: GYAE6OF02GP6A4.22.36.D03.1.454.CMB.1.raw
  modified_base (234)..(234): a, c, t, g, unknown or other
  misc_feature (234)..(234): n is a, c, g, or t
tcagacatacgcgtcacgaccggtgctcgatttagctgcgtcacgatctctcttgggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcactgggaaccaanagtgactagttgggtcttttgactctgtctctaggtaccaacaacaccacggacccaaaacccccccaatccatacctaattttactggtactactaccgttaccggtacccggtccctacgtacggacgttcctaccttacacgttccgtacgtttcctcgtaacgggtccctaaccgtaacggttccgtcggtaacccgaaacccgtaccccgggtaccccttaacccctaaaccctaccgtttacccgttacgtcggggttaacccttacccggttaaggttttaaccgggaaacgggtaaacccggttaacggtttaacccttaaaccgtttttaaacgttttaaccgtacggttaacccttttaaacgggttttttaacccttttaaaaaacgggtttccgggaacccgttacccgttttaaaccgttcccggttttacgggttttaccggggtttttaccggggaccgggtaaaccgggtaccgtaaacccggttaacggggtcccggtttaacccccgggttcccgttaaccgggttaaccgtaaaccccgggttaacccccgggtaaaccgggttaccccgttacccccgggttaaccccccccggtttaacggggtacccctttaacccccggtttcccggtttttaaccccccccgg

SEQ ID NO: 130635 - DNA, 724 bp, Homo sapiens
  misc_feature: GYAE6OF02FLTNF.22.36.D03.1.454.CMB.1.raw
  modified_base (355)..(355): a, c, t, g, unknown or other
  misc_feature (355)..(355): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgccacgtcgggaccaacgagtcgactagtttggggttcttttcgacttctgtcctcgttacggtaccaaaccaacacccgacggacccaaaacccccccaatccatctatttagtggtgtcacgtcgtccggccctnaggctctctcactcgtctttccgacgtacggtccttacccgaagtcgtacggaccaaccgacccgggtccctaccccgtaaacctcgttccttcggtcgggtccttaccgtaggttttcggaacgggtaccgtacgttaccttaaactttactttaccgtcgtacgttaaccgttttaaccgttttaaacgttccgggtaccttacccgtacctttccggtttaccggttttgggttttacccgggacggtacggtacccgtaacggtacggtccgtacccggttccgttccgggtaccaccggtaccccgtaacgggtcccttacccgggcccccgttaacggttcccgtaccttcccgttaccccgg

SEQ ID NO: 130636 - DNA, 579 bp, Homo sapiens
  misc_feature: GYAE6OF02FG64D.22.36.D03.1.454.CMB.1.raw
  modified_base (232)..(232): a, c, t, g, unknown or other
  misc_feature (232)..(232): n is a, c, g, or t
  modified_base (350)..(350): a, c, t, g, unknown or other
  misc_feature (350)..(350): n is a, c, g, or t
  modified_base (386)..(386): a, c, t, g, unknown or other
  misc_feature (386)..(386): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacngtgacattgggtcttttgactctgtctcctggtaccaacaacacccacggcaaacccccccaactcactcatttatggtgtcactcgtcggccctcaggagtctctcatcgcttctcnggctccaagtctggcaacacgcctcctaacatctcncgggcctccagtttgaggtacgagttcttacttacttactgtctagtttacctttaaagttcggacgtccctacgttcttcgtttgggttttccggcggtacggaccgaccggtagtcggacccggttcccgtaccgggtccacgacccgaaggcctccggccccccgttcggtccctaccgttcctaccccg

SEQ ID NO: 130637 - DNA, 633 bp, Homo sapiens
  misc_feature: GYAE6OF02H6AYP.22.36.D03.1.454.CMB.1.raw
  modified_base (221)..(221): a, c, t, g, unknown or other
  misc_feature (221)..(221): n is a, c, g, or t
  modified_base (238)..(238): a, c, t, g, unknown or other
  misc_feature (238)..(238): n is a, c, g, or t
  modified_base (309)..(309): a, c, t, g, unknown or other
  misc_feature (309)..(309): n is a, c, g, or t
  modified_base (380)..(380): a, c, t, g, unknown or other
  misc_feature (380)..(380): n is a, c, g, or t
  modified_base (411)..(411): a, c, t, g, unknown or other
  misc_feature (411)..(411): n is a, c, g, or t
tcagacatacgcgtcacgaccggtgctcgatttagctgcgtcacgatctctcttggggggggtctcaggaggcagcgctctcgggacgtctccacatggcctgggctctgctattcctcaccttcctcactcgagggcacagggtcctgggcccagtctcgccctgacccagcctgcctccgtgtctggatcatcgtggacagtcgatcagctactttccngcacgtgggaaccaagngtgactagttggtctttgactctgtctcgtcgtaccaacacaccagacccaaaccccatcatactattacngtcgtcacgtcgtcgccctacgagtacgtcttctcacgttccgtcttcctcgacggtcctacctaggtccncggacctaaccgccggtcccctaccctaacncttaccgtcgtcggcctcgttagttcggacgacgtataccttatactcgtctcttacgttaccgtttaagtccggacctccgtacgttcgttcggttttcggttaccggaggtaccgtacgaaccggttagtacccggtcccgtaccgttaccggaccgtaccggtaccgtacggttcccgaccggttcccccggttagtccctaccgttccgttcccccgg

SEQ ID NO: 130638 - DNA, 728 bp, Homo sapiens
  misc_feature: GYAE6OF02JEHRS.22.36.D03.1.454.CMB.1.raw
  modified_base (219)..(219): a, c, t, g, unknown or other
  misc_feature (219)..(219): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacgagggtcctgggcccagtctgccctgacccagcctgcctccgtgtctggatcatctggacagtcgatcagctatttccngacacgtcgggaccaacgagtgaactagtttgggttcttttgacttcgtcgtacctccgtaggtaaccaaccgaaccacccgaacggtaaccccaaaacccccctataccactactatttagtcggtactccacgtcggttccggaccctcgtaacggtcttctctactactcgtccttctacgacggtcctaccgtaacgttccgtacggtaaccaacccggaccgtaccctacctaacctcttccgttcgtcgggtccttaccgtaggtttacgaccgggtacgtaacgttccgttaactttacgttactacggtaccgttacgttttaaccgttttaaagtccggtaccgtccttaacgttccgttcggtttacggtttacggcggaaccgtaccgttaccggtagttaccggaccgttccggtaacggttacccaccggaacccggttaacggtcccgttacccggtcccccgtttacgggaccctaccgtttaccgttcccccg

SEQ ID NO: 130639 - DNA, 759 bp, Homo sapiens
  misc_feature: GYAE6OF02GZX1S.22.36.D03.1.454.CMB.1.raw
  modified_base (319)..(319): a, c, t, g, unknown or other
  misc_feature (319)..(319): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcactacgggaccaacagtgactagtttgggtacttttgactctgtctcctggtaccaacacatccacggacccaaaccccccactccatactattatgtntcactccgtcgtccctgagctctctcactctcttctcacggtcctaccgtaagtccgtacggaccaacccgtacccggtaccccctaccctaaaccctacgttcccgttccggtaccgggtcccttaccgtaaggtttacgggaacggtacccggttaacgttaccgtttaaacgttttaccttaccgttacgtaccgttaacggtttttaacccgttttaaaaggttaccgggtacccgtacccctaaccgttttccggtttaccgggttttccggggttttccgggaccggggtacggtacccgtaaccgggttaaccggttccggttaccccggttacccggttaccgggtaccccgaaaccgggtacccccgtaacgggttccccgtaaccccggttccccccggttcccggttacccgtaaccccgtttccccgg

SEQ ID NO: 130640 - DNA, 704 bp, Homo sapiens
  misc_feature: GYAE6OF02I7N19.22.36.D03.1.454.CMB.1.raw
  modified_base (217)..(217): a, c, t, g, unknown or other
  misc_feature (217)..(217): n is a, c, g, or t
  modified_base (379)..(379): a, c, t, g, unknown or other
  misc_feature (379)..(379): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacgagggtcctgggcccagtctgccctgacccagcctgcctcgtgtctggatcatctggacagtcatcagctatttccngcacgtcgggaccaacagtcgactagttcggggttcttttgacttcttgtccttcctaggtaccaacaaccacccgacggacccaaaccccccactcctactctatttagtcggtgtcctacgttcggtccgccctcgaggtactctctctatccgtcttcncgtacgtcctacgtacgtctcggaccaaccgacccggtcccctacctaacctacttcgtccgtcggtccttaccgttacgtttacgacgggtacgtaccgttaccttaacgtttacttaccgttgtaccgttaccgtttttaaccttaaggttaccggtacccgtcccgttaccgttaccggtttcgggtttaccgggttttccgggaccggttacggtacccgtaccggtacgttccggtacccgttccggttaccggtacgacccgtacccgaacggttccctacccggtaccccgttacggtccctaccgttccgttccccg

SEQ ID NO: 130641 - DNA, 705 bp, Homo sapiens
  misc_feature: GYAE6OF02G06D5.22.36.D03.1.454.CMB.1.raw
  modified_base (329)..(329): a, c, t, g, unknown or other
  misc_feature (329)..(329): n is a, c, g, or t
  modified_base (376)..(376): a, c, t, g, unknown or other
  misc_feature (376)..(376): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacgagggtcctgggcccagtctgccctgacccagcctgcctccggtgtctggatcatctggacagtcgatcagctatttcctgccacgtcgggaaccaacagtagactagtttggggttcttttgactctgtctcctacggtaaccaacaaccacccgacggaccccaaaccccccatcactctatttacnggtacgtcacgttcgccggtcctgaggtcgtctctcactcgtcttcncgtacggtctaccgtaagtccgtagaccaaccgtaccggtaccctacccgtaactactcgtcgtcggtacctcgtaggttcgacggtacgtagtacttaacttattacgtcgtacttaactttacgtttaaacgttccggtacctccgtaccgttcggtttaccggttcgggttttaccgggcggtaaccggtacccgtaacgggttaccgggtaccggtacccgttccgggttaccggttaccgaaccggtaccccggtaaggttccccggttacccggaccccccggtttaccgggtacccgttacccgtttccggttaccccccgg

SEQ ID NO: 130642 - DNA, 512 bp, Homo sapiens
  misc_feature: GYAE6OF02FY98P.22.36.D03.1.454.CMB.1.raw
  modified_base (324)..(324): a, c, t, g, unknown or other
  misc_feature (324)..(324): n is a, c, g, or t
  modified_base (334)..(334): a, c, t, g, unknown or other
  misc_feature (334)..(334): n is a, c, g, or t
  modified_base (339)..(339): a, c, t, g, unknown or other
  misc_feature (339)..(339): n is a, c, g, or t
  modified_base (357)..(357): a, c, t, g, unknown or other
  misc_feature (357)..(357): n is a, c, g, or t
  modified_base (368)..(368): a, c, t, g, unknown or other
  misc_feature (368)..(368): n is a, c, g, or t
  modified_base (372)..(372): a, c, t, g, unknown or other
  misc_feature (372)..(372): n is a, c, g, or t
  modified_base (379)..(379): a, c, t, g, unknown or other
  misc_feature (379)..(379): n is a, c, g, or t
  modified_base (384)..(384): a, c, t, g, unknown or other
  misc_feature (384)..(384): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctctgtaccaacaacacccaggccaaacccccaatcatcatttatgtctcactcgtcgccctcaggntctctcatcncttcncagctcaagtctgcaacncgcctctaacntctntggctcngttgngacagtactattacgttactgctacgtttactttaagtagccgtacctacttcgttacgttggtttcgcggtagacaccgagtacgaccgtcgtcgtcacgccaagtctcgcccctgtctactctccg

SEQ ID NO: 130643 - DNA, 659 bp, Homo sapiens
  misc_feature: GYAE6OF02GN61M.22.36.D03.1.454.CMB.1.raw
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcgagctatttcctgcacgtcgggaaccaacgagtgacagttgggttcttttgactctgtctcctggtaccaacaacacccacggaccaaaccccccaactacactacatttactggtctacactcgtccgccctcgaggtcgtctctcatcgtcttctcagctactagtctggacaaccgaccggtccctaccctaacactctacgtcgggcctaccgtagttcggacggtaacgtacgttaccttaacttactttacgtcgtctaacgttttacctttaaacgttcgggtacctaccctacgttccgtttcggtttacgggttttccggacgggtaacggaccgtaaccggaggttaccgtacccggttcccggtaccggtccggaaccgtacccggtaacgtccgtacccggtacccccgttcggtacccgtaccgttaccgttcccccgg

SEQ ID NO: 130644 - DNA, 643 bp, Homo sapiens
  misc_feature: GYAE6OF02JHALQ.22.36.D03.1.454.CMB.1.raw
  modified_base (234)..(234): a, c, t, g, unknown or other
  misc_feature (234)..(234): n is a, c, g, or t
  modified_base (271)..(271): a, c, t, g, unknown or other
  misc_feature (271)..(271): n is a, c, g, or t
  modified_base (320)..(320): a, c, t, g, unknown or other
  misc_feature (320)..(320): n is a, c, g, or t
  modified_base (347)..(347): a, c, t, g, unknown or other
  misc_feature (347)..(347): n is a, c, g, or t
  modified_base (367)..(367): a, c, t, g, unknown or other
  misc_feature (367)..(367): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcacgtgggaccaacgngtgactagttggtcttttgactctgtctctgtaccanacaccagaccaacccccatcatcattatgtcgtcactcgtcgccctacnggtatctcgcatcgtcttctcgagtcncctaagtcgtacgctaaccnccggtccctacccgtaacctactactccgtccgggtcctccgtagtttcggacggacgtacgtaccttaccgtttattactcgtcttaacgtttacctttaaagtttcgaccgtaccttaccgttaccgtttccgtttcgggttttccgggtacggtaccggacgtaccggtacggttacggacccgttcccggttaccggtaccgaccggtacccgtaaccggtcccgtcccggtcccccgtaccgggttacccttccgtaccgtttaccccccg

SEQ ID NO: 130645 - DNA, 717 bp, Homo sapiens
  misc_feature: GYAE6OF02IJ9MR.22.36.D03.1.454.CMB.1.raw
  modified_base (232)..(232): a, c, t, g, unknown or other
  misc_feature (232)..(232): n is a, c, g, or t
  modified_base (251)..(251): a, c, t, g, unknown or other
  misc_feature (251)..(251): n is a, c, g, or t
  modified_base (465)..(465): a, c, t, g, unknown or other
  misc_feature (465)..(465): n is a, c, g, or t
  modified_base (560)..(560): a, c, t, g, unknown or other
  misc_feature (560)..(560): n is a, c, g, or t
  modified_base (638)..(638): a, c, t, g, unknown or other
  misc_feature (638)..(638): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacgagggtcctcgggccctagtctcgccctgacccagcctcgccctcgtgtctggatcatcgtaggactacgtacgactcgagtctactttccngcacggtacggaaccaagngtacgacgttaggtttcgggttacttttacgacttcgttcggttccgttccgtaacggtaaacccaaacgaaacccacccggtaaccggaacccccccaaaacccccctattacctaacgttaccttaagtttacgtcggttacctacctacccggttcggtcccgacccgtaggtacggttacttccgtactacctacgttccgttcttaccncgaaccgttcctacgtacgtcgtaacgacctaccgtacccgtaccctaaccctactacgtccgtcgtcggtaccctgttaacggttcggaacgtntacgttacttacgttacttacgtagtacttacgttacttaagtccggacctccgtacttcggttacggttcgtacggngtaccgtacgacgtcgtacgtcccgtctcgtcgaccgtccgagcccgttccgacccgtctaccgttcctacgttccccg

SEQ ID NO: 130646 - DNA, 729 bp, Homo sapiens
  misc_feature: GYAE6OF02G0PYQ.22.36.D03.1.454.CMB.1.raw
  modified_base (225)..(225): a, c, t, g, unknown or other
  misc_feature (225)..(225): n is a, c, g, or t
  modified_base (239)..(239): a, c, t, g, unknown or other
  misc_feature (239)..(239): n is a, c, g, or t
  modified_base (279)..(279): a, c, t, g, unknown or other
  misc_feature (279)..(279): n is a, c, g, or t
  modified_base (305)..(305): a, c, t, g, unknown or other
  misc_feature (305)..(305): n is a, c, g, or t
  modified_base (309)..(309): a, c, t, g, unknown or other
  misc_feature (309)..(309): n is a, c, g, or t
tcagacatacgcgtcacgaccggtgctcgatttagctgcgtcacgatctctcttggggggggtctcgaggaggcgtaggcgctcgtcgggacgtctccaccatggcctgggctcgtgctattcctcaccttcctcactcgagggcacagggtcctgggcccagtctgccctgacccagcctgcctccgtgtctggatcatctggacagtcgatcagctatttccngcactgggaccaangtgactagttggtcttttgactctgtctctgtacaacacnccagccaaacccccatcatctattanggtntcactcgtccgcctgaggtactctctcatccgtcttcctacgacggtcctaacctaaggttcctagggaccaaaccgtaccgggtaccccttaccccgtaaacctacgttccgttaccgtccggggtacccttaccggttaaggtttacggaacgggtaaccgttacggttacccttaaacttttaacgtttacctcggttaccttaaacggtttttaccttttaaaaggtttccggacccgttaacccgtaccgtttccggtttaccgggttttcggggtttttacccgggacgggttaaccggccgtaacccggttaaggtccgtaacccggttccggttaccggtaccgaccgtacccgtaacggtcccgttacccggtcccccgttccgggtaaccttcccggtccgtttcccccg

SEQ ID NO: 130647 - DNA, 681 bp, Homo sapiens
  misc_feature: GYAE6OF02FHQUU.22.36.D03.1.454.CMB.1.raw
  modified_base (241)..(241): a, c, t, g, unknown or other
  misc_feature (241)..(241): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctcgccctgacccagcctgcctccgtgtctggatcatctggactaggtcgatcaagtctatttcctgccaacgtgggaaccaanagtgaactagtttgggttctttgacttctgttcctccgtacgaccaacaaccaccgacgacccaaacccccatcatctattacgtgtctacacgtccgtcggcctgacggtactctctctagttccgtcttcgttcgtcggtaccctacgtaacgtcgttacggacctaacccgtccgtcccgttcccgtacgtcccgtcgttcgcgggtcctacggagggtcgtacggaggtacgtaggtacggtcttaaggtaactttactacgtcggactagtctactaggttaagtcggtaccgatacggtacttaacgtttacggtttgggtaaccggttacggggaacgggaaaccggtaaccgtaccggttaggttaaccccgggtaccggtttaaccggtaccggttaaccggaccccggtacccggtaaccgttccccggg

SEQ ID NO: 130648 - DNA, 809 bp, Homo sapiens
  misc_feature: GYAE6OF02HVFOI.22.36.D03.1.454.CMB.1.raw
tcagacatacgcgtcacgaccggtgctcgatttagctgcgtcacgatctctcttgggggggggtctcaggaggcagcgctctcggggacgtctccaccatggcctgggctctgctattcctcaccttcctcactcagggcacagggtcctgggcccagtctcgccctgacccagcctcgcctccgtgtctggatcatctggacagtcgatcagctatttcctgcacgtacgggaccaactaggtgactagtttgggttcttttcgacttctgttccttccgtacggtaaccaaaccaaaccgacccgaacggtacccccaaaaccccccactacctaacttaccttaagtttacgtcggttcgtaccaccggttccggttccggacccttcggaacggtacgttcctcgtacctacgttccgtccttactccgtacggtccctacctaacggttcgtaccggaccgtaaccgtacccgggtacccttaacccgtaacctacgttacccgttacccggtcgggtaccccttccggttaacgggtttacgggaacgggttaaccgggttaactttacccgtttaaacggttttaacctttaccgtcgttacgtttaacttttaaacccgttttaaggtacccgtaccgtacccttacgtttaccgttcgggttttccgggtttaccgggaccggttacggtaccgtaaccggtaacggtccggttacccgggttcctccgggtaacgtccggacccggtacggtcctacccgggtcccccgtcgttaacccgtccttacccggttccccgg

SEQ ID NO: 130649 - DNA, 619 bp, Homo sapiens
  misc_feature: GYAE6OF02F8HDY.22.36.D03.1.454.CMB.1.raw
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcagtcaccatctcctgcactggaaccagcagtgacgttggtgttataactatgtctctggtaaccaacaacacccaggacaacgaccccaaactcatgatttatagagtacaacgtaagccggtcccctagacgggtccctaggactcgactttctcgtcggacctaccgtaaagtctggaccaaccgaccggtcccctcccgtggaacccgttcctcgtcgggccttacccggaggtcgtaggaaggtatcggaaggcttagtaactttacgttacgtgcgagcctacaagtagtagggagcaacgacgtaataacgttttgggtcggtttaccggacggggtaacgggaacctaaggaccgttacggaaccccgttcgtaaccgggtcaaccggacccgtaaggccctaccccgg

SEQ ID NO: 130650 - DNA, 1196 bp, Homo sapiens
  misc_feature: GYAE6OF02GNPG9.22.36.D03.1.454.CMB.1.raw
  modified_base (220)..(220): a, c, t, g, unknown or other
  misc_feature (220)..(220): n is a, c, g, or t
tcagacatacgcgtcacgaccggtgctcgatttagctgcgtcacgatctctcttgggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctactttccngccacgtacgggaacccaacgtagtgaactagtttgggttcttttagaccttacgttcggttccttccgttacgggtaacccaaaccgtaaacccaaccccgtaaccgggaacccccaaaaacccccccccgaactttaccctaacttaccgttaattttacgttacgggttaccgttacctaacccgttccgggttaccccggaccccgttacggaacggggttaaccttcccttaccgtaccttaaccgttcccgttaccctttaccgttaccgtaccgggtacccttaacccggttaacgtttcccggtaaacggtaacccgtaaaacccggtacccccggtttaacccccgtttaaccccccgtaaaacccgttaacccgtttaccccggtttacccggggtttaacccgggggttacccccgttttaacccgggtttaaccggggttttttaaacggggggacccggggtaaaacccgggttaccggggttaaacccctttttaaacccggtttttaaaccgtttaacccgggttaccgggtttacccgttttaaaacccgggtttttttaaacccgtttttaaaaaccggggtttacccggggtaacccccttaaccccgggttttaaaccccggttttacccggtttttaccgggggtttttttacccgggggggttttttaaaccccggggaccgggggtttaaaaccccgggggggttaacccccgtttaaaacccggggggtttaacccggggtttaacccccggggtttaaccccccggggtttttaccccccggggttttaaccggggttaaacccccgggttaacccccggggtaaccccccggggtttaaaccccggggttcccccgggtttaaaccccccccggggtttaccccccccgggttaccccgggggttttaaccccccgtttaaccccccgggtttttacccccggggttttaa

SEQ ID NO: 130651 - DNA, 718 bp, Homo sapiens
  misc_feature: GYAE6OF02J2DAI.22.36.D03.1.454.CMB.1.raw
  modified_base (397)..(397): a, c, t, g, unknown or other
  misc_feature (397)..(397): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctactttcctgcacgtgggaaccaacgagtcgaactagtttggggttcttttcggacttctcgtcctccgtacggtaaccaaactaaccaccccgacggaccccaaaacccccccgtactacactacctatttacgtcggtacgtcctaccgttccggtaccggaccctcgacgggtacgtccttacncgtacttcgtcttctcgaggtcctaccgtaacgtcgtacgaccaacccgaccggtccctaccctaacctctaccgtcgtcgggtacccttcgtaacgtttcggaacggtaccgtacgttacgttaacttttcgttaaaccgttcgtaccgtttaacttttaacctttaaacgtacgggtccctaccttaccgtttcggttacggttttcgggttacccggacgggtacggactaccggtaacggtccgttaacccggtccgttcgactacccgaccggtacgtccgtacccgccccggttcaccgtccgtccgttaccccg

SEQ ID NO: 130652 - DNA, 565 bp, Homo sapiens
  misc_feature: GYAE6OF02HYWHT.22.36.D03.1.454.CMB.1.raw
  modified_base (321)..(321): a, c, t, g, unknown or other
  misc_feature (321)..(321): n is a, c, g, or t
  modified_base (339)..(339): a, c, t, g, unknown or other
  misc_feature (339)..(339): n is a, c, g, or t
  modified_base (356)..(356): a, c, t, g, unknown or other
  misc_feature (356)..(356): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcacgtgggaccaacgagtgactagttgggttcttttgactctcgtctcgtggtaaccaacaacacccaggacccaaacccccaactcaactcatttatggtntcactcgtcgcctcgagngtctctcatcgtcttcncacgctacgagtctggcaacgacgtcctaccctaacactctcgtggccttcgtagtttgaacggacgtagttactaacgtttattactgctacgtttacctttaaagtacgcgacctactcgtcgttgggtttcgaggacgacgacgtactcgtaccgcgtcgactacgaccgagtcccgtcgccccgttcgtactacctcgttacccg

SEQ ID NO: 130653 - DNA, 646 bp, Homo sapiens
  misc_feature: GYAE6OF02IJHDG.22.36.D03.1.454.CMB.1.raw
  modified_base (312)..(312): a, c, t, g, unknown or other
  misc_feature (312)..(312): n is a, c, g, or t
tcagacatacgcgtcacgaccggtgctcgatttagctgcgtcacgatctctcttggggggggtctcaggaggcagcgctctcaggacgtcaccaccatggcctgggctctgctcctcctcagcctcctcactcagggcacgagggtcctgggcccagtctgccctgactcagcctccctccgcgtccggtctccgtggacagtcagtccaccatctcctgcacgtacggaaccagcagtgtacgttggtagttacaagtatcgtctcgtgtaccaacaccaccagcacacgaccccaactcatgtatttagngtagtcacgtaagccggtacctcgacgggtcctagcgtccgtcttcgtcgtggtcctcgaacgtcgtacggaccgaccgccgcctccctggacccttcgtccgtcggtcctccgacggtcgtaggacggtcgtaggacggtcttagttacgtttacttacgtcgtaccttaactactagttacctcggacgtacggggaccgtacgtaaccggtttcggtttacggggtggtttaccggggacgggtaccgggaacctaaggtccggtacgtaccccgttacggtacggtacccgaccgaacccggtacggtacccgttcccggtaccccccgg

SEQ ID NO: 130654 - DNA, 784 bp, Homo sapiens
  misc_feature: GYAE6OF02IHSWG.22.36.D03.1.454.CMB.1.raw
  modified_base (262)..(262): a, c, t, g, unknown or other
  misc_feature (262)..(262): n is a, c, g, or t
tcagacatacgcgtcacgaccggtgctcgatttagctgcgtcacgatctctcgttggggggggtctcaggaggcagcgctctcgggacgtctccacatggcctgggctctgcttattcctcaccttcctcactcgagggcacgagggtcctgggcccagtctcgccctgacccagcctcgcctccgtgtctggatcatcgtaggacagtcgatccgagtctactttccgtgccgtacggtagggaaccctaagtacggttanaccgtttaggtttcggggtttacctttttcggtacttccgttcggttccttaccgtcggttaaaccccaaccaaaccgaccccgaccggaacccctaaaaccccccctaataccacttacttagtttaacgtggtttactccgtaccgttccggtccgggtaccctacgtacggtacttccgtactctacgtccgttccttcgacgtacgtccgtactacgtacgtccgaacctaacccggaccgtcccctaccgtactactcgtcgtacggtcttcgtattggacgtacgtacttaccttactttacgttactcgtaacgttcttaacgtttaaggtcgtaccggtcctacgttcgttacgggtttccgggttaccgggacggtccggtaaccgtaccgggtacggttacccggtccccgtttccggtaccggttcccgaaccggtcccgttaaccgggtccccgttacccgggtccccgtttaaccggtacccgttacccgtttacccggttcccccggg

SEQ ID NO: 130655 - DNA, 637 bp, Homo sapiens
  misc_feature: GYAE6OF02JPP2Q.22.36.D03.1.454.CMB.1.raw
  modified_base (140)..(140): a, c, t, g, unknown or other
  misc_feature (140)..(140): n is a, c, g, or t
  modified_base (168)..(168): a, c, t, g, unknown or other
  misc_feature (168)..(168): n is a, c, g, or t
  modified_base (275)..(275): a, c, t, g, unknown or other
  misc_feature (275)..(275): n is a, c, g, or t
  modified_base (300)..(300): a, c, t, g, unknown or other
  misc_feature (300)..(300): n is a, c, g, or t
  modified_base (305)..(305): a, c, t, g, unknown or other
  misc_feature (305)..(305): n is a, c, g, or t
  modified_base (324)..(324): a, c, t, g, unknown or other
  misc_feature (324)..(324): n is a, c, g, or t
  modified_base (351)..(351): a, c, t, g, unknown or other
  misc_feature (351)..(351): n is a, c, g, or t
  modified_base (355)..(355): a, c, t, g, unknown or other
  misc_feature (355)..(355): n is a, c, g, or t
  modified_base (360)..(360): a, c, t, g, unknown or other
  misc_feature (360)..(360): n is a, c, g, or t
  modified_base (382)..(382): a, c, t, g, unknown or other
  misc_feature (382)..(382): n is a, c, g, or t
  modified_base (629)..(629): a, c, t, g, unknown or other
  misc_feature (629)..(629): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacnggtcctgggcccagtctgccctgacccngcctgcctccgtgctggatcatcctaggcagtcgatcagctatttcccgagccacgtcggaaccacagtgactagttggtctttgactcgtgtctctcggtaccaanaacctaccaggacctaaaccccccntaccnctactattactggtctacncttcggtcgccctgtaggctctgtacntccntttcnccaggtccctaacgacttccgngacccgactacccggcctttaccccgaacctaccttacgtccttaacgggtctacccgtgtttacggacggtacgtacgtcgttaacttacgttacgtactccgttaagtttaccgtttaaagttcggaccgtacccttaccgttcgttacgggtttcggttcccgggagttcggaccgtaccgagtcccgtaccggtccgttacggctaaccgcccgaaggttcctccggaccctacggtctaccncgttcccg

SEQ ID NO: 130656 - DNA, 848 bp, Homo sapiens
  misc_feature: GYAE6OF02JL3N7.22.36.D03.1.454.CMB.1.raw
  modified_base (226)..(226): a, c, t, g, unknown or other
  misc_feature (226)..(226): n is a, c, g, or t
tcagacatacgcgtcacgaccggtgctcgatttagctgcgtcacgatctctcgttggggggggtctcaggaggcagcgctctcgggacgtctccaccatggcctgggctctgctattcctcaccttcctcactcacgggcacgagggtcctgggcccagtctcggccctcgacccagcctgcctccgtgtctggatcatcgtggacagtcgatcagcctatttccngctacgtacgggaaccaacgagtacgacgtagttgggtttcttttacgacttcgtcgttccgttccgtacggtaacccaaaccaaacccgtaacccgaaccggtaacccccaaaaaccccccccgtaactacctaacgttaaccttaacttttaacgtcgggttacgtcctaccgttcccggtcccggtaccctacgacgggttactaccttccgttacaccgtccgttccttcgtaccgtacggtacctaccgtaacgttccgttacgggaccctaaaccgtacccggtccccttaacccctaacccgtacgtttcccggtaccggttccggtacccgttaccgttgttaacgggacggtaacgtaccgttacgttacgttaacgtttacgtcgtacctttacgttttaaccgtttaacgtaccggtaccgttaccctacgtttacccgttaaccgggtttcgggttttccgggaccgggtaccgttaccgtaacccggtaacgggttccgtaaccccggtttcccggtttaacgggtacccgaccggtaacccggtaccggtaccccgtttaccccggtcccccgtaccgggttaacccttccggttacccgttccccgg

SEQ ID NO: 130657 - DNA, 682 bp, Homo sapiens
  misc_feature: GYAE6OF02IBFGY.22.36.D03.1.454.CMB.1.raw
  modified_base (219)..(219): a, c, t, g, unknown or other
  misc_feature (219)..(219): n is a, c, g, or t
  modified_base (236)..(236): a, c, t, g, unknown or other
  misc_feature (236)..(236): n is a, c, g, or t
  modified_base (322)..(322): a, c, t, g, unknown or other
  misc_feature (322)..(322): n is a, c, g, or t
  modified_base (326)..(326): a, c, t, g, unknown or other
  misc_feature (326)..(326): n is a, c, g, or t
  modified_base (328)..(328): a, c, t, g, unknown or other
  misc_feature (328)..(328): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggccccagtctgccctgacccagcctgcctccgtgtctggatcatctggacagtcgatcagctatttccngcacgtagggacccaangtgactagtttgggttcttttgacttctgtcctccgtacggtaccaacaaccacccacggaccccaaacccccactcactctattntgtncnctcgtcgccctgagtactctctcactcgtcttcgtcgacggtcctaccgtagtcctggacccaacgtcccgtacccctaccctaacctactccgtcgtcggccttcgtagttcgggacgtacgtacgttaccttactttacttacgtacgtacgttaacgtttaccgttttaaagtccggtaccgtaccgtaccgttccggttccggtttcgggttttaccgggacggttacggacccgtaaccggtacggtacccggtacccgttccggttaccggtacccgtaccggtaccccgtaaccggtcccgttcccggtcccccgttccggtacccgttacccttccgttcccccgg

SEQ ID NO: 130658 - DNA, 704 bp, Homo sapiens
  misc_feature: GYAE6OF02H2IIA.22.36.D03.1.454.CMB.1.raw
  modified_base (269)..(269): a, c, t, g, unknown or other
  misc_feature (269)..(269): n is a, c, g, or t
  modified_base (293)..(293): a, c, t, g, unknown or other
  misc_feature (293)..(293): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgactcagcctcgctcagtcgtccgggtctcctggacagtcagtcacatctcctacactggaaccagcagtgatgttggtgttatactatgtctctggtaccaacngcaccagacaaacgccccagactnatcatttatcgactcgtacaagttaacgcggtccctacgacggggttccctagtacgtcgcctttacgtcgtacggtcctacctaacggttctacggtaccgaaaccgtacccggccctttacccgtacgtaaaccctacgttacccgtcggttacgggcccttacccgaacgggtccgtacggtaaacgtacgttacggaacggtcgttaacgtaactttttaacgttaacctcggtaccgttagtaccttaccgttagtttcggtaacgaccggttccgtaaccgttaaccgtacgtttaggggttccggttaccgggaccgggggtaaccggtaaacccgtaaggtacccgttacgggaaccccggtttacccgtacgggttacccgaccggtaaccccggtaaccgg

SEQ ID NO: 130659 - DNA, 749 bp, Homo sapiens
  misc_feature: GYAE6OF02JGTY9.22.36.D03.1.454.CMB.1.raw
  modified_base (144)..(144): a, c, t, g, unknown or other
  misc_feature (144)..(144): n is a, c, g, or t
tcagacatacgcgtcacgaccggtgctcgatttagctgcgtcacgatctctcgttgggggggggtctcaggaggcagcgctctcgggacgtctccaccatggcctgggctctgctattcctcaccttcctcactcagggcacgngggtcctggcccagtctcgccctgacccagcctcgcctccgtgtctggatcatcgtggacagtcgatcagctactttccgtgccgacgtacggaaccaacgtagtacgacgttagtttcggggttccttttacgtacctcgttcgttccgttccgtacggtaaacccaaccaacccgaccgaaccggaacccccaaaaacccccctatccgaacttactaacgttttcgtcggtcctaaccgtccgtcgtccccggcctacggtaacggtccttacctcgtcgtacgtccgtaccgttccgttacgaccgtaccgtacgtaacgtccgtacggtaaccgaacccgtacccgtaccctaacccgttaacctccgttacttaccgggtccggtccttacggttaggttacggacgttaaccgtcgttacttacgttacgttaccggtcttacgttacgtttaacgttaacgccgtccttcctacgtttcgttaggtttccggttacggacgttacggactaccggtacgtccggtcgttccggtagtccgaaccgtaccgtacggtcccgttaccgccccgttagtccctcgttaccccgttccccg

SEQ ID NO: 130660 - DNA, 673 bp, Homo sapiens
  misc_feature: GYAE6OF02JHM5X.22.36.D03.1.454.CMB.1.raw
  modified_base (218)..(218): a, c, t, g, unknown or other
  misc_feature (218)..(218): n is a, c, g, or t
  modified_base (238)..(238): a, c, t, g, unknown or other
  misc_feature (238)..(238): n is a, c, g, or t
  modified_base (648)..(648): a, c, t, g, unknown or other
  misc_feature (648)..(648): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctcgtgtctggatcatctggacagtcgatcagctactttccngcacgtcggggaaccaacgngtagactagttcggggttctttgactctgtacctcctggtaccaactaaccacccacggtacccaaaccccccaacgtcactacctatttacgtaggtctaccaccgttcgtccggtacccctagtacggacgttcctctaccagtccgtcttacctcgacggtctaccgtaagtccgtcggacaaccgaccggtccctaccctaacctacttaccgtcgtccgggtccttacccgtaggtttcgaacggtacgtacgttaccttaacttacgttaccgtcgtactttaacgtttacctttaaagtccggccgtaccctacttccggttacggttcggtttacggcggtacgtccgaccgtagttccgacccgttcggtaccggtacaccgtaccgtagtcccggtaccncccccgtgtccctactccgttcccg

SEQ ID NO: 130661 - DNA, 557 bp, Homo sapiens
  misc_feature: GYAE6OF02G4I1C.22.36.D03.1.454.CMB.1.raw
  modified_base (359)..(359): a, c, t, g, unknown or other
  misc_feature (359)..(359): n is a, c, g, or t
  modified_base (413)..(413): a, c, t, g, unknown or other
  misc_feature (413)..(413): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacagttgggtcttttgactctgtctcctggtaccaacaacacccaggccaaaccccccactcatctattatggtcgtcactcgtccggcctcgaggagtctctcatcgcttctcagctcagtcngcacgcgcctcctacatctgtcggctcagttcgaggtacagtcttattattacngtctacgtttactttaaagtcggcctccgacttcgttcgttcggttttccggcggtagtccacgtagtcggaccgtccgtaccggtcaaccggtcccgaaggtccgttccggcccccgttacgggtcctacgtcccgttacccg

SEQ ID NO: 130662 - DNA, 760 bp, Homo sapiens
  misc_feature: GYAE6OF02HMW42.22.36.D03.1.454.CMB.1.raw
  modified_base (181)..(181): a, c, t, g, unknown or other
  misc_feature (181)..(181): n is a, c, g, or t
  modified_base (188)..(188): a, c, t, g, unknown or other
  misc_feature (188)..(188): n is a, c, g, or t
  modified_base (204)..(204): a, c, t, g, unknown or other
  misc_feature (204)..(204): n is a, c, g, or t
  modified_base (356)..(356): a, c, t, g, unknown or other
  misc_feature (356)..(356): n is a, c, g, or t
  modified_base (549)..(549): a, c, t, g, unknown or other
  misc_feature (549)..(549): n is a, c, g, or t
  modified_base (567)..(567): a, c, t, g, unknown or other
  misc_feature (567)..(567): n is a, c, g, or t
tcagacatacgcgtcacgaccggtgctcgatttagctgcgtcacgatctctcgttggggggggtctcaggaggcagcgctctcgggacgtctccaccatggcctgggctctgctattcctcaccttcctcactcgagggcacgacgggtcctgggccctagtcctgccctgacccagcctncctcgtntctgatcatcaggacngtcgatcagctacttcctgcacgtgggaaccacgtagtagacttagttggggtttccttttggacttcgtcgttcctcgttaacggtaacctaacaaaccacccgaacggtaaccccaaaaccccccaatacctacttacctagttttacgnggtacgtactaaccgttccgggtccgtacccttacggaacggttacttccgttacctacgtaccgttccgtacttcgtaccgtacggaccttaccggtaaacgtcgttacggaccaaccgtaccgtcccctacgtcgtaccgttccgtcggtacgtccgtcgaggtctacggaagtcggtaacgcgggtactntttaaacgttacgttacnccggtttaactacgtaacgtacgtaagtacgtaaccggcgggtaccgttaaaccctaacgtttcgggtttcggggttaaccggttacgggacccgggttaacgggaccgtaacgggttacctaccccgggtaaccgtttaccggtaaccgggtacgtaccccgggtaacgtacccggtcccttaacccccggg

SEQ ID NO: 130663 - DNA, 635 bp, Homo sapiens
  misc_feature: GYAE6OF02HRQQS.22.36.D03.1.454.CMB.1.raw
  modified_base (200)..(200): a, c, t, g, unknown or other
  misc_feature (200)..(200): n is a, c, g, or t
  modified_base (216)..(216): a, c, t, g, unknown or other
  misc_feature (216)..(216): n is a, c, g, or t
  modified_base (254)..(254): a, c, t, g, unknown or other
  misc_feature (254)..(254): n is a, c, g, or t
  modified_base (306)..(306): a, c, t, g, unknown or other
  misc_feature (306)..(306): n is a, c, g, or t
  modified_base (331)..(331): a, c, t, g, unknown or other
  misc_feature (331)..(331): n is a, c, g, or t
  modified_base (335)..(335): a, c, t, g, unknown or other
  misc_feature (335)..(335): n is a, c, g, or t
  modified_base (341)..(341): a, c, t, g, unknown or other
  misc_feature (341)..(341): n is a, c, g, or t
  modified_base (345)..(345): a, c, t, g, unknown or other
  misc_feature (345)..(345): n is a, c, g, or t
tcagacatacgcgtcacgaccggtgctcgatttagctgcgtcacgatctctcgttggggggggtctcaggaggcagcgctctcgggacgtctccaccatggcctgggctctgctattcctcacttcctcactcaggcacgagggtcctgggcccagtctgccctgacccagcctgcctccgtgtctggatcatctggacngtcgatcagcatttcngacactggaaccaacagtgacagttggtctttgctctntctcctggtacaacaacaccgacgacccaaacccccactcatactatttagngtagcactccgtcgcctcgagtacncgtnctatcnttcncacgtactcaagtctaggaccacgaccgccctacctaacgctctacgtcgacctcgtagttaggacggaacgtacgttaccttaactttacttaacgtccgtaacgtacttaaccgttttaaacacggtcctactaccgttcggttcgtttacgggtttacgggaccggtaacgaccgtaacggtaacgttaccgggacccgtttacggtacccggttaccgaacgtaccccggtaaacggccgttcccccggcccgttacccgggttacacccgtttccggttaccccg

SEQ ID NO: 130664 - DNA, 780 bp, Homo sapiens
  misc_feature: GYAE6OF02G87CT.22.36.D03.1.454.CMB.1.raw
  modified_base (192)..(192): a, c, t, g, unknown or other
  misc_feature (192)..(192): n is a, c, g, or t
  modified_base (222)..(222): a, c, t, g, unknown or other
  misc_feature (222)..(222): n is a, c, g, or t
tcagacatacgcgtcacgaccggtgctcgatttagctgcgtcacgatctctcgttggggggggtctcaggaggcagcgctctcgggacgtctccaccatggcctgggctctgctattcctcaccttcctcactcagggcacgagggtcctgggcccagtctcgccctgacccagcctgcctccgtgtctggntcatcgtggacagtcgatcagctatttccngcacgtcggaaccaacgagtcgacgtagttcgggttctttagacttcgtcgttccgtacgttacggaaaccctaaacgaacccaacccgaacggaacccccctaaaaacccccccctaatcctaaacttaccttaagttttaacgtacgggttcgtaccgtaaccgtttccgggtacccgtcccgtacggtaacggtaacgttccgtacgtaccgtaacgttcccggttccttaccgtacggtacgtacccttaccgtaacgtcggttacgaaccgaaccgtacccggtaccccttaacccgaactccgttaccgtcggtccgggtaccttaccgttaggtttacggaacggttacgtacgttacttacgttaacttcgtcgtaccttattttaaccgtaagttccggaccttaaccgtcgttccggtttacggttccggtttcgggacgtacggtaccgaacgggttaccgacgttacccgccggttccgacgtaacccggtaccgtacggtcccttaccccggccgttaacggtccttacccgttcgttcccccgg

SEQ ID NO: 130665 - DNA, 704 bp, Homo sapiens
  misc_feature: GYAE6OF02G3WC8.22.36.D03.1.454.CMB.1.raw
  modified_base (220)..(220): a, c, t, g, unknown or other
  misc_feature (220)..(220): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacgagggtcctgggcccagtctgccctgacccagcctgcctccgtgtctggatcatctggacagtcgatcagctactttccngccacgtcgggaaccaacaggtacgactagtttggggttcttttagactcgttacgtccttccgtacggtaacccaaactaaccacccgaacggaccccaaaaccccccctaactaccacttactaatttagtcggttacgtcctacgttaccgtcccggcccctacgacggtacgttcctctacctacgttccgtcctttaccgtaccggacggtaccctaccgtaacggttccgtacggaccgaaccgtacccggtaccccttaacccctaaccctacgtcccgttacggtcgggtccttaccgttacggtttacgaacggtacgtacgttacttaacgtttacttacgtctacgttacgtttactttaagtcgacctaccacttcgtcgttcggttcggacggtacgccacgtacggtcgtcccgtctcggactacggccgtaaggtccgtccgtcccgtcggtcctaccgtcgtaccccg

SEQ ID NO: 130666 - DNA, 934 bp, Homo sapiens
  misc_feature: GYAE6OF02GGM9N.22.36.D03.1.454.CMB.1.raw
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcacgtcgggaaccaacgaggtagactacgtttggggttacttttgaccttcgtcgtccgttaccttacgggttaacccaaaccgtaaccctaccccgaacgggtaacccccaaaacccccccctaactacctaacttccttaacgtttttacggttacgggttaccgtaccgtaacccgttccgggtaccccggtacccctacggaacggggtacgttccgttacctaccgtacgttccggtcccttttaccgtaccgtacggtaccccgttaccgtaacggtttccggtacggaaccccgtaaacccggtaccccgggtaccccttaacccccgttaacccgttaccgttacccggttccccgggttaaccgggtccccgtttaccccggttaaaggggttttcgggaaacgggttaccggttaaccgtttacgttttaaacccgtttaacgtttaccgttacgttaaccgtttaaccgtttttaaaccgtttttaaacggttaccgggtacccgttaacccttacggtttaccgtttccggggttttaccggggttttaccgggaccgggtaacgggtacccgtaaccggtaccgggtacccggttacccggttccggtacccgggttaccggaacccgtttacccggaacggttacccgtccccggttaaccccccggttccgtacccgttacccgttccgtttacccccgg

SEQ ID NO: 130667 - DNA, 865 bp, Homo sapiens
  misc_feature: GYAE6OF02JT06Q.22.36.D03.1.454.CMB.1.raw
tcagacatacgcgtcacgaccggtgctcgatttagctgcgtcacgatctctcgttggggggggtctcaggaggcagcgctcgtcgggacgtctccaccatggcctgggctctgcttacttcctctaccttcctcactcgacgggcacgacgggtccgtcggggaccctagtccgtcgtcccctacgaccccgagcccttcggcccttccggtcgtaccgttgggacttccattccgtagggactacgggttcactccgagtaccttacttttccgtgacctacggtacgggaacccaaacggtggttagaacttggtttcgggttctttacgtacttcttcgttcctcgtacggtaccaacgtaaccaccgacggtaccccaaacccccactactactactattacgtcggtactccgtaccgtccggtaccggtccctacggtacggtaccgtccttccgtactccgtccgttaccttccgtacgacccgggtacctaccgtaacggttccgtaccggtaacccgtaacccggtacccgttacccctaccctaacccgtacgttacccggttccgtacgggtcccttacccggttaagggttacgggaacggtaaccgttacggttacttaaccgtttacgttaacgtcgttaaccgttacgttttaaacccgttaagttcccgggtaccttacccgttaaccgttcggtttacccgggttttcgggtttaccgggaacgggtcgtaacccgttaccggtacggttacccggacccgggttacgttccggtaccgaacccgtaccggtaaccgttccgtccccggttacccgttacccggaccgttaccttccccggttacccg

SEQ ID NO: 130668 - DNA, 563 bp, Homo sapiens
  misc_feature: GYAE6OF02J121N.22.36.D03.1.454.CMB.1.raw
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcattcctgcactgggaccaacagtgacagttggtcttttgactctgtctcctggtaccaacaacacccaggccaaacccccaactcatcattactgtgtcactcgtcggccctcaggatctctcatcgcttctcagctcaagtctggacaacgaccggtcctacccgtaaccactctacgtgggcctcctagtttcgaaggacgagtcttacttattactgctacgttaccttaaagttcggacgtcctactcgtcgtttcggtttcgacggacggacgaccgtagtcgtaccgtaccgtcggtactacgcccgaaggtcctaccggcccccttcggtcctaccgtcttcccgg

SEQ ID NO: 130669 - DNA, 819 bp, Homo sapiens
  misc_feature: GYAE6OF02HB1ZB.22.36.D03.1.454.CMB.1.raw
tcagacatacgcgtcacgaccggtgctcgatttagctgcgtcacgatctctcgttgggggggggtctcaggaggcagcgctctcgggacgtctccaccatggcctgggctctgcttattcctcaccttcctcactcgagggcacgagggtcctgggcccagtctcgccctgacccagcctcgcctccgtgtctggatcatcgtggacagtcgatcagctactttcctgcacgtacgggaaccaacgaggtacgacgttacggtttgggtttcttttacggacttcttcggttaccttccgtaacggtaacccaaacaccgtaacccccgacggaaaccccctaaaacccccagtactaacctacttaagttttacgcgggttactccgtacttccgggtaccggtcccttacggaacgggtaccttcttacgacttaccgtacgtttcctcgttacgacggtacctacggttacgttaccggacgtaaccgaaccggtcccggtacccctttacccaaccgttaccgttccggttaaccgggtccggttaccgttacccgggtttaagggtttaccggacgggtaacgttccgtttaaaccgtttactttaacgttcgtacgttacgtttaaccgtttaacgtttaaacgtccgggtaccctacttccgttacggttcgggttttcggttaccgggacggtcgaaccggttacggtacgtcccggttaccggtccgttaccgggaccacccggtacccggttaagtcccccggttacccggtaccccgttagggttacccctcgttcccccttacccgg

SEQ ID NO: 130670 - DNA, 734 bp, Homo sapiens
  misc_feature: GYAE6OF02GJ5AX.22.36.D03.1.454.CMB.1.raw
tcagacatacgcgtcacgaccggtgctcgatttagctgcgtcacgatctctcttggggggggtctcaggaggcagcgctctcgggacgtctccaccatggcctgggctctactattcctcaccttcctcactcagggcacagggtcctgggcccagtctgccctgacccagcctgcctccgtgtctggatcatctggacagtcgatcagctatttcctgccacgtagggaaccaacagtgactagttcgggtcttttgactctgtctccgtaggtaaccaacaacacccgacggacccaaaacccccccactacactctaactttacgtggtcgtacacgttccggtccggtacccctacgaggtaacgtcctctacactcgtcttcctacgtacgcctaccgtaagtccgtcgaccgaaccgtaccggtccctaccctaaacctcgtaccttccgtacgggtaccttccgtaacggtttacggaacgggtacgtaacgttacttaactttaagtaccgttacgtaccgttaacgttttaacctttaaagttacggccgttaccaccgtttaccgttaccgggtttcgggttttccgggaccggtacggtaccgtaaccggtaacgtaccggtacccgtttccgtacggtaccgtaccggtaaccccgtacggtacccgtccggtacccccggttccggtaaccccgtacgttcccgttacccgttaccccccg

SEQ ID NO: 130671 - DNA, 765 bp, Homo sapiens
  misc_feature: GYAE6OF02IMBLH.22.36.D03.1.454.CMB.1.raw
  modified_base (228)..(228): a, c, t, g, unknown or other
  misc_feature (228)..(228): n is a, c, g, or t
  modified_base (252)..(252): a, c, t, g, unknown or other
  misc_feature (252)..(252): n is a, c, g, or t
tcagacatacgcgtcacgaccggtgctcgatttagctgcgtcacgatctctcttggggggggtctcaggaggcagcgctctcgggacgtctccaccatggcctgggctctgctacttcctcaccttcctcactcgagggccacgtagggtcctcgggcccagtctcgccctgacccagcctgccctcgtgtctggactcatctggacagtcgatcgagctactttccngacctacgtacgggaaccctaagnggtagaccgttagttttcggggtttactttacgtaccttcgttcgtccttaccggtacgtaaacccaaaccaaccgaacccgaaccgaacccccaaaacccctactacctacttacttagttagtcggtacgtacctaccgtccggtcccggtacctacggtacggtactcctcctactacgtcctccttaccgtacgtacgtcctaacgtacgtccgtacgaccctaaccgtcccgtaccctaaccctaactctaccgtcggtcgtccttacgtacgttacggaacggtaccgtacttacttaattaacgtacgtacgtacttaaccgttacgttaaacgtcgtacctaccgtccgttcgttacggttcgggttacgggaccggtacggtaaccgtaaccggtacggttaccgacccggttaccgtccggtaaccgtaacccggtacccgtaccggttcccggttaccccgttccccggtaccgttaccccgtacccgttacccggttcccg

SEQ ID NO: 130672 - DNA, 751 bp, Homo sapiens
  misc_feature: GYAE6OF02GLP6P.22.36.D03.1.454.CMB.1.raw
  modified_base (221)..(221): a, c, t, g, unknown or other
  misc_feature (221)..(221): n is a, c, g, or t
  modified_base (239)..(239): a, c, t, g, unknown or other
  misc_feature (239)..(239): n is a, c, g, or t
  modified_base (328)..(328): a, c, t, g, unknown or other
  misc_feature (328)..(328): n is a, c, g, or t
tcagacatacgcgtcacgaccggtgctcgatttagctgcgtcacgatctctcttggggggggtctcaggaggcagcgctctcgggacgtctcaccatggcctgggctctgctattcctcaccttcctcactcagggcacagggtcctgggcccagtctgccctgacccagcctgcctcgtgtctggatcatcgtggacaggtcgatcacgctactttccgngcacgtgggaccctaagngttacgaactgttgggttcttttgaccttcgtcgtctccgtagtaccaacaacctaccgacgtacccaaaccccccatccatctacttntggtgtcacgtcgtccgcctcgtaggctctctcacttcgtcttcacgacgtacctacaacggttcgtcggtaaccaaccgacccgggtaccccttaaccctaaccgtactcccttacggttaccgggtaccttacggttacggtttacggaacggtaacgtacgtttccttaaacgtttacttacgttacgtacgttaacgtttttaccttaaacggtttacggaccgtaccgtttacgttaccggttcgggttttaccgggttttacggggacgggttacgtacccgttaaccgggtaacgttcccggtaacccggttaccgttaccgggtaccgtaaccggtacccggttaaaccggttcccgtaccccggttccccggttaaccgggttcccgttacccgtttacccgtttacccccggg

SEQ ID NO: 130673 - DNA, 726 bp, Homo sapiens
  misc_feature: GYAE6OF02HMNMI.22.36.D03.1.454.CMB.1.raw
  modified_base (207)..(207): a, c, t, g, unknown or other
  misc_feature (207)..(207): n is a, c, g, or t
  modified_base (667)..(667): a, c, t, g, unknown or other
  misc_feature (667)..(667): n is a, c, g, or t
tcagacatacgcgtcacgaccggtgctcgatttagctgcgtcacgatcgtctcgttgggggggggtctcaggaggcagcgctctcgggacgtctccaccatggcctgggctctgtctattcctcaccttcctcactgagggcacgagggtcctgggcccagtctcgccctgacccagcctgtcctccgtgtctggatcatctggacngtcgatcagcttacttccgtgacacgtgggaaccaacgagtagactaggttggttcttttgacttctagttcctccgtacggtaacccaacgtaacacccgtacgaacccctaaaccccctataccgtacttaacgtatttacggtcggttcgtacctacggttccgggtcccgtacccttacgacggtacgtcttactcgtacgttccgtacttcctacggaccgtctaaccgtacggtacgtacggaaccgaaccgtacccggtacccttaccctaacaccgttctccggtacgggtaccttagttaggtaggaccgggtaacttaggttaaccctttaaagtttaccgtacgtcgttacctttacgttaaccgttaagttcgaccgtacctacgttcggttcgttcgggttacgcgtacggtactaccggtagtaccgtaccggttcgtaccggtanacccgggttaccgaaggtccctcccggaacccttccgggtactacccttcgttaccccg

SEQ ID NO: 130674 - DNA, 629 bp, Homo sapiens
  misc_feature: GYAE6OF02FZFNM.22.36.D03.1.454.CMB.1.raw
  modified_base (262)..(262): a, c, t, g, unknown or other
  misc_feature (262)..(262): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgacctacgtgggaccaacagtacgactagttggttctttgactntgtctctgaccaacaacaccacgacccaaccccactcactactattagtgtctctacgtcgtccgtccctcgaggtcgtactctcatcgtcttctcgacgtctacgagtcgtggaccaacgaccgtccctacctaacctactccgtccgtcggcctacgttggttacggtgtaacgtacttacgttaacttacttacgtctacgttactttacctttaaacgttaggtaccgtcctaacgttccgttggtttacggtttcgggtacggcggtaccgtaccggtacgttaccggaccgttcgttaccgtaccgacggacccgtaacggtccgtcccgtcccccggtagtcctaccgtaccttccccgg

SEQ ID NO: 130675 - DNA, 944 bp, Homo sapiens
  misc_feature: GYAE6OF02JBE7N.22.36.D03.1.454.CMB.1.raw
tcagacatacgcgtcacgaccggtgctcgatttagctgcgtcacgatctatcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagtctactttccgtgaccgtaccgtacgggaaccaacgtaggtcgaacgttacggtttcggggtttactttttacggacctttcgttcgttaccgttcccgttacggtaaacccaaaccgaaaccctaaccccgaaccgggtaaccccctaaaaaccccccctaattacctaaacgttaccgtttaacgttttaacggtcgggttacgttaccgtaaccgttcccgggttacccgggtaccccttacggtaacggggttaccttccttccgtactacgttccgtcttccgtacgacggtcctaccgtaacgttccgtcggaaccctaaccggtacccgtacccttaaccctaaccgtaccttaccgttaccggtaccgggtccctttacggtacggtttacggaaccgggtaaccgttacggtttaccgtttaaacgtttacccgttacgttaccgttaacccgtttaaactttttaaccggtttaaaacggttacccgggtacccgttaccctttaacgggttaccgttttccggggttttaccggggttttaccgggaaccgggttaaccgggtaccgttaaccggggttaccggttaaccggtaccccgggtttaccgttacccgggtaaccggttaacccgggtaacccggttaacccgggttccccggtttaccccggttacccccggtttaccgggttaacccttccccggtttacccgtttaccccccgg

SEQ ID NO: 130676 - DNA, 635 bp, Homo sapiens
  misc_feature: GYAE6OF02GK51R.22.36.D03.1.454.CMB.1.raw
  modified_base (317)..(317): a, c, t, g, unknown or other
  misc_feature (317)..(317): n is a, c, g, or t
  modified_base (353)..(353): a, c, t, g, unknown or other
  misc_feature (353)..(353): n is a, c, g, or t
  modified_base (370)..(370): a, c, t, g, unknown or other
  misc_feature (370)..(370): n is a, c, g, or t
  modified_base (398)..(398): a, c, t, g, unknown or other
  misc_feature (398)..(398): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctgggacagtcgatcagctatttcctgcacgtgggacccaacagtgactagttgggttcttttgacttctcgtctcctggtaaccaacaacaccacgacccaaacccccatcatcatttatgtntcactcgtcgcctcgaggtctctctcatcgtcttcncgtagcctacaacgtcnggaccaaccgccggtccctaccctaacnctctaccgtcggtcctacctagtttacgacggtacgtacgttacttaactttattacttcgtactacgttttaccttaaagttccggacctcctacgttccttcggtttacggtttccgggacggtacggtacgtaaccggttaggccgttacccggtccgttccggtaccgtaccggtacccggtaacggtccgttaccccgcccccggtacggtccctaccgtcccgttccccgg

SEQ ID NO: 130677 - DNA, 777 bp, Homo sapiens
  misc_feature: GYAE6OF02IQLHD.22.36.D03.1.454.CMB.1.raw
  modified_base (159)..(159): a, c, t, g, unknown or other
  misc_feature (159)..(159): n is a, c, g, or t
  modified_base (426)..(426): a, c, t, g, unknown or other
  misc_feature (426)..(426): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtcncgcctgacccagcctgcctccgtgtctggatcactctggactgtcgatcagtctatttctggcacgtacgggtaccaacgtagtcgaacgtggtttcggttccgttttacggaccttcgtcgtccttccgtacggtaaccaacaacctacccgaacggaacccccaaaccccccgtatcctaactactagttacgttggtccgtctaccgtcggtcccggtaccctacgtacggtacgttacctcgtaccgtactccggttcttacnccggtacgttccgtacgtaactcggtacgtaacctacccgacccgttacccgtaaccttaaccgtcttaccgtacggtccggacctttacggttacggttacgggtaacggtaccgttacgttaccgtttaacctttagttaccgttcgtaactttaccggtttaacctttaacggtaccgtacccgtaaccgtaccgttcggtttacggggtttacgggttccgggacgggtaaccgtaccgtaaccgggttacgtcccgttaccggtaccgtaccggttacgacccggtacccggtacggttcccgcccggttaccccggttaccggtacttccgtaccccgttcccgg

SEQ ID NO: 130678 - DNA, 790 bp, Homo sapiens
  misc_feature: GYAE6OF02GK3F4.22.36.D03.1.454.CMB.1.raw
  modified_base (221)..(221): a, c, t, g, unknown or other
  misc_feature (221)..(221): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcactagggtcctgggccccagtctgccctgacccagcctcgcctccgtgtctggatcatctggacagtcgatcagctatttccngaccacgtcgggaaccaaacgaggtacgactaacgttttcggggttcctttttaggaccttcgttacgttccttacccgttacggtaaacccaaaccgaaacctaccccgaaccggaacccccaaaaccccccccgtaactacctaacttacttaattttaacgtcgggttacgtacctaccgttccggtcccggtaccccttcggaacggttcgtccgtccttacctacgttccgtcctttccgtaccgtacgtaccctacgtaacgttccgtacggacctaaccggtacccgtaccccttacccctaaccgtaccgttccgtaccgttcgggtcccttacggtaggtttacggaacggtaccgtacgttaccttaactttacttacgtacgtcgttaacctttaaccggttaattaccgggaccttacctcgtttccgttcgggtttcgggttttccggcggtaaccggtaccgtaacgggttacgtacggtacccggtcccgtacggtccggaaccgacccgtacgtcccgtaccggtaccccgtgtaccgtccctccgttccccg

SEQ ID NO: 130679 - DNA, 627 bp, Homo sapiens
  misc_feature: GYAE6OF02FZ635.22.36.D03.1.454.CMB.1.raw
  modified_base (170)..(170): a, c, t, g, unknown or other
  misc_feature (170)..(170): n is a, c, g, or t
  modified_base (200)..(200): a, c, t, g, unknown or other
  misc_feature (200)..(200): n is a, c, g, or t
  modified_base (218)..(218): a, c, t, g, unknown or other
  misc_feature (218)..(218): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccngcctgcctccgtgtctggatcatctggacngtcgatcagctatttccngcacgtcgggaaccaacgtgtacgactagtttgggttcttttgacttctcgtctccgtaggtaccaaacaccaccgacggaccccaaaccccccaatcactactatttacgtggtctcaccgtccgccgtccctgacggtctctctcagtctctctcgcgtacctacacgtcgcgaccacgcccgtccctaccctaactcgtctcgtcggacttcgtgttacgacgacgtacgttacttagttactacgttcgtacttacgtttaaccttaagtcgtaccctctaccgttcggttcggtttcgttcggcgtaacgtaccgtacggtcgtaccgccgttcggtaccgttaccgacccgtacggtccgtcccgttccccgtcccgttccgaccgttaccctcgttcccccg

SEQ ID NO: 130680 - DNA, 764 bp, Homo sapiens
  misc_feature: GYAE6OF02GMA7F.22.36.D03.1.454.CMB.1.raw
tcagacatacgcgtcacgaccggtgctcgatttagctgcgtcacgatctctcttgggggggggtctcaggaggcagcgctctcgggacgtctccaccatggcctgggctctgctattcctcaccttcctcactcagggcacagggtcctgggcccagtctgccctacgacccacgcctgccctccgtgtctggatcatcgtggacagtcgatcagtctactttcctgacgtaacgtacggggaaccaaacgtagtacgtaacgtaggtttcggggtttcttttagaccttcgttcgttcctaccgttacggtaacccaaaccaaacccacccgaaccggtaacccccaaaaaccccccctaactacctaacgttacttaacgttttaacgttcgggttacttaccgtaccgttccggtaccccggtacccgtaccggtaacggggtacttccttaccgttactacgttccgttcctttaccgtacgtaccggtacttacccgtaacgtcgtacggtacctaacccggtacccgtacccctacccgtaactacgttccgtacgtcgggtcctaccgttagtacggacggtacgtacgtacttaactacgttactcgtactttacttaaccgtttaaagtcgaccttaccgtactttcggttcgttcgggtttcggacgtacgaccgtacggtagtccgtaccggtcgtacggtaccgactccggacgtccgtcccggtcccgtcgttccgtaccgtccgttcccg

SEQ ID NO: 130681 - DNA, 956 bp, Homo sapiens
  misc_feature: GYAE6OF02HYRJI.22.36.D03.1.454.CMB.1.raw
  modified_base (209)..(209): a, c, t, g, unknown or other
  misc_feature (209)..(209): n is a, c, g, or t
  modified_base (228)..(228): a, c, t, g, unknown or other
  misc_feature (228)..(228): n is a, c, g, or t
tcagacatacgcgtcacgaccggtgctcgatttagctgcgtcacgatctctcgttgggggggggtctcaggaggcagcgctctcgggacgtctccaccatggcctgggctctgctattcctcaccttcctcactcgagggcacgagggtcctcgggcccagtctcgccctgacccagcctcgcctccgtgtctggatcatcgtaggacngtcgatcagtctactttcngacacgtacgggaaccaacgtaggtacgacgtaggttttggggttctttttacggaccttcgttacgttcccttaccggttaccggtaaaccccaaaacctaaaccccgtaaccccccgaaccgggaaacccccccctaaaaaccccccccctaaacgttacctaactttaaccttaagtttttaaccggtacggtttacccgtaccttaccgttcccgggttaccggtaccccttacggtaacggggttaccgttccttaccgtaccgtaccgttcccggttacctttccgtaccggtaccggttaccgttaaaccccggtaaggtttacccggtacggtaaacccgtaaccccggtacccggtttacccccctaaaccccgttaacctaccggtttcccgttcccgggttaccggtaccccgtttacggttacgggtttaaccgggaacggtaccggtttaaccgttacctttaaaccgttttacgtaccgttacgttaaccgttttaacggttttaaacttttaaacggtaccgtacccgttacccttaaccgtttccgggtttacgggttttccggggtttaccgggacggtaaccggtaccgaaccggttaccgggtccggttacccgttaccggtaccggttaccgaccccggtaccgttaccgggtcccttccccgggttaccccgtccggttaacccttccggtaccccgttaacccccg

SEQ ID NO: 130682 - DNA, 844 bp, Homo sapiens
  misc_feature: GYAE6OF02JW787.22.36.D03.1.454.CMB.1.raw
  modified_base (204)..(204): a, c, t, g, unknown or other
  misc_feature (204)..(204): n is a, c, g, or t
  modified_base (222)..(222): a, c, t, g, unknown or other
  misc_feature (222)..(222): n is a, c, g, or t
tcagacatacgcgtcacgaccggtgctcgatttagctgcgtcacgatctctcttgggggggggtctcaggaggcagcgctctcgggacgtctccaccatggcctggggctctgctattcctcaccttcctcactcagggcacagggtcctgggccccagtctgccctgacccagcctgccctccgtgtctggatcatctggacngtcgatcagctatttccngccacggtacggaccaacgtagtcgaactaggtttcgggttcttttcggaccttcgttcgttccctccggttaaccggtaaaccaaaccaaacccgaccccgaaccgggaacccccctaaaacccccccctaactacctaacttaccttaacttttaacgttcggttacgtaccgtacccgttccgggttacccgccccgttaccggaacggggttacttcctttaccgtacgtaccgttccgttacccgttccgttaccgaaccgggttaccccttaaccggtaacgtttcccggaaccggttaaccgaaacccccggtacccggtccccttaacccgtacctaacgtcccgttccgttaccgggcctttacccggtaaggtttcggaacggtacgttacgttaacttaccgtttacttacgtcgtaactttaacgtttaaccgtttaaagtaccggtaccgttaaccctaccgtttcggttaccgggttttaggtttccgggagggttaccgacccgttaagtacccggtaccgtacccgtccggttacgaccggacccggtaacgtccggttacccgtcccggtacccgttccggtaacttccgttccgttaccccccg

SEQ ID NO: 130683 - DNA, 651 bp, Homo sapiens
  misc_feature: GYAE6OF02FYO9M.22.36.D03.1.454.CMB.1.raw
  modified_base (232)..(232): a, c, t, g, unknown or other
  misc_feature (232)..(232): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacngtgacagttggtcttttgactctgtctctggtaccaacaacacccaggaccaaaccccccaactcatcattatggtgtcactcgtcggccctcgaggagtctctcatcgcttctcacggctaccgaagtctggacaaccgaccggccctacccgtaaccctactcctccgtgggcctccgtagtttcggacggtacgacgttccgttaacttatttacctgtctacgttttacctttaaagttacggcctaccgtaccttcgttcggttcgggttttaccggacgggtacgtaccgtaccggtacgttccggtacccggttcccgttaccgggttaccgaaccggtacccccgtaacgggtccgtaccccggtacccccccggttacgggtcccttacccgttcccgtttaccccccgg

SEQ ID NO: 130684 - DNA, 676 bp, Homo sapiens
  misc_feature: GYAE6OF02GX6C5.22.36.D03.1.454.CMB.1.raw
  modified_base (315)..(315): a, c, t, g, unknown or other
  misc_feature (315)..(315): n is a, c, g, or t
tcagacatacgcgtcacgaccggtgctcgatttagctgcgtcacgatctctcttgggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctactttcctgcacgtcgggaccaacgagtgactagttggttctttgctctgtctcctagtaccaacaaccaccacgacccaaacccccaatactctattatgtntcactcgtcgcctgaggtactctctctactcctcttctcgacgtcctacgtagtcgtacgactaaccgaccggtcccctaaccgtaaccattccgtcgtacggtcctccgttagttggacgtacgtagttccttactttaataccgttgtcttaacgttttaaccttaagttccgccttaccgtacttccgtttcgggtttacgggtttaccgggcgggttaacgtccgtaaccggtacggttacccggtacccgtcccggttacggtacccgtaaccggtaccccgggtaggtaccccgttcccggtccccccgtttaacgggtacccctacccgtttcccgtacccccgttaccccccg

SEQ ID NO: 130685 - DNA, 725 bp, Homo sapiens
  misc_feature: GYAE6OF02JCJ68.22.36.D03.1.454.CMB.1.raw
  modified_base (219)..(219): a, c, t, g, unknown or other
  misc_feature (219)..(219): n is a, c, g, or t
  modified_base (238)..(238): a, c, t, g, unknown or other
  misc_feature (238)..(238): n is a, c, g, or t
  modified_base (381)..(381): a, c, t, g, unknown or other
  misc_feature (381)..(381): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctncctacgtcgggaccaacgngtcgactagttgggttcttttgactctgtctcctggtaccaactaaccacccaggacccaaaacccccctataccatctactttagtcggtatccacgtccgtccggccctagacggtactcctctacactccgtcttctacncggtcctaccgtaagttccgacggtaccaaacccgtaccggtccccttacccctaacctcgtccctccggtacggggtcctacccgagggtcgttaacggaaacgtagttacgggacggtcttaggtaactttaacgttcgtcgtacgttcgacctttacgttaacgtttccggaccggtaaccgggttcccgtacccgtttaaacggttcgggttttcgggggttaacgttcccgggggaacggggttaaccgggaacctaacgggtcggttacccggtaacccgggtttcgttaccgggacccgtaacccggtaacccggtaccggttcccgtacccccggg

SEQ ID NO: 130686 - DNA, 708 bp, Homo sapiens
  misc_feature: GYAE6OF02GZMZ9.22.36.D03.1.454.CMB.1.raw
  modified_base (211)..(211): a, c, t, g, unknown or other
  misc_feature (211)..(211): n is a, c, g, or t
  modified_base (235)..(235): a, c, t, g, unknown or other
  misc_feature (235)..(235): n is a, c, g, or t
  modified_base (666)..(666): a, c, t, g, unknown or other
  misc_feature (666)..(666): n is a, c, g, or t
tcagacatacgcgtcacgaccggtgctcgatttagctgcgtcacgagtctctcttggggggggtctcaggaggcagcgctctcgggacgtctccaccatggcctgggctctgctacttcctcaccttcctcactcagggctacgtagggtcctgggccctagttctgccctgacccagcctgcctcgtgtcgtggactctagtcgtggacngtacgactcgagtctactttccgngtccacggtccggaaccaagtcggagtacgttggtttcggtttctttacgcttcgtcgttccttccgtacgtaaccaacgtaacccgacccggaaccggtaacccccaaaaccccctaacgtacctaacgtacttaagtttagtcggttccgtacgtacggttccgtacccggtaccgtcggtaacgtccgttcctccgttacgttacgttccgttcgttacctacggtcggtaccttacgtacgtccgacggaccgtaccgccggtaccctaccctaactcgtccgtcggtacgtcctacgttacggtacggaacggtacgttaactcgtttaactttacgttacgtcgtacgtttaacgtttaccttaacgtacgtccgacttaccgttcggtcgttaggtccgagtcgacgtacgcgtcgtaccgtcncggacacgaccgtacgtcctccgccgtcgactcgccttcccg

SEQ ID NO: 130687 - DNA, 810 bp, Homo sapiens
  misc_feature: GYAE6OF02FQTOB.22.36.D03.1.454.CMB.1.raw
  modified_base (218)..(218): a, c, t, g, unknown or other
  misc_feature (218)..(218): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcacgtcgggaaccaacgagtcgactagtttgggttcttttgaccttcgtcgttctccgttacggtaaccaacaaccacccgacgacccaaaccccccatcactctattatggtcgtctactcgtccggtcctcgaggtacgtctctactacgtccgtcttcgtcgacggtcctaccgtaacggttccgtacgggtacctaaaccgtacccggtacccttacccctaaacctacgtccgttaccggtacgggtcccttaccggtaggtttacggaacggtaccggtacgttaccgtttaaaccgtttacgtttaccgttctaaccgtttaacgtttttaacccttttaaagttaccgggtacccgtaccccgttaaccgttttccggtttacgggttttccggggtttttacccgggaccgggttaccggtacccggtaaaccgggttacgggtttacccgggtaaccccggttttccccggttacccgggttacccgtaaccgggtacccccgttaacggggtcccccgttaccccgggttacccccccggtttacgggttaccctaccccggtttacccgttccccccgg

SEQ ID NO: 130688 - DNA, 706 bp, Homo sapiens
  misc_feature: GYAE6OF02F3XQA.22.36.D03.1.454.CMB.1.raw
  modified_base (140)..(140): a, c, t, g, unknown or other
  misc_feature (140)..(140): n is a, c, g, or t
  modified_base (169)..(169): a, c, t, g, unknown or other
  misc_feature (169)..(169): n is a, c, g, or t
  modified_base (198)..(198): a, c, t, g, unknown or other
  misc_feature (198)..(198): n is a, c, g, or t
  modified_base (242)..(242): a, c, t, g, unknown or other
  misc_feature (242)..(242): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcangggtcctgggcccagtctgccctgacccngcctgcctccgttgtctggatccattcgnggacaggtcgatcagtctatttccggaccacgtgggaaccaacnggtcaactggtttcggttacgtttgtactcttcgttctaccgtcggtacctaaccaaccaccgaccgaacccaaccccaacctaccacctactacttacgttgtgtcgtacctcgtccgccgttttcgacgtacgtctcgtctactcgtactctcacgtctacgtacgtctcgacgacgaccgtaccctaccgtaccttactaccgttcgtcggtccgttccttacggttacggttacgacggtattccgttaacttacgttacgttacgttcgttacgtttacgtttaaacgttacgtcgtacccgtaacgttccgttccggttttacgtttcggggtaccggtacgggtaccgaaccggttacggtaccggttacccggtcccgttaccggttaccggtcccggtaaccgtaccggtcccgttacccgtcccggtcccgtcgttacccgtctttaaccccgg

SEQ ID NO: 130689 - DNA, 823 bp, Homo sapiens
  misc_feature: GYAE6OF02I6962.22.36.D03.1.454.CMB.1.raw
  modified_base (225)..(225): a, c, t, g, unknown or other
  misc_feature (225)..(225): n is a, c, g, or t
  modified_base (246)..(246): a, c, t, g, unknown or other
  misc_feature (246)..(246): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacgagggtcctgggcccagtctgccctgacccagcctgcctcgtgtctggactcatcgtaggactagtcgatcagcttactttccgngactacgtcgggaacccaagnggtacgacttacggtttcgggtttcttttcggaccttcgttacgtccttaccgttacggaacctaaaccaacccaacccgaaccggtaacccccaaaacccccctaacttacaacttacttaattttaacggtcggttactaccgtaaccgttccgggtacccgtaccccgttacggtaacggttacgttaccttacctacttaacgtccggtttacctttacccggttaccggtacggttacccttaccggtaaacgtttcccggttaacggaacccgtaaaccggtaccccgttacccccttaaccccgtaaaccgtacccgtttacccgttaccgggtaccggtccccgttaccggtttaacggtttacggaaccggttaaccgttacgtttacctttaacgtttacttacgtcgttacctttaacgttttaacctttaaacggtcgtacccgtaccttacgttcggttccgggtttacgttaccgggcgtacgacgtaccgtagtccggtaccgttcgcgtacgaccgtaccgtcgtaccgtcccggacccttcgtactccgtccttaccccg

SEQ ID NO: 130690 - DNA, 758 bp, Homo sapiens
  misc_feature: GYAE6OF02GQ3UH.22.36.D03.1.454.CMB.1.raw
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctcgtgtctggatcatctggacagtcatcagtcatttcctgccactggggaacccaacagtagactatttcgggtcttttggactctcgtctcctggttaaccaacaacctacccgaggacccaaaaccccccgaattaccgacgttactagtttaactggttacgtacctaccgttaccgtcggtcccctacgtcgggtaagttccgttacttacctaattccggtcctttaccttcgaacggtcttacccaaaaggttccttacgggaccaaacggtacccggtccctacccgtaaaccacttctaccgtttacgggccttacccggaagttttcgggaacggtaacggtaacggttcccttaaactttagtttaaccgtaacgtcgtaaccggtttttaccttttaaaacgttacgggcccttaaacccgtcgttcgttaccggtttcgggtttttacgggacgggttaacgtccgttaaccggtacgttcggtaaccccgttcgtacccgggtcaaccggtccccgtaaaggtccctccggtacccccgtttaggtccccgtacgttccctttacccgg

SEQ ID NO: 130691 - DNA, 826 bp, Homo sapiens
  misc_feature: GYAE6OF02FWOFO.22.36.D03.1.454.CMB.1.raw
  modified_base (220)..(220): a, c, t, g, unknown or other
  misc_feature (220)..(220): n is a, c, g, or t
tcagacatacgcgtcacgaccggtgctcgatttagctgcgtcacgatctctcttgggggggggtctcaggaggcagtgctctcgggacgtctccaccatggcctgggctctgctattcctcaccttcctcactcagggcacagggtcctgggcccagtctgccctgacccagcctgcctccgtgtctggatcatctggacagtcgatcagctactttccngcaccgtgggaaccctaaacaggtcgaactagttggtagttcttttacggacttcttagttccttaccgttacggttaaacccaaacctaaaccacccccgtaacggacccccaaaaaccccccccgtaactaccgtaacttcctaattttaacggtcggttagtacctaccgttccggttcccggacccttcgaacggtactccgtctacacgttccgtccttaccgtacgacggtaccttaccgtaacgttcctacggaccaaccgtacccggtacccctaacccgtaaaccacgttcccgttacggtccgggtaccttaccgttagggttacggaacggtacggttaacgttactttacgtttaacttacgtacgtacgtttaacgttttaaccttttaaaggtaccggttacctaccgttaccttcggtttaccgggtttccgggttttaccgggaccgggtacggtaacccgtacccgggttaacgttacccggtaaccccggtttaccggttccccgggtaaccgtaccggtacccccggaacgggttccccgtaccccggttacccccggttaccgttacccgtacccgtttaccccgg

SEQ ID NO: 130692 - DNA, 725 bp, Homo sapiens
  misc_feature: GYAE6OF02I9757.22.36.D03.1.454.CMB.1.raw
  modified_base (202)..(202): a, c, t, g, unknown or other
  misc_feature (202)..(202): n is a, c, g, or t
  modified_base (323)..(323): a, c, t, g, unknown or other
  misc_feature (323)..(323): n is a, c, g, or t
tcagacatacgcgtcacgaccggtgctcgatttagctgcgtcacgagtcctactcttcgggggggtctcgaggagcagcgctctcgggacgtctccaccatggcctgggctctgctattcctcaccttcctcactcaggcacgagggtcctgggcccagtctgcctgacccagcctgcctcgtgtctggatcatcgtggacngtcgatcagcctatttccagcctacgtcgggaaccaactagtcgactagtttggtctttgactctgtcctctcggtaaccaacaacaccgacggacccaaacccccatcaatctaatttgnggtcgtacctacttccgtccgccctacgaacgggtactcgtcctcaacgtccgtaccttccgtacgcggtcctaccgtacgtctacggaccaaaccggccggtacccttaacccgaacctacgttcccgtacggttaccgggtccttacccgttagttttacggaacgggttaccgtacggttactttaaaccgttacgtttactcgacgtttactttaacgtttaaacgttccgaccgtaccctacgtttccggttaggtttccgggttacggggtactaacgggccgtaaccggtaggttccgggtacccttcggttaacccgttacgacccgtacccggtaaggttccccttacccggtaccccggtttcggtacccttaccgtttcccggttaacccg

SEQ ID NO: 130693 - DNA, 720 bp, Homo sapiens
  misc_feature: GYAE6OF02GAM99.22.36.D03.1.454.CMB.1.raw
  modified_base (220)..(220): a, c, t, g, unknown or other
  misc_feature (220)..(220): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctcgccctgacccagcctgcctcgtgtctggactcatcgtggacagtcgatcagctatttccngcacgtacgggaccaacgagtcgactagttcggtcttttgacctcgtcgtcctcctaggtaccctaaacaaccacccgtacggaccctaaaacccccccaagtaccaacgtctaacgttttagtcgggttactacctaccgttccgtaccgggtccccttgaaggtacgtcctccgtaccgattccggtaccttccgtaacgacggtcctacccgtaagttccgacggtacccaaccgtcccggtacccttaaccccgaacctaccttccgtacggtcgggtaccctacggttacgggtttaacggaccggtaacgtaccgtttaccgttaacgttttaacttcggtactacgttacgttttaaccgtttaacgtaccgggtcctacctacgttcttacgtttcgggttcgacggcgtaccgtacgagtccgtaaccgtcggtcgtaccggacgaccgtacggtcctcccggtccccgttgaccgttccgccttaccccg

SEQ ID NO: 130694 - DNA, 748 bp, Homo sapiens
  misc_feature: GYAE6OF02HIS3P.22.36.D03.1.454.CMB.1.raw
  modified_base (221)..(221): a, c, t, g, unknown or other
  misc_feature (221)..(221): n is a, c, g, or t
tcagacatacgcgtcacgaccggtgctcgatttagctgcgtcacgatcgtctcttggggggggtctcaggaggcagcgctctcgggacgtctccaccatggcctgggctctgctattcctcaccttcctcactcacgggcacagggtcctgggcccagtctgcctgacccagcctgcctccgtgtctggactcatcgtggacagtcgatcagctatttccngtcaccgtgggaaccaactagtagactagtttgggttcttttacggacttcgtcgttacctccgtacggtaaccaactaaaccaacccgacggtaaccccaaaaacccccctaatccgaacttacctaatttagtcggtctaccgtaactcggtccggtaccctacgaaggtacgttctcgtactacgtcgtcttaccgtcgaacggtctacgtaacgttacgtacggaccaaaccgtaccggtcccctaaccgtaaacctcttacccgtacgtacggacccttacgtacggtttacgacggtaaccgtaagttaccttaacgtttacttacgtagtaccttacggttttaacctttaaagtcggaccttacccgtacgttccgttcgggtttacggtttccgggaacgtaacggacccgtaacggtacggttaccgacccggttccgtacggtaccgtaaccgtacccgtaacggtccgttcccggtacccccgttacggtaccttcccggtaccgtttaccccgg

SEQ ID NO: 130695 - DNA, 668 bp, Homo sapiens
  misc_feature: GYAE6OF02HZKY9.22.36.D03.1.454.CMB.1.raw
tcagacatacgcgtcacgaccggtgctcgatttagctgcgtcacgatctctcttgggggggggtctcaggaggcagcgctctcgggacgtctccaccatggcctgggctctgctattcctcaccttcctcactcagggcacgagggtcctgggcccagtctgccctgacccagcctgcctccgtgtctggatcatcgtaggacaggtcgatcagctacgtttcctgctacgtacgggaccaacgaggtgactagttgggttcttttagacttctcgtctcctggtaaccaacaaccaccgacgaaccccaaacccccaactcactctacttagtcggtacgtctaccgttcgtccggacctcgacggtactctcctacactccgtcttctcgacgtcctacacggtcgacggactaacccgaccggtaccctaccccgtaactctccttcggtccggtcctacgttaggttacggaggtaacgtacgttaccttacttacgttactacgtacttacgtttaacctttaagtcggtaccgtactaccgttcgttcggttgggtttaccggacgggtacgaccgtaaccggtaggttccgtaccggtccgtacggtctaccgtaccgacgggtcctaccggccccgttacggtcgtacctccgttacccg

SEQ ID NO: 130696 - DNA, 778 bp, Homo sapiens
  misc_feature: GYAE6OF02IEODE.22.36.D03.1.454.CMB.1.raw
  modified_base (145)..(145): a, c, t, g, unknown or other
  misc_feature (145)..(145): n is a, c, g, or t
  modified_base (152)..(152): a, c, t, g, unknown or other
  misc_feature (152)..(152): n is a, c, g, or t
  modified_base (254)..(254): a, c, t, g, unknown or other
  misc_feature (254)..(254): n is a, c, g, or t
  modified_base (294)..(294): a, c, t, g, unknown or other
  misc_feature (294)..(294): n is a, c, g, or t
  modified_base (750)..(750): a, c, t, g, unknown or other
  misc_feature (750)..(750): n is a, c, g, or t
  modified_base (761)..(761): a, c, t, g, unknown or other
  misc_feature (761)..(761): n is a, c, g, or t
  modified_base (770)..(770): a, c, t, g, unknown or other
  misc_feature (770)..(770): n is a, c, g, or t
tcagacatacgcgtcacgaccggtgctcgatttagctgcgtcacgatctctcgttggggggggtctcaggaggcagcgctcgtcgggacgtcctccaccatggcctgggctctgctattcctcaccttcctcactcgaggcacgngggtccnggcccagtctcgccctcgaccccagtccgtcgcccttccggtgtaccgtggactctacgttccgttaggaccgtagtccgattccgagtcttacttttccgngacctacgtcggaacccaagtgtagactaggtttcggttntttcgactcgttcgtcctacgtacgtaaccaaaccaacctacccggacgtaacccccaaaacccccttagtaccttaacgttacctttaagtttacggtcggttcctaccgtacgttacccggtccggaccccttaaggaaccgttcgttcctaccgtacgtccgttacgttccgttacccgtagtaacggtcccttaccggtaacgttccgtaacggggaccctaaaccggtacccgttccccttaaaacccgtaactccgttccggttccgggttacgtacccttaccggttagggtcggtacgtacgttaccagtttttaacgtattcgcgttacgttaacgtttaccgttagtaccggcgttaccctgtttacccgttgggttaccgggttcggacggcgtaccgacgtaggtcccttacggtccgacgtacgacttacggcgccgtacccnccggtttccgnttccccgtnttccccgg

SEQ ID NO: 130697 - DNA, 710 bp, Homo sapiens
  misc_feature: GYAE6OF02F0PC9.22.36.D03.1.454.CMB.1.raw
  modified_base (232)..(232): a, c, t, g, unknown or other
  misc_feature (232)..(232): n is a, c, g, or t
  modified_base (374)..(374): a, c, t, g, unknown or other
  misc_feature (374)..(374): n is a, c, g, or t
tcagacatacgcgtcacgaccggtgctcgatttagctgcgtcacgagtctctcgttggggggggtctcaggaggcagcgctctcgggacgtctcaccatggcctgggctctgcttattcctcaccttcctcactcagggcacgagggtcctgggcccagtctgccctgacccagcctgcctccgtgtcgtggactcactcgtaggaccaaggtccgatcacgactactttcncgcacgtcgggaaccaacgtagtacgacgtacgtttgggttactttgaccttcgtcgttctccgtacggtaaccaaaccgtaaccaccgaaccgaaccccaaaccccccgtataccgactactaactttacgtggtctaccncgttccgtccggtccctagtacggactttcctacgtactactccgtcttcgtcgacgtcctacgaactcgtacgaacctaccgaccctccctaacccacctacgtccgtcggtaccggtcttcgtaggttcggaacgtacgtacgtttaccttaatttaaccgtcgtactaccgtttaacgtttactttaacgtcgggtctcccgtagttccgttcgggtttcggttaccgcggttaaacgccgtaacgtacgtaccggtcgttacgtccggtacgtaaccgaccgtcggttaccgtcccggtccccgtagtacccgtacgttcccgttaccccgg

SEQ ID NO: 130698 - DNA, 887 bp, Homo sapiens
  misc_feature: GYAE6OF02J13LH.22.36.D03.1.454.CMB.1.raw
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacgagggtcctgggcccagtctgccctgacccagccttggcctccgtgtctaggactccatctcggaccaggtccgagtcacggctacttttcctgcacggttcgggaaccaaacgtgtcgtaactagtttcgggttacttttcgaccttcgtcgtctccgtacggtaaccaacctaaccaacccgaacggtacccctaaaacccccctatacctactaccttaagtttagtaccggttacgtcctaaccgttccgtacccggtcccgtacggtacggtaacgttcttccgtaactccggttcgtcccgtttccgaccgtaccggtaccttaccgtaacggtccgtacgggtaaccaaacccggtaccccggtttacctacccccgttaaacgtcgttacccttacggtacggtccccttcggttaacgggttacggacgggtaacctaccggttactttaaccgtttagttaaaccgttcggaaccgttttaacgtttaaaccgggtttaacccgtaaaggggttccctaaacggtttcccgtttcgggttaaccggggtttttaggtttaccccgggggaaacgggttacccgaccggttaaacccgggtacggtttacccgggtttaacccgtacccgggtttaccggttaaccccggaccggttaaccccgtaaccgggggtttccccttacccggttccccccgtttaaccgggtccgtacccctttaccggtttaccccccgg

SEQ ID NO: 130699 - DNA, 867 bp, Homo sapiens
  misc_feature: GYAE6OF02JK2UU.22.36.D03.1.454.CMB.1.raw
  modified_base (222)..(222): a, c, t, g, unknown or other
  misc_feature (222)..(222): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacgagggtcctgggcccagtctcgccctgacccagcctgcctccgtgtctggatcatctggactagtcgatcagctatttccgngcctacgtcgggaacctaacgtaggtcgaacgtagttcggggtttctttttacggaccttcgttcgttaccgttccgttacgggtaaccccaaaccgaaaccctaaccccggtaaccgggaacccccctaaaaaccccccccctaaagttccctaaaccttaccgttaacgttttaaacgtcggggtttaccgtaccgtacccgtttacccgggtaccccggtccccgtacgtaacggggtaaccgttccttcctaccgttaacggttcccgttccttaccgtacgtaccggtaccctacgtaacgtcgttacggacctaacccgtacccggtacccctaacccgtaacctcgttacccgtcgtacgggtcctttaccgtacggtttacggtaacggaaccgttacgttacctttaacgtttaaccgttacgttacgtacgtttaaccggttttaccttttaaaacgtaccgggtcctacccgttaccttccggtttcggtttaccgggtttccgggaccgtaccgggtacctaaccgggtacgttaccggacccggttcccgtacggtccgtaacccggtccggtaaccggttccgtcccggttaccccccgttaggtacccgttaccgttcccttacccccgg

SEQ ID NO: 130700 - DNA, 652 bp, Homo sapiens
  misc_feature: GYAE6OF02JGU4M.22.36.D03.1.454.CMB.1.raw
  modified_base (210)..(210): a, c, t, g, unknown or other
  misc_feature (210)..(210): n is a, c, g, or t
  modified_base (219)..(219): a, c, t, g, unknown or other
  misc_feature (219)..(219): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctaggacagtcgatcanctatttccngcacgtcggaccacagtgactagttggtctttgacttctcgtctctggtaccaacaacctaccacggtacccaaacccccactacactctatttagtggtcgtactacgtcgtaccggtccctacgaggtacttcctctactactcgtaccgttctcgacggcgttaccgtaacgttccgtcgggacaacccgtacccggcccttaacccgtaacacttcccgtcgttcggcccttacgtggttacgaggtaccgtagttcccttatttacgtacgtacgtacttaccgttttacctttaaagtccggtcctaccgtacttccggttcgtttacgggtttccggcggacgtaccgacgtaccgtcgtaccggttctcggtcaccgtaccgtacgggccctcccgttcccggcttacccgcgttaccttccccg

SEQ ID NO: 130701 - DNA, 837 bp, Homo sapiens
  misc_feature: GYAE6OF02FV0O1.22.36.D03.1.454.CMB.1.raw
  modified_base (385)..(385): a, c, t, g, unknown or other
  misc_feature (385)..(385): n is a, c, g, or t
tcagacatacgcgtcacgaccggtgctcgatttagctgcgtcacgatctctcttgggggggggtctcaggaggcagcgctctcgggacgtctccaccatggcctgggctctgctattcctcaccttcctcactcgagggcacagggtcctgggcccagtctcgccctgacccagcctgccctccgtgtctggatcatctggacagtcgatcagctactttcctgcctaacgtcgggaaccaacgtaggtagaacgtagtttcggggtttaccttttcggaccttcgttcgttccgttcccgttacggttaaccccaaacaaacctacgtacccgaacggaaccccaaaacccccccactacacttactactttaacgtacggttntaccaccgtccggtccggtacctacggacgtactccgtctacgtactccgttcttacctacggtacgtcttaccgaacgttcgtacgggacctaaacccgacccggtaccccttaacccgtaaacctcttacccgttccggtaccgggttcctaccggttagggtttacggaccgggtacgttacgtttaaccgttaactttaacgttaaccgtcttaaccgtttacgttttaaacccttttaaaagttccgggaacccttcccgttaaacgtttccgggtttaccgggttttccggggttttaccgggaccgggaaaccgttcccgtaaccgggtaaccgggttcccggtaacccgggttacccgtccggggttaacccgtaccggtaacccgtacgggttccccgcccccgggtttacccccgtccggttaccgtccccgtttaccccgg

SEQ ID NO: 130702 - DNA, 731 bp, Homo sapiens
  misc_feature: GYAE6OF02HVFPF.22.36.D03.1.454.CMB.1.raw
  modified_base (128)..(128): a, c, t, g, unknown or other
  misc_feature (128)..(128): n is a, c, g, or t
  modified_base (218)..(218): a, c, t, g, unknown or other
  misc_feature (218)..(218): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctnactcacgggcacagggtcctgggcccagtctgccctgacccagcctgcctcgtgtctggatcatctggacagtcgatcagctatttccgngacacgtcgggaacctacaggtgactagtttggttcttttgactctcgtcctccgtaggtaaccaacaaccacccgaacgacccaaaaccccctatccatctattacgtcgtctacactcgtcggcctacgacggtcgttcctctacctactccgtccttctccgtacggtcctacccgtaacgttcgtacgaccaaaccgtaccggtcccttaacccgtaaacctctacccgtcggttcgggacccttcgttaaggttcggaacggtaacgttacgttaccgtttaactttaaacgtcggtaaccgttacttacggttttaaccttttaaacgtccgggtccctaaccccgttaaccgtttccgttacgggtttcgggttttaacccgggtcggtaccgggtaacctaaacccggttacggtccgtaccccgttcggtacccggtacgtaacccggtacccgtacggtccgtcccgtaacccccgttgggacccttccgttaccttccccgg

SEQ ID NO: 130703 - DNA, 910 bp, Homo sapiens
  misc_feature: GYAE6OF02F4NYF.22.36.D03.1.454.CMB.1.raw
  modified_base (701)..(701): a, c, t, g, unknown or other
  misc_feature (701)..(701): n is a, c, g, or t
tcagacatacgcgtcacgaccggtgctcgatttagctgcgtcacgatctctcgttggggggggtctcaggaggcagcgctcgtcgggacgtctccaccatggcctgggctctgctacttcctcaccttcctcactcgacgggcacgtcgggtccgtcgggcccagtctcgccctcgacccgagtcctcgccgtccgtgtacgtggactcagtcgtaggactagtcgagtacacgtctactttccgtagccgtaacgtacggaaccctaaacgtcggtacgtacgttaggttttcggtttctttacggtccttacgttcggttccgttaccgttaacggaaacccgtaaacccgaaccctaaccccggaacccgtaaacccccctaaacccccctactacgtaacttccgttaagtttacgtcgggtactaccgtccggtaccgttccggacccgttagacggtactcctcgtactacgtcctttccgttacgaccgtacgtaccgtaaccgtagttccgaaccggtaccgacccggacccgtttaaccccttaacccgtaaccttcgtacccggttccggttccggaccgttaacccggagggtccgtaaacggtaagggtcgttaacggggtaccgttaacggtttaagtttaaccgttaacgtacccggtttaacgtaacccgttaggttaaacccttntaaaccggggtttaccgggaccgggttacccgggggttaacctaaccgggtttccgggtttaacggggtttaccggggtcggggtaaacccggggttacgggaaacccggttaaccgtaaaccggggttcccgtaacccgggttacccgttaacggaccggtacccggacccggttttaaccggcccgggtacccttacccccccgggg

SEQ ID NO: 130704 - DNA, 883 bp, Homo sapiens
  misc_feature: GYAE6OF02F8TFT.22.36.D03.1.454.CMB.1.raw
  modified_base (186)..(186): a, c, t, g, unknown or other
  misc_feature (186)..(186): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcgagggcacagggtccgtgggcccagtctgccctgacccagcctgccctccgtntccgtggatcgattcgtggacagtcgatacgacgtctactttaccgtgaccgacgtaggggaacccctaaagtacgtagaacctacggttttcggggtttaccttttaggaccttcgttacgttcctaccgttacggtaaccccaaaccgtaaccaccccgaaccggtaccccaaaaacccccccctaattaccgtactacgttaacgttttagtcggttaccgtaccgtaccgttccgggtacccggtccccttacgaacggtacggttccttaccttacccgtacgttccgtccgttacctaccggtcggtaacccgtaacccgttacggtcggttaaacccgccgtaaacccggtacccgggtacccccttaacccttaaccctacgttaccgttcccgggttaaccgggtcctttacccgggtaacgttttacggggaaccggtacgtaaccgtttacctttaaaccggttaacgtttaacacggttaaccgtttaacgttttaacttttaaaccggtacggtaccctacccgttaccgttacgtttaccgggtttcgggttttacccggacggaacggtaccgtaaccggttagtaccggtacccttccgggtacgtcccggtaacgtacccggtaccggtccgttacccggacccccgtttacggtaccctaccggttcccgttaaccccg

SEQ ID NO: 130705 - DNA, 726 bp, Homo sapiens
  misc_feature: GYAE6OF02I7SNB.22.36.D03.1.454.CMB.1.raw
  modified_base (240)..(240): a, c, t, g, unknown or other
  misc_feature (240)..(240): n is a, c, g, or t
  modified_base (257)..(257): a, c, t, g, unknown or other
  misc_feature (257)..(257): n is a, c, g, or t
  modified_base (359)..(359): a, c, t, g, unknown or other
  misc_feature (359)..(359): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacgaggtcctcgggcccagtctcgccctcgacccagcctcgcctccgtgtctggactcagtctggaactagtcgatcagctacttcctgcacgtggaccaanagtgactagtttcggtnttttcgacttcgtcgtactcgttacggtaccaaacaaccacccgtagaaccctaaacccccactacactactattactgtacgtcacgttcgccgcctacgngactctacctacacgtcgcttcctcgaacgcttcaacgtcgtccgacaaactcccggtacccttacctaacccgtaactccgtacgtccgggtcctaccgttacgttacggtaacggactacggttacctttaacgtttacctttacgttacgttacctttaacgtttaaccgtttttaaacgtacggttaccgtaccctaggttaccctttcggggtttcgggttttaccggacgggtacgtaccggtacccgtaagttccggtaacccggttcccttaccggtaccggtaccggtaaccccgaacgggtttcctaccccgggtaccccgttcccggttaccctaccggtttccctttaccccggg

SEQ ID NO: 130706 - DNA, 981 bp, Homo sapiens
  misc_feature: GYAE6OF02GFW7I.22.36.D03.1.454.CMB.1.raw
  modified_base (230)..(230): a, c, t, g, unknown or other
  misc_feature (230)..(230): n is a, c, g, or t
  modified_base (255)..(255): a, c, t, g, unknown or other
  misc_feature (255)..(255): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacgagggtcctgggcccagtctcgccctgacccagcctgccttccgtgtcgtggactcatcgtaggacacggtcgatcgagtctactttccngcctacgtacgggacctaacgagtnacgttagttcgggttcttttaggaccttcgtcgttccttcccgttacgggtaacccctaaaccgaaacccgtacccgaaccgggtaacccccctaaaaaccccccccgaagtaccttaacttaccgtaattttacggtcgggtctaccgtaccgttccggtcccgtcccttccggaaggtacggttcctaccgttactaccggttccttcgtttaccttaccgaacgggtccctaaccgtaacgggttccgtacggaacccgttaaacggaccccggttacccttaacccctaaccgtaccttacccgttcggttaccgggtccgtttacccgggttaacgttacgggtaaccggggtacgttaaccggttaaccttttaacgtttaaccgtttaacgttaccgttaaccgtttaaaccggtttttaccgttttaaaaccggtttcccgggtaaccgttaccccgtttaacgtttacccggggttttaccggtttttccggggggtttaacccgggaccgggggtttaaccggaaccgggttaaaacccgggttaccggtttaaccccggggtaccccggtttacccggggttaaccccggtttaacccgggaccccggttaaaccccgggtaccggttaaccccggtttccccccgggtaccccccgggttttaaccgggtaaccccgttttacccccggttcccggtttttaaaccccccccgg

SEQ ID NO: 130707 - DNA, 779 bp, Homo sapiens
  misc_feature: GYAE6OF02IFQ5H.22.36.D03.1.454.CMB.1.raw
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctcgccctgacccagcctgcctccgtgtctggatcatctggacaggtcgatcagctatttcctgacacgtacgggaacccaacgtaggtcgaactaggtttcggggttctttttaggacttcgttacggtccttaccgtacggttaaccaaacctaaacccacccccgtaacggacccccaaaaccccccctaacgttacccaacttacttaacgttttaacggttgggttacgtccctaccgttcccggtacccggtcccttacgaacggttacgttccttaccgttcgtaccgttcgtcctttactacgtacgggtacctacgtacgttacgaccgtaacaaccgaccgtaccctaccctaacctctccgttcgtcggtacctaccgttaggtacggacggtacgtacgttacctttaacgttaacgttactcgttacttacgtttaaccgtttaacgttacgacccgttacctacgtttccgtttcgggttaccgggtttcggacggtacggttacgtaccggtacggtcccggtcccggttaccggttccggtacgaccgacccgtaacggtcccgtaccggttccccgttccggtacccttcgttcccgttaccccg

SEQ ID NO: 130708 - DNA, 768 bp, Homo sapiens
  misc_feature: GYAE6OF02JSKKJ.22.36.D03.1.454.CMB.1.raw
  modified_base (218)..(218): a, c, t, g, unknown or other
  misc_feature (218)..(218): n is a, c, g, or t
  modified_base (233)..(233): a, c, t, g, unknown or other
  misc_feature (233)..(233): n is a, c, g, or t
  modified_base (236)..(236): a, c, t, g, unknown or other
  misc_feature (236)..(236): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgaccctgacccagcctgcctccgtgtctggatcatctggacagtcgatcagctatttccngcacgtgggaccaangtnactagttcggtctttgactctgtctctacggtaccaacaaccaccacggaccctaaaccccccatacactactactttagtacggtgtacctcgttccggtaccggtcccctacgtaacggggtccttacctcctaccgtacgtcccgttacttcctacggtacgggttaccctaaccgttaaggtccgttcggaaacccgaaccgtccgggtaccccttaaccctaacctacttccgtccgttacgggtccttacccgttagggttacggaacgggtaactacgtttccttaacgtttaacgttccgtagtacgtttaacctttaaacccgttttaaagtccgggaccctacctaccgtttacgtcggggtttttaacggtttcccgggcggtaaacggtccctaaacccggggttagttcccggtaacccggttcccgtaccggttacctaacccgggtaacccgtaaccggtcccgttaacccggtcccccgtttccgggacctttacccgttcccggtttacccccgg

SEQ ID NO: 130709 - DNA, 675 bp, Homo sapiens
  misc_feature: GYAE6OF02JQ3V9.22.36.D03.1.454.CMB.1.raw
  modified_base (277)..(277): a, c, t, g, unknown or other
  misc_feature (277)..(277): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacaggatccgtgggctcagtctcgcctgactcagcctcgctcagtgtccggtctccgtgacagtcagtcacatcctcctacacgtcgaaccagcagtgacttggttaggtgttactactagtcgtcctcgtagtaccanacgaccaccgacgacccaaccgccccagtaccactactactatttacgactcgtatacctaagtaccggccggtaccctcggtaccggggttacctaggtaccgttccgtccgtttacgtcgtaccggtccgttaccgtaccgtcgtaccggaaccgtaaccgtacccgtccccgtacccgttaccgtaccgtaccgttcggtaccggttccggaccgtacccggtacgtcgacggtaacgttcgacggtaacgtccgttaagtacttaaccggttacctggtaccttacgtcgttactgtttccgacgtaccgtcccgtacgttacgttacgggttcggttcgtaccgggacgtacggtaccgacggttcgaccgtaccgttcgtagcccgtacggg

SEQ ID NO: 130710 - DNA, 801 bp, Homo sapiens
  misc_feature: GYAE6OF02FX2GT.22.36.D03.1.454.CMB.1.raw
  modified_base (232)..(232): a, c, t, g, unknown or other
  misc_feature (232)..(232): n is a, c, g, or t
tcagacatacgcgtcacgaccggtgctcgatttagctgcgtcacgatctctcttgggggggggtctcaggaggcagcgctctcgggacgtctccaccatggcctgggctctgctattcctcaccttcctcactcagggcacagggtcctgggcccaggtctcgccctcgacccagcctcgcctcgtgtcgtggtactcatctcggactaggtacgatcagtctactttccgngccacgtacgggaaccaaacgtaggtacgtaactaggttttcggggtttatttttacgaaccgtttcgttacggttcctttaccgttaaccgggttaaaccccaaaaccgtaaacccgaaccccgaaccggaaaccccctaaaacccccccgtaactacctacgttacctatttaacgtcgggtacgttactaccgtcggtccgtaccctgacggtcttactcctactacgtctctcgtacgcgtactactacgtcgtacgtaccaacgtccgacctaccctaatacgtctcggtacggcttacgtagttacggacgtacgtacgttacttaacgttacgttactacgttacttaacgtttaacctttaaacgtcggggacctacccgttacgtttccggttaacggtttttcggggttacccggtaaggtacccgggtaaccgttaaaccgggtacgggttaacccgttcccggtttaccggtaaccgggttccgaaccggttaccgtaacggttcccgttaacccgggtcccctacggttacccgttaccgtttcgttaacccccgg

SEQ ID NO: 130711 - DNA, 859 bp, Homo sapiens
  misc_feature: GYAE6OF02HQK6V.22.36.D03.1.454.CMB.1.raw
tcagacatacgcgtcacgaccggtgctcgatttagctgcgtcacgatctctcttggggggggtctcaggaggcagcgctctcgggacgtctccaccatggcctgggctctgctattcctcaccttccctcactcagggcacaggggtccgtcgggcccagtcgtcgccctcgacccacgcctcgccgtccgtgtccgtggactctatcgtgactacgtcgatccgagtactctttccgcgtaccgacggtacgggtaaccaacgtacggtaacgtaacgttacggttttcggggtttccttttcgtaccgttccgttacgttcccgttcccggtaaccggttaaaccccgtaaacccaaccccgaaccccggttaacccggtaaacccccaaaaaaccccccccgtacctacgtaacctttacctttaacgtttacgtcggttccgttaccgtaccggttccccggtccccgggttaccctaaccgggtaacggttccgttaccgtcccgtttaccgtactccccgtttaccgttaccgttccggtaaccggtcccgttaacccgtacggtacccggttaaccggaaccccggtaacccggtacccggttaacccctaaccccccgtaacttcgtacccgggttccggtaccgtacccttccggttagtttacgaccgttaggtaccctagttaacttcttacttacggtactaccgtttacttacgttaacgtaccggactaccgtccttacggtttcggtcgggttacctaggccgtaacgtaccggtagtccgggtaaccttcggaccgtccaccggtaccgcgttccgtcccgtccgtacggtcctccgttcccg

SEQ ID NO: 130712 - DNA, 840 bp, Homo sapiens
  misc_feature: GYAE6OF02GZBEO.22.36.D03.1.454.CMB.1.raw
tcagacatacgcgtcacgaccggtgctcgatttagctgcgtcacgatctctcttgggggggggtctcaggaggcagcgctctcgggacgtctccaccatggcctgggctctgcttattcctcacctttcctcactcgagggcacgacgggtcctgggccctagtctcgccctcgacccagcctcgcctccgtgtctcggatcatcgtgacagtcatcagtactactttctgactacggtacggaaccaactacgtgactaggtttgggtttcttttcggacctttcgttcgttaccttacccgttacggtaaaacccaaacccgaaaccctaacccccgaaaccggtaaaccccccctaaaaaccccccccgtaatacctaactttacttaacgttttacggtcgggtttacttacccgtacccggttccggtaccccgggtacccttacggaacggttaccttccgttaccctacttaacgttccgtcctttaccgcgggtacgttaccgttaccgtaaacgttcgtaccggaacctaacccggtcccggttaacccttaacccctaactcgtaccgttcccggtcggtcccttacgtaaggttcggtaaccggtcggtacctttacgttaccgttactttacgtacgttacgtttaccttttaacggttaacctcggtaccccttccgaccgttttgggttaccgtttcgggttaccggacggtacgtaccccgaacgggttacgtacccgtccggttcgtccggtaacgccgttaacccgggtacttccccgggaccctttacccggccgtttaccgtcccggttccccttacccgg

SEQ ID NO: 130713 - DNA, 870 bp, Homo sapiens
  misc_feature: GYAE6OF02I4342.22.36.D03.1.454.CMB.1.raw
  modified_base (221)..(221): a, c, t, g, unknown or other
  misc_feature (221)..(221): n is a, c, g, or t
  modified_base (241)..(241): a, c, t, g, unknown or other
  misc_feature (241)..(241): n is a, c, g, or t
tcagacatacgcgtcacgaccggtgctcgatttagctgcgtcacgatctctcttgggggggggtctcaggaggcagcgctctcgggacgtctccaccatggcctgggctctgctattcctcaccttcctcactcagggcacagggtcctgggcccagtctgccctgacccagcctcgcctccgtgtctggatcatcgtggacagtcgatcagctatttccngcacgtcggaaccaacagtnacgtagttcgggttctttgactctcgttcctccgtacggaacccaaaccaaaccctaccccgaacggaaccccccaaaaccccccctaacgtacctaacttacttagtttagtcggttacgtcctaccgtccggtccccgtacccgttacgacggtaccgttcctacctacgtaccgtcgttcctttaccaccggtaccggtacccttaccgtaacggttccgtacggtaacccgtaacccggtaccggtaccccccttaccctaaccctaccttacccgtccggtaaccgggtccctttaaccggttaccggtttacgggaaccgggttaaccgttaccgggttaaccctttaacttttaaccgttaccggttacgttacccgtttaacccggtttttaaaccgtttaaacggttaccgggacccgtttacccgtttaacccgtttacggttttacccggggtttaccggggttttaccggggacccgggttaaccggaacccggttaccgtaacgggtcccgttaccccgggttccgtttacccgggaccgtaacccggtaccccggttaagggccccgttcccgggtaaccccggttcgtacccttaccggtccctttacccccgg

SEQ ID NO: 130714 - DNA, 776 bp, Homo sapiens
  misc_feature: GYAE6OF02FM4Y9.22.36.D03.1.454.CMB.1.raw
  modified_base (223)..(223): a, c, t, g, unknown or other
  misc_feature (223)..(223): n is a, c, g, or t
  modified_base (262)..(262): a, c, t, g, unknown or other
  misc_feature (262)..(262): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtcctggactcatcgtggactagtcgatcagtctatttccngcacgtcggacacgagtcgactagttggttctttgactntcggtctccgtggtaaccaactaaccacccgacggtaccccaaaacccccccaagttccaattcctaattttacgtcgggtacgtacctaacgtccggtcccggtcccctacgaagggtacgtctccgtactacgtcgtacgtttctacgtgggtcctaccgtaacggttcgtacggaccgtaaccgtacccgggtaccctaccccgttaaacgtaccttccgttacgtccggggtaccttccgtacgggtttagaaccgggtacgtacgttaccttaacgtttacttacgcgttaccgtttaccgtttaacgtttaaacgtacggtaccgtccgtaccgtttcggttcgggttttaacgggttccgggacgggtacggtaaccgtaacccgggttagttaccgggtacccgtttaccgggtacggtacccgaaccggtaccccggtaaacggtccccgttccgggtaaccccccggttcgtacccggttacccgttcccgttacccccccggg

SEQ ID NO: 130715 - DNA, 868 bp, Homo sapiens
  misc_feature: GYAE6OF02HCIF2.22.36.D03.1.454.CMB.1.raw
tcagacatacgcgtcacgaccggtgctcgatttagctgcgtcacgatctctcttggggggggtctcaggaggcagcgctctcgggacgtctccaccatggcctgggctctgctacttcctcaccttcctcactcgagggcacgagggtcctcgggccagtctcgccctgacccagcctgcccgtccgtgtcgtggactcatcgtaggacagtcgatcacgctacgtttcctgccgtacgtacgggaaccaagtacgtacgacttacggtttcgggtttacttttacgacttcgtcgttccgtccgttacggttaaccaaacctaacccgaacccgaaccgggaaacccccaaaaccccccgtaacttacctacttacgttaacgttttacggtcggttacgtaccgtaccgttccgggtacccgtcctacggtaacggtacgttcctacgtacctacgtccgtcgtttaccgtcggtaccgtacccgttaccgttaacgttccggtaccgtaacccgtaaccggtacccggtaccccgttaaaccctaaccgtacccgttaccgttcggtaccgggtacccttacggtttaacgggttacggtaacggtaaccgtcgttaccgtttaacgtttactttacgtacgttacgtttaacgttttaaccgtttaaacgttccgggttacctaccgtttccggtttccggtttcgggtttaccgggtttacgggtaccggtaccgggttaccgttaacccgggtacgttcccggttacccgggttaaccggtaccgtaccggtaaccggtacccgtaggtccccgttccggttaccccggttcggtttaccccgtctttcccggttaccccgg

SEQ ID NO: 130716 - DNA, 762 bp, Homo sapiens
  misc_feature: GYAE6OF02IMXFV.22.36.D03.1.454.CMB.1.raw
  modified_base (183)..(183): a, c, t, g, unknown or other
  misc_feature (183)..(183): n is a, c, g, or t
  modified_base (220)..(220): a, c, t, g, unknown or other
  misc_feature (220)..(220): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctggccccagtctgccctgacccagcctgcctccgtntctggatcatctggacagtcgaatcagctactttccngcgaacgtcgggaaccaaacgacgttagacgtagttttcggggttcctttttacggacctttcgtcgttccgttacccgtacggttaaacccaaaacgtaaacccaaccccgaaacgggtaacccccaaaaaccccccccgtaataccaacgttacctaagttttaacgtcgggttactacccgtaacgttccgggtacccgtccttacgaggtacgttcctactctacgtccgtcttcgtcgacggtctaccacggtcgtcgactaaccgcgtacccctacctaaactctacgtacgtcggtacctacgttacgttggaacgtacgtacgtttaccttaacgtttactaccgttacgactttaacgttttaaccgtttaaaagtccggccgttaccgtccgtacgtttccgggtttggtttaccgggcgggtaacgtaccgaccgttacggtaccggttaccgtccggtaccgtacgtacccggtaaccgaacggttaccgtccccgtaccccttacgggtcctaccgttacccgttcccc

SEQ ID NO: 130717 - DNA, 815 bp, Homo sapiens
  misc_feature: GYAE6OF02HHX9Y.22.36.D03.1.454.CMB.1.raw
  modified_base (208)..(208): a, c, t, g, unknown or other
  misc_feature (208)..(208): n is a, c, g, or t
  modified_base (351)..(351): a, c, t, g, unknown or other
  misc_feature (351)..(351): n is a, c, g, or t
  modified_base (524)..(524): a, c, t, g, unknown or other
  misc_feature (524)..(524): n is a, c, g, or t
tcagacatacgcgtcacgaccggtgctcgatttagctgcgtcacgatctctcttggggggggtctcaggaggcagcgctctcgggacgtctccaccatggcctgggactctgctattcctcaccttcctcactcagggcacgacgggtcctgggcccagtctcgccctgaccctgcctgcctcgtgtcctggactcagtcgtggacgngtcgatcgagcctactttccgtcgcacgtcgggaaccaagaggtactacgtagtttccggggttcttttcggaccttcgttcgttcctccgtacgtaaccctaaacgacccaaccgtaccggaacccccaaaccccccctaanaccttaacgttacttaaacttttcggttcggtcgttacctaccggttacccggtcccggtccccgtaacgtacggggtaccttccgttccgtactacgttccgtttacctttcccgaacggttaaccgttacccgttaccgtaaacggtttaccgacggaacccgtaaacccncccgggtaacccccttaaccgttaacccgtacctttaccgttccggttaccggtaccttaccggttacgttacgggaaccgggtacggtaaccttactttaacttacgtttacctgttactttaccgttttaactttacgttacggcccttacgtaccgttccgtttacgggttcgggtttaccgggaggtaccgttacgaccgtacggtccggtcccgtccggttacgtaccgacccgttccgaccggtcccgtccgttaccccgtccgtacctacccgttcttcccccg

SEQ ID NO: 130718 - DNA, 792 bp, Homo sapiens
  misc_feature: GYAE6OF02JDYHD.22.36.D03.1.454.CMB.1.raw
  modified_base (127)..(127): a, c, t, g, unknown or other
  misc_feature (127)..(127): n is a, c, g, or t
  modified_base (468)..(468): a, c, t, g, unknown or other
  misc_feature (468)..(468): n is a, c, g, or t
tcagacatacgcgtcacgaccggtgctcgatttagctgcgtcacgatctctcttggggggggtctcaggaggcagcgctctcgggacgtctccaccatgcctgggctctgctattcctcaccttccncactcgagggcacgagggtccgtgggccctagtctcgccccgtcgacccagcctcgccctccgtgtcgtggactcctagtccgtacggaaccgtacgttcggaactccgacgtaccttaaccttttcccgacgaccgtaaccggtaccgggaaacccaacgtagtacgaccgttagtttgggttttacttttcggaccttcgttcgtccgttccgtaacgtaacccaaaccacccgtaacccgaccgaaccccccaaaaccccccgtataccgtaccttagttatttacgggtggttccgtacctaccgtccggtacccgtcccgtacgagttccgttacnctacgtctccgttctccgtacgacgtactacctagtccacgaacccgacgtcccgttacccaccctaccgtacttcccgtacgttccggaccgtttaccgttagtacggaacgtaccgttaccgttaactttaacgtttagttctaaccgttacgttaaacttttaccgttaacggtccgttaccctccgttaccgtttcggttccgggtttaggtccgggcggtaagtcccgtaacggtacgtcgtaccggtccggttcgaccgtaccgtacgtaccgtccgtccccggtacccgttccgacccttaccggtccttaccccgg

SEQ ID NO: 130719 - DNA, 984 bp, Homo sapiens
  misc_feature: GYAE6OF02GFMIL.22.36.D03.1.454.CMB.1.raw
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtccgtgggcccagtctcgccctcgacccagcctcgcccttccgtgtcctggactcactcgtacggtacacgttcgatccagtctacttttcgacgacctaccgtcgggaaccaacgtacggtacgtaaccgttaggtttcgggggttttaccgttttacgtaccctttccgttacgttcccgtttaacccggttacccggttaaaacccctaaaaccgaaaccccccgaaacccccggtaaacccgggaaaacccccccccaaaaaaccccccccccttaactacccgttaacctttaaccgttaacgtttttaacgtacggtttaccttaaacccgtccgttaacccgggttccccggttacccgtaccggtacggtaacttccgtaccttacgttcccgttacccgttaccgtttcctacggtaaccccgtaccgttaacccggtaacgttcgttacccggtaaaccacccggtacccccggtttacccttaaacccctaactccgtttccggtttccgtaccgggtacctttacccggtaggttaacggaccgttaccggtaactttccgttaaacttttacgttaccgtacctttacgttaaccgttttaaaccgttacgggttaccgtaccgttccctttacggtacctttccggggtttttacgggtaccggtaaccggtcgacccgttaaccggttaacgggtccccgttacccggtttacccggaacggttacccccggtaacccgtaccgggtttacccgttaccccggtcccccggttaccccgttaccggttaccccgttaccccggttttacccccttaacccccggg

SEQ ID NO: 130720 - DNA, 549 bp, Homo sapiens
  misc_feature: GYAE6OF01CCZPX.16.80.H03.1.454.CMB.1.raw
  modified_base (425)..(425): a, c, t, g, unknown or other
  misc_feature (425)..(425): n is a, c, g, or t
  modified_base (450)..(450): a, c, t, g, unknown or other
  misc_feature (450)..(450): n is a, c, g, or t
tcagtgtactactccacgaccggtgctcgatttagctgtgcgtcgaagggaaagggggctgtgggagaggagccccaggcccgggattcccaggtgtttccattcagtgatcagcactgaagacaggagactcatcatggagttctggctgagctgggttctccttgttgcctattttaaaagatgtccagtgtgaggtgcagctggtggagtcgtgggggaggcttggtccgaggccgggggggtccctggagactctcctgttcagcctctggattcatcttcagcggtttcgctatgcactgggtccgccaggcctccgaggaagggactggaatatgttcagctattagttataatgggggtaacacatactacgtcagactcagtgaaggcagattcaccatctccagagacaatccaanaacacgctaggatcttacaaatganctagtccttaggagagcgtaggacggacgacggtctggtgttattacgtggttagtaagtaaagtcgttttaccggtagtccttaacgtacgtaaaccg

SEQ ID NO: 130721 - DNA, 579 bp, Homo sapiens
  misc_feature: GYAE6OF01A8NSQ.16.80.H03.1.454.CMB.1.raw
  modified_base (504)..(504): a, c, t, g, unknown or other
  misc_feature (504)..(504): n is a, c, g, or t
tcagtgtactactccacgaccggtgctcgatttagctgtgcgtcgaagggaaagggggctgtgggagaggagccccaggcccgggattcccaggtgtttccattcagtgatcagcactgaagacaggagactcatcatggagttctggctgagcgtggttctccttgttgccattttaaaagatgtccagtgtgaggtgcagctggtggagtcgtgggggagcttggtccgaggccgggggggtccctggacgactcctcctgttcagcctctggattcattcttcagtcggttttcgctagtgcacgtcgggtcccgccgaggcctccgaagggaaagggactggaatagtgtttcagtctattagttataagtggggtaacactatactacgctagactcgagtgaagggcagtatacacatcctaccagacgaactaacttacccgaagaaccacgtcgtaggacttacttacaaagtgaagacagtcgtagagcgtacgnggaacggacacggtctagttgtattacgtgtagtagtaaagttacgtttccggtagtccttaacgtacgtaaccg

SEQ ID NO: 130722 - DNA, 880 bp, Homo sapiens
  misc_feature: GYAE6OF01B4F15.16.80.H03.1.454.CMB.1.raw
  modified_base (184)..(184): a, c, t, g, unknown or other
  misc_feature (184)..(184): n is a, c, g, or t
tcagtgtactactccacgaccggtgctcgatttagctgtgcgtcgaaagggaaagggggctgtgggagaggagccccaggcccgggattcccaggtgtttccattcagtgatcagcactgaagacaggagactcatcatggagttctggctgagcgtgggttctccttgtgcctaatttaaagntgtccagtgtgaggtgcagcgtggtggagtcggtgggggaggtcgtttgggtccgacggggtccccggggggggtcccctggacgtacccttccttcccgttagttccgacgtcccttcgtcgggtaactttcctaacttcctttccgtacggttccgggttttccgtaccgttaatcggtcctaaccggttccgggggttaccccgcccggtaaccgggtcccgttaccccggaaacgggggtaaaacggggtaaccgttaaggggtaaaactttaacgtttacggtttttaccgtaacggttaccgtttaaagttttaacggttttaaagttaaaacgggtttaacgggggggtaaaactaaccgtaacgtaacgttaaccgtacgtaacgtaccgtacgtaacggtacgggaacgggtacgtaacgtaactttacccgaacctaacgttaccccgtacccgaaacggaaccggtaaacctaaaccttaccccgaaacggtaaacccgaaccggttaccgttacgggtaaacctttaccgtttaaaccgtaaacgtttacggaacgttaccggacgttacggttacgaagggtacggacgtaggaacggtaaccgaccggtacgttaggttacgttagttacgttaggttagtaagtaacgttacgtttacggtgtacctacgtaacgtaaccg

SEQ ID NO: 130723 - DNA, 792 bp, Homo sapiens
  misc_feature: GYAE6OF01D2PRN.16.80.H03.1.454.CMB.1.raw
tcagtgtactactccacgaccggtgctcgatttagctgtgcgtcgaagggaaaggggctgtgggagaggagccccaggcccgggattcccaggtgtttccattcagtgatcagcactgaagacaggagactcatcatggtagttctggctgagtcgtgggttctccttgttcgacctaattttaaaagatgtaccagtgtgaggtgcagtcgtggtggagtcggtgggggagtcgttggtccgagggcccggggggtcctggacgtacctctccgtgttcgacgtcctgtggtacttctattccgttcgacggttccggtttcgacgttagtcggcctacggttcgggtccccgtccgacggccgtacccggaaaggggtaaacggtaacgttaggtaacgttatttacggtttacaacgttagtttaagtttaagtttaagttaaaggttacgggggtaaacctaacgtaacttaacgaacgtacgtaagtaaccgtcgtaagggtaaggaacgggtacgtaagtaccttaccaacctactacctaacgaagtaaccgtaacctaaccgtaacccgaacgtaaccgacgtaccggtacgtaacttacgtaactaaagtcggtaacgtcgtaacggttacgtaggaaccggtacgtacgtacgggaacggtacccggaccgggtacttaccgggttaagtttaacgttaaccggttggttaacggttaaacggtaaacgtttacggttaccgttaacgggtaacccgttaacccgtaaacgtttaaacccgg

SEQ ID NO: 130724 - DNA, 816 bp, Homo sapiens
  misc_feature: GYAE6OF01EVYZ3.16.80.H03.1.454.CMB.1.raw
  modified_base (189)..(189): a, c, t, g, unknown or other
  misc_feature (189)..(189): n is a, c, g, or t
  modified_base (651)..(651): a, c, t, g, unknown or other
  misc_feature (651)..(651): n is a, c, g, or t
tcagtgtactactccacgaccggtgctcgatttagctgtgcgtcgaaaggggaaagggggctgtgggagaggagccccaggcccgggattcccaggtgtttccattcagtgatcagcactgaagacaggagactcatcatggtagttctggctgagcgttgggttctcttgttgactaattttaaaagntcgtcagtgtgaggtgcaggcgtgggtggtacgtcggtgggggacgttcgttcgggtccgacggggtcccggggggtccctggacgtctccgttcgtgttcgacgtcctcgtggtaattcaacgttcttacgaggttccggttactacttagtcgcgttaccggtcgggtcccgccgacggccgtacggaagggaaacgggtacgtaggtaaattgttacgttataacggtacttagttaacgtttagttaaaggtacggggtaaactacgtaattaccggtacgactaagtactacgtaaggacggaacggacgtacgtacgtacccaacctagttacccaagaaaccgacgtaaaccttaccgttaacccgaagaaaccccgtcgtaccgtaaggttaccttacccgttaagtaactacgggttaacaccggtacgtttacggagggtaagttaaccggnggaaaccgtaaccgggaaccgggttaccggtacgtttcggggtttaaactttaccggtttaacgggtttaccgggtaaacggtttaaaaggttaacggtttaacccggttttacgggaacccggtttaaccgtttaaaccccggtaaccccttttaaaacccggg

SEQ ID NO: 130725 - DNA, 840 bp, Homo sapiens
  misc_feature: GYAE6OF01BHMAJ.16.80.H03.1.454.CMB.1.raw
tcagtgtactactccacgaccggtgctcgatttagctgtgcgtcgaagggaaagggggctgtgggagaggagccccaggcccgggattcccaggtgtttccattcagtgatcagcactgaagacaggagactcatcatggagttctggctgagtcgttgggttccttccttgttgtacctaattttaaaagattgtcagtgtgaggtgcagcgtgggtggaggtcggtgggggagtcgttcggtccgcggggtcccggggggtcctaggacgtccttccgtccgttgttccacgtccgttcgttggtacttcctactttcctttaccgtacggtttccgggttttccgtcttacgtcggtacccgtaccgggtttccgggggtaccccgtacccggtaccggggtccccgtaaccgggaaagggggtaaacggggtacgttaaggtaagttacgttcgtttaccgtacgttacgtttaagtttaagtttaaaggttaaagggttaacgggggtaaaactaacgtaactaaaccgtaccgaacgtaacgtaaccgttacggtaaagggtacgggtaacgggtacctaacggtaccttaacccgaacccgtaaccttacccgtaccgtaaacggtaaccgtaaaccctaaaccttaccccgaaacgtaaacccgtaaccgtacgtacgttaaccttaaccgttaaactaagtacggacgtacgtacgtacgtagaacgtacgtacgtaggacggacgacggtacgttaggttacgtttagttacgttggttaggtaacggttaagttccgttacggtaggttaccttaacgtacgttaaccg

SEQ ID NO: 130726 - DNA, 834 bp, Homo sapiens
  misc_feature: GYAE6OF01A8KFB.16.80.H03.1.454.CMB.1.raw
  modified_base (211)..(211): a, c, t, g, unknown or other
  misc_feature (211)..(211): n is a, c, g, or t
tcagtgtactactccacgaccggtgctcgatttagctgtgcgtcgaagggaaaggggcgtgtgggagaggagccccaggcccgggattcccaggtgtttccattcagtgatcagcactgaagacaggagactcatcagtggagttctggctgagtcgtggttctccttgttcgacctattttaaagatgtccagtgtgagtcgcagctggnggagtcgtggggacgtcgtggtccgaggtccggggggttcctggacgtactccgtccgtgttacacggtcctcgtgtacttcgacttcttaccgacgtcggtttccgacttacgtcgtcctacggtccgggtcccgaccgtacggtaccgttaccgaacgggtaaacgggacgttaggtaacttagttcgttaccgtagtacttagtttaacggttaagttaacgggttaacggggaacctacgtaaccttaacgtaaccgcgtaacgaccttacggaggtaacgggtaacgaccgttaagtaccgtttaaacccgaccgtaaccgttaccgtaaccccgtaaggaaccgtaaaccttaacccgtacccgtaaaggaaccccgtaacggtacccgtaagggtaacctttacgttaaccgtaacgttacggaaccggtactaacggggttacctacgggtaaccagggttaccgtaaggggtaacccaacgggttaccccggttaggtttaccgggttagtttaaacccgttacggttaacgggttagttaaaccggttaaacgttttaccccgggttaccggtaaccttaccccgggttaaacgttaacccggttaaaccccg

SEQ ID NO: 130727 - DNA, 892 bp, Homo sapiens
  misc_feature: GYAE6OF01CYKB7.16.80.H03.1.454.CMB.1.raw
  modified_base (186)..(186): a, c, t, g, unknown or other
  misc_feature (186)..(186): n is a, c, g, or t
tcagtgtactactccacgaccggtgctcgatttagctgtgcgtcgaagggaaagggggctgtgggagaggagccccaggcccgggattcccaggtgtttccattcagtgatcagcactgaagacaggagactcatcatggagttctggctgagctgggttctccttgttcacctaattttaaaagntgtcctagtgtgaggtgcagcgtgggtggacggttcgggtaggggggaggtccgttgggtcccggacgggggtcccggggggggttccctggaacggtcctccgttccgttacggttccgacgtcccgttcgtacgggtactttacctacttccgttacgacgggttccggtttcgtaccgtagtcggaccgtcggttccggggtcccgaccggacggtcccgtaccggaaagggtaaacggggtctaggtaaacgtttagttcggttacgacgttactttaaagtttaggtttaaagttaacgggttacgggggaaactaacgtaattacgacgactacgtactacgtaggtacgggaacgggcgtaacgtacgttacccgtaaacacgtttacccgaaccgaacgtaacgtaaaccggttaacttaccccgaaaacggtaaccctacggtacgtaaccgggttaacttaaccgtttaacgaaacgttaccgtaacggtaccgtaacgggttacgtacgggaaagtccggttaggaacgggtaacggacccgggttacccgggttacgttaggggttttaaacccttagggttttaaccggttggtttaacgggtttaaaaacgggttaacggttttaccgggttttaacccggtaccgggtttaaaacccctttacccgggtaaacccggttttaaaacccggg

SEQ ID NO: 130728 - DNA, 770 bp, Homo sapiens
  misc_feature: GYAE6OF01AVU0P.16.80.H03.1.454.CMB.1.raw
tcagtgtactactccacgaccggtgctcgatttagctgtgcgtcgaagggaaagggggctgtgggagaggagccccaggcccgggattcccaggtgtttccattcagtgatcagcactgaaagacaggagactcatcagtggagttcgtggctgagtcgttgggttctccttgttcgacctaattttaaaagatcgtccagtgtgtaggtgcgagtcgtggtgggtaggtcggtgggggacggtcgttcggtccggaccgggcccggggggtccctaggtacgtaccttccttccgttgttacacgtcccgttcgtcggtatttcgtacttcgttccgtacgttccgggtttccgtacttacgtcgtaccgtaccggtccgggtacccgtccggtacggtcccgtaccggaaggggtaaacgggtacctaggtaagttagtttagttacgtagttacctttaagtttaacggtttaaagttaacgggttacggggttaaactaacgtaacttacgtacgtacgtacgtacgtacggtagtaacgggacgagtacgtactacccgactaccgttaccgacgtaagaaccgaacgtaaccgttaccgaaacgtaacgtaccgtacgtaacgtaacttactaaaccgtaagtacggaactacgtacgtacgtaaggacgtacgtacgacgtacgacgtaccggtaacgtgttacgttagtagtcgttaacggagttaacgttcgttacggagttaccctagtaaccgtaaccg

SEQ ID NO: 130729 - DNA, 511 bp, Homo sapiens
  misc_feature: GYAE6OF02HMBJZ.16.80.H03.1.454.CMB.1.raw
tcagtgtactactccacgaccggtgctcgatttagctgtgcgtcgaagggaaagggggctgtgggagaggagccccaggcccgggattcccaggtgtttccattcagtgatcagcactgaagacaggagactcatcatggagttctggctgagctgggttctccttgttgccattttaaaagatgtccagtgtgaggtgcagctggtggagtctgggggaggcttggtccaggccgggggggtccctgagactctcctgttcagcctctggattcatcttcagcggtttcgctatgcactgggtccgccaggctccaggaagggactggatatgttcagctattagttataatgggggtaacacatactacgcagactcagtgaagggcagattcaccatctccagagacaatccagaacacgctggatcttacaatagagcagtctagagagctagaggacacggctgtgtattactgtgtagaagtacgttcgtggctacgtacgtacg

SEQ ID NO: 130730 - DNA, 708 bp, Homo sapiens
  misc_feature: GYAE6OF02ICPBJ.16.80.H03.1.454.CMB.1.raw
  modified_base (207)..(207): a, c, t, g, unknown or other
  misc_feature (207)..(207): n is a, c, g, or t
tcagtgtactactccacgaccggtgctcgatttagctgtgcgtcgaagggaaagggggctgtgggagaggagccccaggcccgggattcccaggtgtttccattcagtgatcagcactgaagacaggagactcatcatggattctggctgagcgtgggttctccgttgttgcctaattttaaaagatgtccagtgtggaggtgcagntggtggagtcgtgggggagtcgttggtccgagggtccggggggtcctggacgtacgtcctcgttcgtacacgtcctcgtggtacttctattctttcgacggttcggtttcgcgttatcgcgtaccgtcggtcccgccgacggtccaccgaaggaaagggcgtaggaataagttcgttacgagacttagtaagtttagtaaggtacgggtaacactaagacgtacgactaagactacgagtacgaagggctagtacttacaaccgtactccgtacacgtaacgtaacctaacttaaccccgaagtaaaccgaaccgtcgtaacggtacttaaccgtaaccgtaaagtacgaaccgtagtacgtacgtagtacggtacggacgtaggacgtaaccgtacgggtaccgttaggtaacgtttaacgttaaccggtggttaagttaccgtaaaggttaccgtttaaccgggtaccgttacccgttaaccggttaacgttaaacccg

SEQ ID NO: 130731 - DNA, 950 bp, Homo sapiens
  misc_feature: GYAE6OF02I02TJ.16.80.H03.1.454.CMB.1.raw
tcagtgtactactccacgaccggtgctcgatttagctgtgcgtcgaagggaaagggggctgtgggagaggagccccaggcccgggattcccaggtgtttccattcagtgatcagcactgaagacaggagactcatcatggagttctggctgagctgggttctccttgttgccattttaaaagatgtccagtgtggaggtgcagcgtgggtggagttcgtgggggaggtcttcgggtccgacgggtcccgggggggtccctaggacgaccttccgtcccgttgttccacgtccttcgtaggtacgttcctaatttccttcgtaacggttccgggtttttccgacgtttaacgtcggaccgttaaccgggttccgggggttcccccggaccggtacggggaccccgttaacccgggaaaacggggggaaaaaccgggggtaccggtttaaggggaaaattttacggttttaccggttttaacggtaacggttaccgttttaaaggtttttaaggtttttaaaacggttaaaacgggggttttacggggggttaaaaaccctaacggttaaacgtttaaccgttaaccgggactaaacgggtaacttaccggtaaagggttacgggtaacggggaccgtaaaggtaccctttaaccgaaacccgtacttacccgtaccgaaggtaaccgaaaccgttaaacctttacccccgaaagtaaacccgacggtacccgttagggttaaacctttacccgttaaactaaacggttacggtaacgacccggttaacggttaggttaacggacgtaacgaccggttaacggaacgggaccgtacgggtacggttacggttaaggtttacgtttaacggttaggttaacggttaaggttaaacggtttacggttttacccggtacgggttaacccgtttaacccgttaaccggtaaacccg

SEQ ID NO: 130732 - DNA, 536 bp, Homo sapiens
  misc_feature: GYAE6OF02IU5R2.16.80.H03.1.454.CMB.1.raw
  modified_base (392)..(392): a, c, t, g, unknown or other
  misc_feature (392)..(392): n is a, c, g, or t
  modified_base (416)..(416): a, c, t, g, unknown or other
  misc_feature (416)..(416): n is a, c, g, or t
  modified_base (444)..(444): a, c, t, g, unknown or other
  misc_feature (444)..(444): n is a, c, g, or t
tcagtgtactactccacgaccggtgctcgatttagctgtgcgtcgaagggaaagggggctgtgggagaggagccccaggcccgggattcccaggtgtttccattcagtgatcagcactgaagacaggagactcatcatggagttctggctgagctgggttctccttgttgccattttaaaagatgtccagtgtgaggtgcagctggtggagtcgtgggggaggcttggtccaggccgggggggtccctgagactctcctgttcagcctctggattcatcttcagcggtttcgctatgcactgggtcccgccgaggctcccgagggaaacgggactggaatagtgtttcagtctattagttataagtggggtaacactatacgtagcagactnagtgaggcagatcacatcacaganacaatacccagaacacgctggatcctanaactgagacagtctagagagcgtagagacgcggactgtgttattacgtgtacgtagtaacgtagtttccggtgtacgttacctacgtaaccg

SEQ ID NO: 130733 - DNA, 748 bp, Homo sapiens
  misc_feature: GYAE6OF02JADO2.16.80.H03.1.454.CMB.1.raw
  modified_base (272)..(272): a, c, t, g, unknown or other
  misc_feature (272)..(272): n is a, c, g, or t
tcagtgtactactccacgaccggtgctcgatttagctgtgcgtcgaagggaaagggggctgtgggagaggagccccaggcccgggattcccaggtgtttccattcagtgatcagcactgaaagacaggagactcatcatggagttctggctgagctgggtctccttgttgcctattttaaaagatgtccagtgtgaggtgcagctggtggagtcgtgggggagcgttggtccgaggcccgggggggtccctggacgtactccgtcctgttcngcctctggatcatcttcagtcgtttcgctagtgcacgtcgggtcccgccgtaaggcctaccgaagggaaaacgggaccgtagggtaaacttagtgttttacgaaggtcttaagtttaggtttaaataaaggttacgggggtaaaccaacgtaattaaccgttaacgacgagtaacctacgtaagtagggaacgggccaagtactacccgaaccaatccctacgaagaacgtaacctaaaccgttcccgaaacgtaaaccgaaccgtccgttacgggacttacctttaacgtaaaacgttggaaaccgtacgtaacggttacgtaaccggtaagaccgggttactagggtaaaccgggtaacgaccggggttaaccgtttaggtaacggttttaaacttaccgttaaggttaccggtaaggtaacggtttaacgtttcccggttacgggtacctttaaccggtaaccggttaaaccc

SEQ ID NO: 130734 - DNA, 779 bp, Homo sapiens
  misc_feature: GYAE6OF02FMU26.16.80.H03.1.454.CMB.1.raw
  modified_base (298)..(298): a, c, t, g, unknown or other
  misc_feature (298)..(298): n is a, c, g, or t
tcagtgtactactccacgaccggtgctcgatttagctgtgcgtcgaagggaaagggggctgtgggagaggagccccaggcccgggattcccaggtgtttccattcagtgatcagcactgaagacaggagactcatcatggagttctggctgagctgggttctccttgttgcctattttaaaagatgtccagtgtgaggtgcagctggtggagtcgtgggggaggtcgttgggtccgagggcccgggggggtccctggacgtacctctcctgttcacgcctcgtggattcattcttcgngtcggtttcgctactcgacgtacgtcgggtcccgccgacggcctaccgaagggaaacgggtacgtaggtaaagttacgttggttttacagttacttaagtttaacggtttaagttaaggttagggggtaaactaacgaacttaacgtacggacgtaacgtaacgtacgtaaggtacgggaaggcgtaaagtacgttaccaccgtactaccgtaccgaagaacgaaccttaaaccgttacccgaaacgtaaacccgaaccggtccgttaacggtactttaaccgttaacgttaaacgtaggtacgtaccgtaagttacgttaacgggaacgacgtccggaacgggtaacgaacggttaccgggtagttacgggttaacgtttaacggtttacggttagggtttaaccggttaagggttaaaggttccggttttaacccgggtacgggtttaacccgtttaccggtaaccggttttaaacccg

SEQ ID NO: 130735 - DNA, 642 bp, Homo sapiens
  misc_feature: GYAE6OF02IPNPM.16.80.H03.1.454.CMB.1.raw
  modified_base (212)..(212): a, c, t, g, unknown or other
  misc_feature (212)..(212): n is a, c, g, or t
tcagtgtactactccacgaccggtgctcgatttagctgtgcgtcgaagggaaagggggctgtgggagaggagccccaggcccgggattcccaggtgtttccattcagtgatcagcactgaagacaggagactcatcatggagttctggctgagctgggttctccttgtgccattttaaagatgtccagtgtgagtgcagctggtggagtcgngggggagcttggccgaggccggggggtcctgacgactctcctgtcagctctggtattcatcttcgagcggtttcgcttatgctacgtcgggtccgccgtagggcctccgagggaaacgggctaggaatattgtttcagtcttattagttagtaagttcgggggtaacactactactacgacagactacgagtaggaaggcgagtacgtaccacactctaccgagtacgaactaacttaccgaaacgaaccacgtcgtaacgtacttctaacaagtgacgacgtacgtcgtagcgtaacggcgttaacgggacgtaaccggaccggtacgttcggttaacgttaagtttaccggttaggtttacgtaacgggttaaaacggttcgtttttaccgggtaacggttaccctttaccggtaacggttaaccccg

SEQ ID NO: 130736 - DNA, 858 bp, Homo sapiens
  misc_feature: GYAE6OF02HENXN.16.80.H03.1.454.CMB.1.raw
tcagtgtactactccacgaccggtgctcgatttagctgtgcgtcgaagggaaagggggctgtgggagaggagccccaggcccgggattcccaggtgtttccattcagtgatcagcactgaagacaggagactcatcatggagttctggctgagcgtgggttctccttgttgcctaattttaaaagatgtccagtgtgaggtgcagctgggtggagtcggtgggggagtcgtttcggtccgacgggcccggggggtccctggacgtacctcctccttggttcacgtcctcgttggtacttcacttccttcgtacgtccggtttcgcttagtcgtactacgttccgggggtacccgaccggaccggtcctaccgggaaagggtaaacggggtaacgttagggtaaagtttagtttacgtttacgacgtactttaagttaaagtttaagttaagggttacggggtaaacctaacgtaactaacgtaacgacgaacgtacctacggaaggttacgggaaacgggtctaacgtaacgtttacccaaaccgttactaccgtaaccgaaggtaaacgtaaccctaaaccgttaccccgaacgtaaaccgaaccccggttacgttaacgggtaaccttttaaccgtaaccgttaaacgttacgggacgtaaccgttaaccgggtacgttaacgggtaacgtacgggtaccggtttaaacggggaccgggtaaccggtacccgggttccggttaggttaaccggtttaacgttttaccggttaggtttaacgggtaaccgttaaaggttttacccggttttacccggacggtttaacccgttaacccggttacccggttaaacccgg

SEQ ID NO: 130737 - DNA, 765 bp, Homo sapiens
  misc_feature: GYAE6OF02JO37V.16.80.H03.1.454.CMB.1.raw
  modified_base (177)..(177): a, c, t, g, unknown or other
  misc_feature (177)..(177): n is a, c, g, or t
  modified_base (193)..(193): a, c, t, g, unknown or other
  misc_feature (193)..(193): n is a, c, g, or t
tcagtgtactactccacgaccggtgctcgatttagctgtgcgtcgaagggaaagggggcgtgtgggagaggagccccaggcccgggattcccaggtgtttccattcagtgatcagcactgaagacaggagactcatcatggagttctggctgagcgttgggttcctccgttggttcnccgtaatttaaagatntcctagtgtgaggtgcagcgtggtggagtcggtgggggagtcgttgggtcccgagggtcccggggggtccctggacgtccgtcttccgtgttcgacgtccttcgtggtacgttcagttcgttacgacggttccggttcgtactagtccgtccgtacggttccgggtacccgtccggacggtaccgtaccggaacggggtaaaaccggggtactaagggtaactttattacgggttacgaacggttcttttaaggtaatttaaagtaacggggtacgggtaacctaactacgtacgttacgacgtaagacccgtgtaaggacggtaacggagtagtacgtaccaacgtactaccgtacgtacgtaagaactaaccgtaccgtaacgaccgtacgtacgtacggtacgttactaaccgtaagtaccgagtacgtacgttaccgacggttaacacggtacgtaggaacggtacccggtacgttcggtaggtttaaccgtttacgtaccgttaggtacggttaaaggtaacgttccggttaccgttaccggtaaccgttacggaaccctttaccgg

SEQ ID NO: 130738 - DNA, 765 bp, Homo sapiens
  misc_feature: GYAE6OF02FI754.16.80.H03.1.454.CMB.1.raw
  modified_base (186)..(186): a, c, t, g, unknown or other
  misc_feature (186)..(186): n is a, c, g, or t
tcagtgtactactccacgaccggtgctcgatttagctgtgcgtcgaagggaaagggggctgtgggagaggagccccaggcccgggattcccaggtgtttccattcagtgatcagcactgaagacaggagactcatcatggagttctggctgagcgtgggttctccttgttgacctaattttaaagntgtccagtgtgaggtgcagcgtgggtggaggttcggtgggggaggtcgttcgggcccgaggggcccgggggggtccctggacgtaccttcctccgtgtcgccgtacgcctcgtggtacttcctaccgttttagtcgtacccttatcggccctaagtcggacggtccggttcggggtccccgtaccgaagggtcccgtaccggtaacggggggaacggggtcgtaaaggaacggttcggggttacctaacgtaacggttaactaccgaaaccgaaggtacctaaaggttaacgtaacggttacccgagtaacgttacgggttaccgaccgtaacggtacccgttacgggtacgggtaaccggggttcccgtttacaacccttgttacccgtacccgaagacgtaacctaacgttaccgaaagtaacctacggtcttaacgttatttacggaactaaacggtacaacgttagtcgtaaggacgttaacggtccgaaagggaaccaccggacttagtacttaacgttctagggtagaccggtaaggtacgttagggtcgtcgggacggtgtactggttaacg

SEQ ID NO: 130739 - DNA, 472 bp, Homo sapiens
  misc_feature: GYAE6OF01AV07Y.35.20.B09.1.454.CMB.1.raw
  modified_base (216)..(216): a, c, t, g, unknown or other
  misc_feature (216)..(216): n is a, c, g, or t
  modified_base (437)..(472): a, c, t, g, unknown or other
  misc_feature (437)..(472): n is a, c, g, or t
tcagtacagatcgtcacgaccggtgctcgatttagtgtagtgtgaaggggtcgttgggagtggggtcctcaacgtattgatggtagtggctcataacacatggtacgcagactccgtcgaggggccggttcaccatctccagagacaattccaggaacacgctgtatctacaaatggacagtctgacgagccgaggacacgggcccttatattacngtcgcgaaagttcgaacagtggctggcacgaggtcgggataatgactactggggccagggaacctggtcaccggcctacctcaggcctccaccaaggggcccatcggtctccccctggcaccctcctccaagagcacctctggggcacagcggccctgggctgcctggtcaagggactacttccacgactctgtactgagcgggctggcaaggcgcatagnnnnnnnnnnnnnnnnnnnnnnnnnnnnnnnnnnnn

SEQ ID NO: 130740 - DNA, 425 bp, Homo sapiens
  misc_feature: GYAE6OF01BK8OO.35.20.B09.1.454.CMB.1.raw
  modified_base (419)..(425): a, c, t, g, unknown or other
  misc_feature (419)..(425): n is a, c, g, or t
tcagtacagatcgtcacgaccggtgctcgatttagtgtagtgtgaagggctggagtgggtctcaactattgatggtagtgctcataacacatggtacgcagactccgtgaggggccggttcaccatctccagagacaattccaggaacacgctgtatctacaaatggacagtctgagagccgaggacacggccttatattactgtgcgaaagttcgaacagtggctggcacgaggtcgggatatgactactggggccagggaaccctggtcaccgcctcctcagcctccaccaagggcccatcggtcttccccctggcaccctcctccaagagcacctctggggcacagcggccctgggctgcctggtcaaggactacttccacgatctgtactgagcgggctgggcaaggcgcatagnnnnnnn

SEQ ID NO: 130741 - DNA, 422 bp, Homo sapiens
  misc_feature: GYAE6OF01B8LS2.35.20.B09.1.454.CMB.1.raw
  modified_base (418)..(422): a, c, t, g, unknown or other
  misc_feature (418)..(422): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatctccagagacaattccaggaacacgctgtatctacaaatggacagtctgagagccgaggacacggccttatattactgtgcgaaagttcgaacagtggctggcacgaggtcgggatatgactactggggccagggaaccctggtcaccgcctcctcagcctccaccaagggcccatcggtcttccccctggcaccctcctccaagagcacctctggggcacagcggccctgggctgcctggtcaggactacttccacgatctgtactgagcgggctggcaaggcgcatagnnnnn

SEQ ID NO: 130742 - DNA, 424 bp, Homo sapiens
  misc_feature: GYAE6OF01C59YL.35.20.B09.1.454.CMB.1.raw
  modified_base (419)..(424): a, c, t, g, unknown or other
  misc_feature (419)..(424): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatctccagagacaattccaggaacacgctgtatctacaaatggacagtctgagagccgaggacacggccttatattactgtgcgaaagttcgaacagtggctggcacgaggtcgggatatgactactggggccagggaaccctggtcaccgcctcctcagcctccaccaagggccccatcggtcttccccctggcaccctcctccaagagcacctctggggcacagcggccctgggctgcctggtcaaggctacttccacgatctgtactgagcgggctggcaaggcgcatagnnnnnn

SEQ ID NO: 130743 - DNA, 357 bp, Homo sapiens
  misc_feature: GYAE6OF01DPELI.35.20.B09.1.454.CMB.1.raw
  modified_base (352)..(357): a, c, t, g, unknown or other
  misc_feature (352)..(357): n is a, c, g, or t
tcagtacagatcgtcacgaccggtgctcgatttagtgtagtgtgagggccggttcaccatctccagagacaattccaggaacacgctgtatctacaaatggacagtctgagagccgaggacacggccttatattactgtgcgaaagttcgaacagtggctggcacgaggtcgggatatgactactggggccagggaaccctggtcaccgcctcctcagcctccaccaagggcccatcggtcttccccctggcaccctcctccaagagcacctctgggggcacagcggcctgggctgcctggtcaaggactacttccacgatctgtactgagcgggctggcaaggcgcatagnnnnnn

SEQ ID NO: 130744 - DNA, 421 bp, Homo sapiens
  misc_feature: GYAE6OF01DI7BM.35.20.B09.1.454.CMB.1.raw
  modified_base (417)..(421): a, c, t, g, unknown or other
  misc_feature (417)..(421): n is a, c, g, or t
tcagtacagatcgtcacgaccggtgctcgatttagtgtagtgtgaagggctggagtgggtctcaactattgatggtagtgctcataacacatggtacgcagactccgtgaggggccggttcaccatctccagagacaattccaggaacacgctgtatctacaaatggacagtctgagagccgaggacacggccttatattactgtgcgaaaagttcgaacagtggctggcacgaggtcgggatatgactactggggccagggaaccctggtcaccgcctcctcagctccaccaagggcccatcggtcttccccctggcaccctcctccaagagcacctctggggcacagcggcctgggctgcctggtcaaggctacttccacgatctgtactgagcgggctgggcaaggcgcatagnnnnn

SEQ ID NO: 130745 - DNA, 417 bp, Homo sapiens
  misc_feature: GYAE6OF01CTGPV.35.20.B09.1.454.CMB.1.raw
  modified_base (413)..(417): a, c, t, g, unknown or other
  misc_feature (413)..(417): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatctccagagacaattccaagaacactttgttcctgcaaatgaacagcctgagagccgaggacacggcgatatattactgtgcgagaagcgatgggagcctaccccggatgagcactgggggccagggcaccctggtcgccgtctcttcagcctccaccaagggccccatcggtcttccccctggcacccctcctccaagagcacctctgggggcacagcggccctgggctgccctggtcaaggactacttcacgatctgtactgagcgggctggcaaggcgcatagnnnnn

SEQ ID NO: 130746 - DNA, 423 bp, Homo sapiens
  misc_feature: GYAE6OF01BGK93.35.20.B09.1.454.CMB.1.raw
  modified_base (418)..(423): a, c, t, g, unknown or other
  misc_feature (418)..(423): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatctccagagacaattccaggaacacgctgtatctacaaatggacagtctgagagccgaggacacggccttatattactgtgcgaaagttcgaacagtggctggcacgaggtcgggatatgactactggggccagggaaccctggtcaccgcctcctcagcctccaccaagggcccatcggtcttcccctggcaccctcctccaagagcacctctggggcacagcggccctgggctgcctggtcaaggactacttccacgatctgtactgagcgggctggcaaggcgcatagnnnnnn

SEQ ID NO: 130747 - DNA, 427 bp, Homo sapiens
  misc_feature: GYAE6OF01C9MIQ.35.20.B09.1.454.CMB.1.raw
  modified_base (420)..(427): a, c, t, g, unknown or other
  misc_feature (420)..(427): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatctccagagacaattccaggaacacgctgtatctacaaatggacagtctgagagccgaggacacggccttatattactgtgcgaaagttcgaacagtggctggcacgaggtcgggatatgactactggggccagggaaccctggtcaccgcctcctcagcctccaccaagggcccatcggtcttccccctggccaccctcctccaagagcacctctgggggcacagcggccctgggctgcctggtcaaggctacttccacgatctgtactgagcgggctggcaaggcgcatagnnnnnnnn

SEQ ID NO: 130748 - DNA, 421 bp, Homo sapiens
  misc_feature: GYAE6OF01DE26J.35.20.B09.1.454.CMB.1.raw
  modified_base (417)..(421): a, c, t, g, unknown or other
  misc_feature (417)..(421): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatctccagagacaattccaggaacacgctgtatctacaaatggacagtctgagagccgaggacacggccttatattactgtgcgaaagttcgaacagtggctggcacgaggtcgggatatgactactggggccagggaaccctggtcaccgcctcctcagcctccaccaagggcccatcggtcttccccctggcaccctcctccaagagcacctctggggcacagcggccctgggctgcctggtcaaggctacttccacgatctgtactgagcgggctggcaggcgcatagnnnnn

SEQ ID NO: 130749 - DNA, 421 bp, Homo sapiens
  misc_feature: GYAE6OF01A5H52.35.20.B09.1.454.CMB.1.raw
  modified_base (417)..(421): a, c, t, g, unknown or other
  misc_feature (417)..(421): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatctccagagacaattccaggaacacgctgtatctacaaatggacagtctgagagccgaggacacggccttatattactgtgcgaaagttcgaacagtggctggcacgaggtcgggatatgactactggggccagggaaccctggtcaccgcctcctcagcctccaccaagggcccatcggtcttccccctggcaccctcctccaagagcacctctggggcacagcggccctgggctgcctggtcaaggctacttcacgatctgtactgagcgggctggcaaggcgcatagnnnnn

SEQ ID NO: 130750 - DNA, 424 bp, Homo sapiens
  misc_feature: GYAE6OF01DEIGA.35.20.B09.1.454.CMB.1.raw
  modified_base (419)..(424): a, c, t, g, unknown or other
  misc_feature (419)..(424): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatctccagagacaattccaggaacacgctgtatctacaaatggacagtctgagagccgaggacacggccttatattactgtgcgaaagttcgaacagtggctggcacgaggtcggatatgactactggggccagggaaccctggtcaccgcctcctcagcctccaccaagggcccatcggtcttccccctggcaccctcctccaagagcacctctgggggcacagcggccctgggctgcctggtcaaggactacttccacgatctgtactgagcgggctggcaaggcgcatagnnnnnn

SEQ ID NO: 130751 - DNA, 423 bp, Homo sapiens
  misc_feature: GYAE6OF01AKJVV.35.20.B09.1.454.CMB.1.raw
  modified_base (419)..(423): a, c, t, g, unknown or other
  misc_feature (419)..(423): n is a, c, g, or t
tcagtacagatcgtcacgaccggtgctcgatttagtgtagtgtgaagggctggagtgggtctcaactattgatggtagtgctcataacacatggtacgcagactccgtgaggggccggttcaccatctccagagacaattccaggaacacgctgtatctacaaatggacagtctgagagccgaggacacggccttatattactgtgcgaaagttcgaacagtggctggcacgaggtcgggatatgactactggggccagggaaccctggtcaccgcctcctcagcctccaccaagggcccatcgtcttccccctggccaccctcctccaagagcacctctggggcacagcggccctgggctgcctggtcaaggactacttccacgatctgtactgagcgggctgggcaaggcgcatagnnnnn

SEQ ID NO: 130752 - DNA, 425 bp, Homo sapiens
  misc_feature: GYAE6OF01EVWJE.35.20.B09.1.454.CMB.1.raw
  modified_base (421)..(425): a, c, t, g, unknown or other
  misc_feature (421)..(425): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatctccagagacaattccaggaacacgctgtatctacaaatggacagtctgagagccgaggacacggccttatattactgtgcgaaagttcgaacagtggctggcacgaggtcgggatatgactactggggccagggaaccctggtcaccgcctcctcagcctccaccaagggcccatcggtcttccccctggccaccctcctccaagagcacctctgggggcacagcggccctgggctgcctggtcaaggactacttccacgatctgtactgagcgggctggcaaggcgcatagnnnnn

SEQ ID NO: 130753 - DNA, 427 bp, Homo sapiens
  misc_feature: GYAE6OF01EZFDU.35.20.B09.1.454.CMB.1.raw
  modified_base (419)..(427): a, c, t, g, unknown or other
  misc_feature (419)..(427): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatctccagagacaattccaggaacacgctgtatctacaaatggacagtctgagagccgaggacacggccttatattactgtgcgaaagttcgaacagtggctggcacgaggtcgggatatgactactggggccagggaaccctggtcaccgcctcctcagcctccaccaagggcccatcggtcttccccctggcaccctcctccaagagcacctctgggggcacagcgccctgggctgcctggtcaaggactacttccacgatctgtactgagcgggctggcaaggcgcatagnnnnnnnnn

SEQ ID NO: 130754 - DNA, 433 bp, Homo sapiens
  misc_feature: GYAE6OF01CXX94.35.20.B09.1.454.CMB.1.raw
  modified_base (428)..(433): a, c, t, g, unknown or other
  misc_feature (428)..(433): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatctccagagacaattccaggaacacgctgtatctacaaaatggacagtctgagagccgaggacacggccttatattactgtgcgaaaagttcgaacagtggctggcacgaggtcgggatatgactactggggccagggaaccctggtcaccgcctcctcagcctccaccaagggccccatcggtcttccccctggccacccctcctcccaaagacgcacctcgtgggggcacagcggccctgggctgcctggtcaaggctacttccacgatctgtactgagcgggctggcaaggcgcatagnnnnnn

SEQ ID NO: 130755 - DNA, 586 bp, Homo sapiens
  misc_feature: GYAE6OF01CYVAS.35.20.B09.1.454.CMB.1.raw
  modified_base (549)..(549): a, c, t, g, unknown or other
  misc_feature (549)..(549): n is a, c, g, or t
  modified_base (552)..(552): a, c, t, g, unknown or other
  misc_feature (552)..(552): n is a, c, g, or t
  modified_base (561)..(564): a, c, t, g, unknown or other
  misc_feature (561)..(564): n is a, c, g, or t
  modified_base (566)..(572): a, c, t, g, unknown or other
  misc_feature (566)..(572): n is a, c, g, or t
  modified_base (574)..(581): a, c, t, g, unknown or other
  misc_feature (574)..(581): n is a, c, g, or t
  modified_base (583)..(586): a, c, t, g, unknown or other
  misc_feature (583)..(586): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatctccagagacaattccaggaacacgctgtatctacaaatggacagtctgagagccgaggacacggccttatattactgtgcgaaagttcgaacagtggctggcacgaggtcgggatatgactactggggccagggaaccctggtcaccgcctcctcacgcctccaccgaacgggcccatccggtccttcccccgtggccaccctcctccaagacgcacctcgtcggggcacgacgccggcccgtggggctcggcccgtggtaccgaaacgggtaccttacccgtttacccgaaccgggtactttaccgtacgggtttaaccgttacgggaacgggtacccggggggtccgtttacgggggaccccgaaaacgggggtcccggaacccggtaacgttaacggggtcgcgacgacgcgacgacncgngcgcgcatnnnncnnnnnnncnnnnnnnnannnn

SEQ ID NO: 130756 - DNA, 429 bp, Homo sapiens
  misc_feature: GYAE6OF01A4CRZ.35.20.B09.1.454.CMB.1.raw
  modified_base (415)..(415): a, c, t, g, unknown or other
  misc_feature (415)..(415): n is a, c, g, or t
  modified_base (421)..(429): a, c, t, g, unknown or other
  misc_feature (421)..(429): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatctccagagacaattccaggaacacgctgtatctacaaatggacagtctgagagccgaggacacggccttatattactgtgcgaaagttcgaacagtggctggcacgaggtcgggatatgactactggggccagggaaccctggtcaccgcctcctcagcctccaccaagggcccatcggtctccccctggcaccctcctccaagacgcacctctggggcacagcggccctgggctgcctggtcaaggactacttccacgatctgtactgagcgggctgggcaagggcncatagnnnnnnnnn

SEQ ID NO: 130757 - DNA, 584 bp, Homo sapiens
  misc_feature: GYAE6OF01AGUDI.35.20.B09.1.454.CMB.1.raw
  modified_base (259)..(259): a, c, t, g, unknown or other
  misc_feature (259)..(259): n is a, c, g, or t
  modified_base (296)..(296): a, c, t, g, unknown or other
  misc_feature (296)..(296): n is a, c, g, or t
  modified_base (404)..(404): a, c, t, g, unknown or other
  misc_feature (404)..(404): n is a, c, g, or t
  modified_base (457)..(457): a, c, t, g, unknown or other
  misc_feature (457)..(457): n is a, c, g, or t
tcagtacagatcgtcacgaccggtgctcgatttagtgtagtgtgaaggggagctctgagagaggagcccagccctgggattttcaggtgttttcatttggtgatcaggactgaacagagagaactcaccatggagtttgggctgagcggtgtgtttctaggtcggctaatttaaaaggtgtccagtgtgaggtgcagctgttggagtcgtgggggaggcttggcacagccgtggggggtccctggagctctcctgtgcngcctctggtattcacctttagctacctagtggcatgngcgtgggtccgcgggctccgaggggagggctgggagtgggtctactaactagtgatggtagtgctcgataacacagttggacgcagctcgtggacgggtccgtcaccntcctacgagacactaacgttaccgaaggacctacggcttagtaatcccgtaanaagtcggaataggtacgtaggacggacggaccgacggtaccgacggttaccttattacttacgtaggtagtaacggttaaggttccgaagtggtcggacggtacggaccggtacggtgggtcggtaa

SEQ ID NO: 130758 - DNA, 429 bp, Homo sapiens
  misc_feature: GYAE6OF01CNLWI.35.20.B09.1.454.CMB.1.raw
  modified_base (418)..(429): a, c, t, g, unknown or other
  misc_feature (418)..(429): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatctccagagacaattccaggaacacgctgtatctacaaatggacagtctgagagccgaggacacggccttatattactgtgcgaaaaattggcgaaactgggggaagtggtacttcgatctctggggcctggcaccctggtcactgtctcctcagcctccaccaagggccccatcggtcttccccctggccgccctgctccaggagcacctccgagagcacagcggccctgggctgcctggtcaaggctacttccacgatctgtactgagcgggctgggcaaggcgcatagnnnnnnnnnnnn

SEQ ID NO: 130759 - DNA, 430 bp, Homo sapiens
  misc_feature: GYAE6OF01CBNDZ.35.20.B09.1.454.CMB.1.raw
  modified_base (415)..(430): a, c, t, g, unknown or other
  misc_feature (415)..(430): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatctccagagacaattccaggaacacgctgtatctacaaatggacagtctgagagccgaggacacggccttatattactgtgcgaaagttcgaacagtggctggcacgagtcgggatatgactactggggccagggaaccctggtcaccgcctcctcagcctccaccaagggcccatcggtctcccctggcaccctctccagagcacctctggggcacagcggccctgggctgcctggtcaaggactacttccacgatctgtactgagcgggctggcaaggcgcatacgnnnnnnnnnnnnnnnn

SEQ ID NO: 130760 - DNA, 427 bp, Homo sapiens
  misc_feature: GYAE6OF01AFU2Z.35.20.B09.1.454.CMB.1.raw
  modified_base (420)..(427): a, c, t, g, unknown or other
  misc_feature (420)..(427): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatctccagagacaattccaggaacacgctgtatctacaaatggacagtctgagagccgaggacacggccttatattactgtgcgaaagttcgaacagtggctggcacgaggtcgggatatgactactggggccagggaaccctggtcaccgcctcctcagcctccaccaagggcccatcggtcttccccctggccaccctcctccaagagcacctctggggcacagcggccctgggctgcctggtcaaggactacttccacgatctgtactgagcgggctggcaaggcgcatagnnnnnnnn

SEQ ID NO: 130761 - DNA, 357 bp, Homo sapiens
  misc_feature: GYAE6OF01BK2AF.35.20.B09.1.454.CMB.1.raw
  modified_base (352)..(357): a, c, t, g, unknown or other
  misc_feature (352)..(357): n is a, c, g, or t
tcagtacagatcgtcacgaccggtgctcgatttagtgtagtgtgaggggccggttcaccatctccagagacaattccaggaacacgctgtatctacaaatggacagtctgagagccgaggacacggccttatattactgtgcgaaagttcgaacagtggctggcacgaggtcgggatatgactactggggccagggaaccctggtcaccgcctcctcggcctccaccaagggcccatcggtcttccccctggcaccctcctccaagagcacctctgggggcacagcggccctgggctgcctggtcaaggctacttccacgatctgtactgagcggctggcaaggcgcatagnnnnnn

SEQ ID NO: 130762 - DNA, 489 bp, Homo sapiens
  misc_feature: GYAE6OF01E2HAT.35.20.B09.1.454.CMB.1.raw
  modified_base (475)..(477): a, c, t, g, unknown or other
  misc_feature (475)..(477): n is a, c, g, or t
  modified_base (479)..(489): a, c, t, g, unknown or other
  misc_feature (479)..(489): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatctccagagacaattccaggaacacgctgtatctacaaatggacagtctgagagccgaggacacggccttatattactgtgcgaaagttcgaacagtggctggcacgaggtcgggatatgactacgtggggccagggaaccctggtcaccgcctcctcacgcctccaccaacgggccccagtccggtccttccccccgtggcccaccctccctccaagacgccacctcgtcgggggccacgacggccggcccgtgggcctcgcccgtgggtcaacgggaccttaccttcccgacgtactcgttcgtacgtggacggccggggcgtgggaccgaacgggccgcaagtagnnngnnnnnnnnnnn

SEQ ID NO: 130763 - DNA, 479 bp, Homo sapiens
  misc_feature: GYAE6OF01BWKVR.35.20.B09.1.454.CMB.1.raw
  modified_base (466)..(479): a, c, t, g, unknown or other
  misc_feature (466)..(479): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatctccagagacaattccaggaacacgctgtatctaacaaatggacagtctgagagccgaggacacggccttatattactgtgacgaaagttcgaacagtggctggcacgaggtcgggatatgactagtggggccaagggaaccctggtcaccgcctcctcacgcctccaccgaacgggcccatccggtccttccccctcggccaccctccctaccaagacgcaccgtcgtgggggccacgaggccggccctgggcctcgcctggtacaacgggactaccttccacgtactctacgtacgtcggaggcgggcgtcgggacgaagggccgacctagtaggcnnnnnnnnnnnnnn

SEQ ID NO: 130764 - DNA, 432 bp, Homo sapiens
  misc_feature: GYAE6OF01DYZ80.35.20.B09.1.454.CMB.1.raw
  modified_base (410)..(410): a, c, t, g, unknown or other
  misc_feature (410)..(410): n is a, c, g, or t
  modified_base (426)..(432): a, c, t, g, unknown or other
  misc_feature (426)..(432): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatctccagagacaattccaggaacacgctgtatctacaaatggacagtctgagagccgaggacacggccttatattactgtgcgaaagttcgaacagtggctggcacggaggtcgggatatgactactggggccagggaaccctggtcaccgcctcctcagcctccaccaacgggcccatcggtcttcccctggccgccctgctccaggagccacctccgagagcacagcggcccgtgggctgcctggtcaacggactaccttccacgatctgtactgagcgggntggcaaggcgcatagnnnnnnn

SEQ ID NO: 130765 - DNA, 361 bp, Homo sapiens
  misc_feature: GYAE6OF01A890X.35.20.B09.1.454.CMB.1.raw
  modified_base (353)..(361): a, c, t, g, unknown or other
  misc_feature (353)..(361): n is a, c, g, or t
tcagtacagatcgtcacgaccggtgctcgatttagtgtagtgtgaggggccggttcaccatctccagagacaattccaggaacacgctgtatctacaaatggacagtctgagagccgaggacacggccttatattactgtgcgaaagttcgaacagtggctggcacgaggtcgggatatgactactggggccagggaaccctggtcaccgcctcctcggcctccaccaagggcccatcggtctccccctggccaccctcctccaagagcacctctgggggcacagcggccctgggctgcctggtcaaggctacttccacgatctgtactgagcgggctggcaaggcgcatagnnnnnnnnn

SEQ ID NO: 130766 - DNA, 444 bp, Homo sapiens
  misc_feature: GYAE6OF01A9CR4.35.20.B09.1.454.CMB.1.raw
  modified_base (409)..(409): a, c, t, g, unknown or other
  misc_feature (409)..(409): n is a, c, g, or t
  modified_base (434)..(444): a, c, t, g, unknown or other
  misc_feature (434)..(444): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatctccagagacaattccaggaacacgctgtatctacaaatggacagtctgagagccgaggacacggccttatattactgtgcgaaagttcgaacagtggctggcacgaggtcgggatatgactacgtggggccagggaaccctggtcaccgcctcctcagcctccaccaacgggccccagtccggtccttcccccctggccacccctcctccaagacgcacctcgtggggcaccacgcggccctgggcctgcctggtcaaggacctactccacgatctgtacngaggcgggctggcaaggcgcatagnnnnnnnnnnn

SEQ ID NO: 130767 - DNA, 691 bp, Homo sapiens
  misc_feature: GYAE6OF01DB7C4.35.20.B09.1.454.CMB.1.raw
  modified_base (233)..(233): a, c, t, g, unknown or other
  misc_feature (233)..(233): n is a, c, g, or t
  modified_base (270)..(270): a, c, t, g, unknown or other
  misc_feature (270)..(270): n is a, c, g, or t
  modified_base (662)..(662): a, c, t, g, unknown or other
  misc_feature (662)..(662): n is a, c, g, or t
  modified_base (682)..(682): a, c, t, g, unknown or other
  misc_feature (682)..(682): n is a, c, g, or t
tcagtacagatcgtcacgaccggtgctcgatttagtgtagtgtgaaggggagctctgagagaggagcccagccctgggattttcaggttgttttcatttggtgatcaggactgaacagagagaactcacatggagtttgggctggagcgtggtcttttctggtggtacttaagttttaaaaggtgtccagtgtgaggtgcagctgttggagtcggtggggagcgttggcacgngccgtgggggtccctgagctctcctgtcgcagcctgnggtacttctacctttagcctacctagtggcagtgacgtcgtcgggtccgccggctccggaggggaacgggtcgtggaggtcgggtccctacgtaaacgttagttggtaagtgggttaacgtcgtcctacgtaaaacttaaaccacgttaacgtacggggttaaaccaccgtaaacggtaccccgtaccggggttacggggtaacccgggggtccccggtttaaccaaccgttaacgtacccgttaacccgaaaggtaaaccggtaaccttaaaccgttacccggaaacgggaacctacggtaccttagtaacctaactaacgtaaagtacggactacgtcgagacgacgcgaacgacacgtctaatactacgtgacgactaaggtcaaacgngtacggctaggacgtacggnggtcgtaag

SEQ ID NO: 130768 - DNA, 751 bp, Homo sapiens
  misc_feature: GYAE6OF01EPDZ9.35.20.B09.1.454.CMB.1.raw
tcagtacagatcgtcacgaccggtgctcgatttagtgtagtgtgaaggggagctctgagagaggagcccagccctgggattttcaggtgttttcatttggtgatcaggactgaacagagagaactcaccatggagtttgggctgagctggtctttttcttgtggcttattttaaaaggtgtccagtgtgaggtgcagctgttggagtcgtgggggagcttggcacgagccgtgggggtccctgagactctcctgtgcagcctcgtggtacttccacctttagcctacctatggcatggagcgtcgggtccgccgggcctccggaggggaagggcgtgggtaggtcgggtctacgaacttagttgagttggtagtcgcttacaactaaaccacgtagtacgggtaaccgacgtaacggtacccgttccgggttaggggaaccggggggttcccggttacccaacccgtacgttcccgtaccgaaaggtaacgaacctaaacgttcccggaaagggtaacccacggtacttagttaacctaccgtaaacgtaacgtacggaacctaggtaccgtagggaacggaccggtaccggaacggtaccgtaccggttaccctttaagttaacgttaccggttgggtaaccggtaaccgggttaaaaggtttacccggaaaacggttacgggttaccggggtaccgttaccgggggaaacccgtaaccgggggttaacgggggtaccgggggttaaaac

SEQ ID NO: 130769 - DNA, 655 bp, Homo sapiens
  misc_feature: GYAE6OF01CFPHC.35.20.B09.1.454.CMB.1.raw
tcagtacagatcgtcacgaccggtgctcgatttagtgtagtgtgaaggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgttggagtcgtgggggaggcttggcacagccgtggggggtccctgagactctcctgtgcagcctctggattcacctttagccacctatggcatgagcgtcgggtccgccgggctccgaggggaggggctggagtgggtctacaactattgatggtagtgctcaataacactattgttacgcagacctccggtggacgggggtcccgttcaaccctatcctaccaaggaacgacctaaacttcccgaagggaaaccaccggtcttaggttaactacctaacaaaagtcgggaacctaggttcctaggaacggacggcccggaagggacctaaccgggtcctttaagtacgtttaaccgtgggttacggaaccggttaaaaggtttcccggaaaacgtagggttacggggtaccgttacgggggaaccctaaccgggggtaaggggttcccggggtaaag

SEQ ID NO: 130770 - DNA, 422 bp, Homo sapiens
  misc_feature: GYAE6OF01BP462.35.20.B09.1.454.CMB.1.raw
  modified_base (419)..(422): a, c, t, g, unknown or other
  misc_feature (419)..(422): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatctccagagacaattccaggaacacgctgtatctacaaatggacagtctgagagccgaggacacggccttatattactgtgcgaaagttcgaacagtggctggcacgaggtcgggatatgactactggggccagggaaccctggtcaccgcctcctcagcctccaccaagggcccatcggtcttccccctggcaccctcctccaagagcacctctggggcacagcggccctgggctgcctggtcaaggactacttccacgatctgtactgagcgggctggcaaggcgcatagnnnn

SEQ ID NO: 130771 - DNA, 522 bp, Homo sapiens
  misc_feature: GYAE6OF01A846L.35.20.B09.1.454.CMB.1.raw
  modified_base (193)..(193): a, c, t, g, unknown or other
  misc_feature (193)..(193): n is a, c, g, or t
  modified_base (272)..(272): a, c, t, g, unknown or other
  misc_feature (272)..(272): n is a, c, g, or t
  modified_base (349)..(349): a, c, t, g, unknown or other
  misc_feature (349)..(349): n is a, c, g, or t
  modified_base (365)..(365): a, c, t, g, unknown or other
  misc_feature (365)..(365): n is a, c, g, or t
  modified_base (385)..(385): a, c, t, g, unknown or other
  misc_feature (385)..(385): n is a, c, g, or t
  modified_base (389)..(389): a, c, t, g, unknown or other
  misc_feature (389)..(389): n is a, c, g, or t
  modified_base (418)..(418): a, c, t, g, unknown or other
  misc_feature (418)..(418): n is a, c, g, or t
tcagtacagatcgtcacgaccggtgctcgatttagtgtagtgtgaagggagctctgagagaggagcccagccctgggattttcaggtgttttcatttggtgatcaggactgaacagagagaactcaccatggagtttgggctgagcgtgtcgttttctagtggctatttaaaggtgtcagtgtgaggtgcagntgttggagtcgtgggggaggtcttggcacgagccgtgggggtccctgagactctcctgtgcagcctgtggattcacttnagtgcatggatgcactgggtcctcaagttccgagggagggctggtgtgggttcacgtatagagtgatgggatgacanaatcaacgcgactcgnaacgggctattccacccctnaagngacaacgtccaaagaactacatacatganacaaatagaacatactagagagacgacgacgaacgacgtcggtactagttaacgtcgtagacgaacgagtggcaccatactatacgttagtactgtcgtacggg

SEQ ID NO: 130772 - DNA, 431 bp, Homo sapiens
  misc_feature: GYAE6OF01DMJMP.35.20.B09.1.454.CMB.1.raw
  modified_base (332)..(332): a, c, t, g, unknown or other
  misc_feature (332)..(332): n is a, c, g, or t
  modified_base (422)..(431): a, c, t, g, unknown or other
  misc_feature (422)..(431): n is a, c, g, or t
tcagtacagatcgtcacgaccggtgctcgatttagtgtagtgtgaaggggctggagtgggtctcaactattgatggtagtgctcataacacatggtacgcagactccgtgagggggccggttcaccatctccagagacaattccaggaacacgctgtatctacaaaatggacagtctgagagccgaggacacggccttatattactgtgcgaaaagttcgaacagtggctggcacgaggtcgggatatgactactggggccagggaaccctggtcaccgcctcctcagctccaccaagggccatcggtcttcccctggcaccctctccaagngcacctctggggcacacgcggccctgggctgcctggtcaaggctacttccacgatctgtactgacgcggggctgggcaaggcgccatagnnnnnnnnnn

SEQ ID NO: 130773 - DNA, 549 bp, Homo sapiens
  misc_feature: GYAE6OF01ADU5Y.35.20.B09.1.454.CMB.1.raw
  modified_base (244)..(244): a, c, t, g, unknown or other
  misc_feature (244)..(244): n is a, c, g, or t
  modified_base (379)..(379): a, c, t, g, unknown or other
  misc_feature (379)..(379): n is a, c, g, or t
  modified_base (527)..(549): a, c, t, g, unknown or other
  misc_feature (527)..(549): n is a, c, g, or t
tcagtacagatcgtcacgaccggtgctcgatttagtgtagtgtgaagggctggagtgggtctcaactattgatggtagtgctcataacacatggtacgcagactccgtgagggccggttcaccatctccagagacaattccaggaacacgctgtatctacaaatggacagtctgagagccgaggacacggcctttatattactgtgacgaaagttcgaacagtggctggcacggaggtcggatntgactcgtgggccgaggaaccctggccaccgcctccgtcacgccctcacccgaacgggccgtcgtaccgtcccgttccccgtcggtaccaccccgtccctaccaacgacgtcccaccgttccggcgggggtaccnccggaacggcccgggtcccgtcggggtaccgtcggtaacccgttcgggtacaaacgggtacctttacccgttaccaccggtatcgttaaccgtcgttacgggaggggcccgtcgggtcggaacggaacggtccgggactaagtgagcnnnnnnnnnnnnnnnnnnnnnnn

SEQ ID NO: 130774 - DNA, 438 bp, Homo sapiens
  misc_feature: GYAE6OF01BSBFJ.35.20.B09.1.454.CMB.1.raw
  modified_base (424)..(438): a, c, t, g, unknown or other
  misc_feature (424)..(438): n is a, c, g, or t
tcagtacagatcgtcacgaccggtgctcgatttagtgtagtgtgaaggggctgggagtgggtctcaactattgatggtagtgctcataacacatggtacgcagactccgtgaggggccggttcaccatctccagagacaattccaggaacacgctgtatctacaaatggacagtctgagagcccgaggacacggccttatattactgtgcgaaaagttcgaacagtggctggcacgaggtcgggatatgactactggggccagggaaccctggtcaccgcctcctcagcctccaccaagggcccatcggtccttccccctggcaccctcctccaagagcaccgtctggggcacagcggccctgggctgcctggcaaggactacttccacgatctgtactgagcgggctgggcaaggcgcatagnnnnnnnnnnnnnnn

SEQ ID NO: 130775 - DNA, 561 bp, Homo sapiens
  misc_feature: GYAE6OF01AC3O1.35.20.B09.1.454.CMB.1.raw
  modified_base (198)..(198): a, c, t, g, unknown or other
  misc_feature (198)..(198): n is a, c, g, or t
  modified_base (204)..(204): a, c, t, g, unknown or other
  misc_feature (204)..(204): n is a, c, g, or t
  modified_base (222)..(222): a, c, t, g, unknown or other
  misc_feature (222)..(222): n is a, c, g, or t
  modified_base (412)..(412): a, c, t, g, unknown or other
  misc_feature (412)..(412): n is a, c, g, or t
  modified_base (523)..(523): a, c, t, g, unknown or other
  misc_feature (523)..(523): n is a, c, g, or t
  modified_base (525)..(525): a, c, t, g, unknown or other
  misc_feature (525)..(525): n is a, c, g, or t
  modified_base (530)..(530): a, c, t, g, unknown or other
  misc_feature (530)..(530): n is a, c, g, or t
  modified_base (532)..(561): a, c, t, g, unknown or other
  misc_feature (532)..(561): n is a, c, g, or t
tcagtacagatcgtcacgaccggtgctcgatttagtgtagtgtgagggcgtggagtgggtctcaactattgatggtagtgctcataacacatggtacgcagactccgtgaggggcccggttcaccatctccagagacaattccaggaacacgctgtatctacaaatggacagtctgagagccgaggacacggccttanattacngtgcgaaagttcgaaacngtggctggcacggaggtcgggatagtgaactacgtggggccgacgggtaaccccgtcgggttcgaacccggccctcccgttaccacggcccttcccacccgaacggggcccccacgtccgggtccttcccccccttcgggcctacccccgtccctccctaaccgaggccacccttacctcgggggggccncgaacgccgggccccttggggccgtcgcccttgggtccgaacggaccgtaccttcccacggactcgttcgtactcgagccgggctcggcgaaacggcggtaccagtaacgngnacgtnannnnnnnnnnnnnnnnnnnnnnnnnnnnnn

SEQ ID NO: 130776 - DNA, 637 bp, Homo sapiens
  misc_feature: GYAE6OF01BGBOM.35.20.B09.1.454.CMB.1.raw
  modified_base (560)..(560): a, c, t, g, unknown or other
  misc_feature (560)..(560): n is a, c, g, or t
  modified_base (564)..(564): a, c, t, g, unknown or other
  misc_feature (564)..(564): n is a, c, g, or t
tcagtacagatcgtcacgaccggtgctcgattttagtgtagtgtgaaggggcgtggagtgggtctccaactattagatggtagtgccttcataacacactggtacgcagaccttccgtgacgggccggttcaccatcctccgaggagacaatttccaggacacgctgtatcctaacaaagtggaccagtctgagagccgaggcacggccttatattactgtggcgaaagttcgaacaggtggctggcacgaggtcggatatgactacgtgggccacgggaacctggtcaccgccgtcctcacgtcctcctaccaacgggcccagtcggtccttacccccgtggcccacccgtcctccgaacgtacgccaccgtcgttgggggcacgacgccggacccgtagggcgtacggccgtaggtaccgaacgggtaccttaccgttaccaccgtacttaccggttacggttaaccgtgggacggtccgggggaccgttcggggaaccgtaaacggggtccggtacgtaacgtaacgcgacgacgcgacgcacgagtcgtaacgacncggntacgtagtagcgtcgacgtcgtacgtcgtcgtcgtcgcgcgcgcgtcggacggacggacgtagcgtgtcgtcg

SEQ ID NO: 130777 - DNA, 456 bp, Homo sapiens
  misc_feature: GYAE6OF01AX4M2.35.20.B09.1.454.CMB.1.raw
  modified_base (425)..(425): a, c, t, g, unknown or other
  misc_feature (425)..(425): n is a, c, g, or t
  modified_base (431)..(456): a, c, t, g, unknown or other
  misc_feature (431)..(456): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatctccagagacaattccaggaacacgctgtatctacaaatggacagtctgagagccgaggacacggccttatattactgtgcgaaaagttcgaacagtggctggcacgaggtcgggatatgactactggggccagggaaccctggtcaccgcctcctcagcctccaccaagggcccatcggtcttccccctggccaccctcctccaagagcacctcgtggggcacgagccggccctgggctcgccgtggtcaagggacctacgttccacgatctgtacgtgagcgggctgggcaaggcncatagnnnnnnnnnnnnnnnnnnnnnnnnnn

SEQ ID NO: 130778 - DNA, 484 bp, Homo sapiens
  misc_feature: GYAE6OF01D7BL0.35.20.B09.1.454.CMB.1.raw
  modified_base (461)..(484): a, c, t, g, unknown or other
  misc_feature (461)..(484): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatctccagagacaattccaggaacacgctgtatctacaaatggacagtctgagagccgaggacacggccttatattactgtgcgaaagttcgaacagtggctggcacgaggtcgggatatgactacgtggggccaggaaccctggtcaccgcctcctcacgcctccaccaacgggccccagtccggtccttcccccgtggccaccctcctccaagacgcaccgtcgtcggggcacgacgccggcctgggctgcctggtacaacggtcctaccgttccacgtacttcgtcgtacgtcggacggccgggtcgtcgggacgaacggcgacgataggggnnnnnnnnnnnnnnnnnnnnnnnn

SEQ ID NO: 130779 - DNA, 438 bp, Homo sapiens
  misc_feature: GYAE6OF01BD3AM.35.20.B09.1.454.CMB.1.raw
  modified_base (316)..(316): a, c, t, g, unknown or other
  misc_feature (316)..(316): n is a, c, g, or t
  modified_base (336)..(336): a, c, t, g, unknown or other
  misc_feature (336)..(336): n is a, c, g, or t
  modified_base (430)..(438): a, c, t, g, unknown or other
  misc_feature (430)..(438): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatctccagagacaattccaggaacacgctgtatctacaaatggacagtctgagagccgaggacacggccttatattactgtgcgaaagttcgaacagtggctggcacgaggtcgggatatgactacgtggggccagggaaccctggtcaccgcctcctcagcctccaccaagggcccatcggtcttccccnggccaccctcctccaagacncacctcgtggggccacgagccggccctgggctgccctggtcaaggacctacttccacgtatctgtactgagcggggctgggcaaggcgcatagnnnnnnnnn

SEQ ID NO: 130780 - DNA, 518 bp, Homo sapiens
  misc_feature: GYAE6OF01DISS4.35.20.B09.1.454.CMB.1.raw
  modified_base (482)..(518): a, c, t, g, unknown or other
  misc_feature (482)..(518): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatctccagagacaattccaggaacacgctgtatctaacaaatggacagtctgagagccgaggacacggccttatattactgtgacgaaagttcgaacaggtggctggcacgagggtcggatatgactacgtgggccagggaaccctggtcaccgcctcctcacgcctccaccaacgggcccatccggtccttccccctggccaccctcctccaagacgccacctcgtcggggcacgacgccggcccgtgggcctgccctgggtacaacgggtacctaccgttccacgtacttcgttacgtaacgtggacgggtccggggtacttcggggaccaaacggggccgaccgtaagtagcgnnnnnnnnnnnnnnnnnnnnnnnnnnnnnnnnnnnnn

SEQ ID NO: 130781 - DNA, 629 bp, Homo sapiens
  misc_feature: GYAE6OF01BTM6P.35.20.B09.1.454.CMB.1.raw
tcagtacagatcgtcacgaccggtgctcgatttagtgtagtgtgaaggggagctctgagagaggagcccagccctgggattttcaggtgttttcatttggtgatcaggactgaacagagagaactcaccatggagtttgggctgagcgtgtcttttcttggtggctaattttaaaaggtgtccagtgtgaggtgcagctgttggagtcgtgggggaggcttggcacgaggccggtggggggtcccctggacgctctcctgtcgcagcctctggtacttccacctttagcctacctatggcatgagtcgtcggggtccgccgggcctccggaggggaacggggctgggagtcgggtctacgtaacgttattgagtggtagtcgctacaataaacactagtggacgactagaccgtccggtggacggggtccgttccaccgatccgtaccgagaacgtaactaacttccgaacggaacctacgcttagtaactactaacgaagtacggacctagtccgtagacgacgaccgaacggaccgtaccggtacttattacgttaacgtcgtaacgtacggtaaagtccggaaagcggttacggtcggacggtaccgacggtacgggtaggtaacg

SEQ ID NO: 130782 - DNA, 640 bp, Homo sapiens
  misc_feature: GYAE6OF01CGTPV.35.20.B09.1.454.CMB.1.raw
  modified_base (487)..(487): a, c, t, g, unknown or other
  misc_feature (487)..(487): n is a, c, g, or t
tcagtacagatcgtcacgaccggtgctcgatttagtgtagtgtgaaggggagctctgagagaggagcccagccctgggattttcaggtgttttcatttggtgatcaggactgaacagagagaactcaccatggagtttgggctgagctggtctttttcttgtggctattttaaaaggtgtccagtgtgaggtgcagctgttggagtcgtgggggagcttggcacaggccgtgggggtccctgagctctcctgtgcagcctgtggtattcctacctttagcctacctatggcatggagcgtgggtcccggccggctccggaggggagggtcgtgggagtgggtctacaacgttagttcggagttggtagtgtcctacaaactaacactagttacgggtaccgcgaacgaccgttccggtagggacgggggtcccgttccaaccgtactccctaccgaaggacgaactaacgttccgaacgggaaaccncgtcttagtaactactaacgaaagtcggaactacgtacgaggtacggaacgaccggaacggaccgaccgtaccttaagtacttagtggtacggtaacgtaaacggttccgaacggtagtcggacgttgggaaccgtacggagggtcggtaacg

SEQ ID NO: 130783 - DNA, 468 bp, Homo sapiens
  misc_feature: GYAE6OF01BIINU.35.20.B09.1.454.CMB.1.raw
  modified_base (235)..(235): a, c, t, g, unknown or other
  misc_feature (235)..(235): n is a, c, g, or t
  modified_base (451)..(468): a, c, t, g, unknown or other
  misc_feature (451)..(468): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatctccagagacaattccaggaacacgctgtatctacaaatggacagtctgagagccgaggacacggccttatattactgtgcgaaagttcgaacagtggctggcacggnggtcgggatatgactacgtggggccgagggaaccctggtcaccgcctcctcagcctccaccaacgggccccatccggtccttcccccgtggccaccctcctccaagacgcacctcgtgggggcaccgagccggcccgtgggcctgcccgtggtacaacggtacctacttccacgtctcgtgtacgtggacggcgggctgggcgaaggcgacatagnnnnnnnnnnnnnnnnnn

SEQ ID NO: 130784 - DNA, 437 bp, Homo sapiens
  misc_feature: GYAE6OF01CFVAP.35.20.B09.1.454.CMB.1.raw
  modified_base (426)..(437): a, c, t, g, unknown or other
  misc_feature (426)..(437): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatctccagagacaattccaggaacacgctgtatctacaaatggacagtctgagagccgaggacacggccttatattactgtgcgaaagttcgaacagtggctggcacgaggtcgggatatgactactggggccagggaaccctggtcaccgcctcctcagcctccaccaagggcccatccggtcttccccctggccaccctcctccaagagcacctcgtggggcacagcggccctgggctgcctggtcaaggctacttccacgatctgtactgacgcgggactcgggacaaggcgcatagnnnnnnnnnnnn

SEQ ID NO: 130785 - DNA, 436 bp, Homo sapiens
  misc_feature: GYAE6OF01EQAAO.35.20.B09.1.454.CMB.1.raw
  modified_base (428)..(436): a, c, t, g, unknown or other
  misc_feature (428)..(436): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatctccagagacaattccaggaacacgctgtatctacaaatggacagtctgagagccgaggacacggccttatattactgtgcgaaagttcgaacagtggctggcacgaggtcgggatatgactactggggccagggaaccctggtcaccgcctcctcagcctccaccaagggcccatccggtccttccccctggccaccctcctccaagacgcacctcgtggggcacacgcggccctgggctgcctggtcaaggactacttccacgtactctgtactgacgcgggctggcaaggcgcatagnnnnnnnnn

SEQ ID NO: 130786 - DNA, 842 bp, Homo sapiens
  misc_feature: GYAE6OF01AOA9F.35.20.B09.1.454.CMB.1.raw
  modified_base (744)..(744): a, c, t, g, unknown or other
  misc_feature (744)..(744): n is a, c, g, or t
  modified_base (775)..(775): a, c, t, g, unknown or other
  misc_feature (775)..(775): n is a, c, g, or t
  modified_base (791)..(791): a, c, t, g, unknown or other
  misc_feature (791)..(791): n is a, c, g, or t
  modified_base (821)..(821): a, c, t, g, unknown or other
  misc_feature (821)..(821): n is a, c, g, or t
  modified_base (835)..(835): a, c, t, g, unknown or other
  misc_feature (835)..(835): n is a, c, g, or t
tcagtacagatcgtcacgaccggtgctcgatttagtgtagtgtgaaggggtcgttggggagtcgggtcggttcctaacctaatttgatgggtagtcgcttcgacttaacgactactggtacgtccagtaccttcccgtgacgggtccggttcaccgactcgtccagtagacaattccaggacacgctgtatctaccaaatggacagtctgacgaggccgagacacggtccttatattacctggtcgaccgtaaacgttacgaactaggtggcctgggaccaaccggtagggttccgggtaatttaacgttacgtaaacccttaaccggttcggggggtaccccgaacggggtaaaaccccgtacggggttaaccccgaaccccgggtaccccttaccccgtacccgaaaccggtcccccggttacccccgaaaccccgtaaaccgggggtacccccttaaacgttacccgggttaacccctttaacccccccgtaacggtaacccctaacccccgttccccgttaacccgaaaccgtaccggacccgtaacccgttccggtacgggggtaccacccggtaccggcccgggtaccccgggtacgggaccgttccggtcccgtcggttacgaaccggtaccttaccgtttacccgacggtacttcgtaacgttacgtacggacgggccgggtaccgagggtacccgaaggggtactaaccgtagtaccggctccgtactcgttcgngtcgtacgtgtctaacgcgttacggacgtanacgtctacgctacgtntacgtacgaccgtctacgcctccgtacgcnctactacctcctcncctcgtc

SEQ ID NO: 130787 - DNA, 522 bp, Homo sapiens
  misc_feature: GYAE6OF01DBOHR.35.20.B09.1.454.CMB.1.raw
  modified_base (500)..(522): a, c, t, g, unknown or other
  misc_feature (500)..(522): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatctcagagacaattccaggaacacgctgtatctaacaaaatggacagtctgagagccgaggacacggcctttaatattactggtgacgaaaagttcgaaacaggtggctggcacggaggtcgggatatgactacgtgggccgaagggaacccgtggtcaccgccctcctcacgccctccaaccgaaacgggccccagtccggttccttccccctggcccaccctccctaccaacgacgccacctcgtcgggggacacgacggccggcccgtcgggcgtcgcccgtggtaccgaaacgggaccttaaccgttaccaacgtacttctacgtacgtagacggccgggcgtacgggacgaaacgggccgacgaatagnnnnnnnnnnnnnnnnnnnnnnn

SEQ ID NO: 130788 - DNA, 476 bp, Homo sapiens
  misc_feature: GYAE6OF01AG651.35.20.B09.1.454.CMB.1.raw
  modified_base (443)..(447): a, c, t, g, unknown or other
  misc_feature (443)..(447): n is a, c, g, or t
  modified_base (450)..(453): a, c, t, g, unknown or other
  misc_feature (450)..(453): n is a, c, g, or t
  modified_base (455)..(476): a, c, t, g, unknown or other
  misc_feature (455)..(476): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatctccagagacaattccaggaacacgctgtatctacaaatggacagtctgagagccgaggacacggccttatattactgtgcgaaagttcgaacagtggctggcacgaggtcgggatatgactacgtggggccagggaaccctggtcaccgcctcctcagcctcaccagggccatcgtctccccctggcaccctcctccaagcgcaccctcgtgggggcacgacgccggcccgtgggctgccgtggtcaacggacctacgttccacgtatctagtactggacggcgggtcgtcgggaccgaacgggcgactagtagnnnnngcnnnnannnnnnnnnnnnnnnnnnnnnn

SEQ ID NO: 130789 - DNA, 492 bp, Homo sapiens
  misc_feature: GYAE6OF01CJ7EK.35.20.B09.1.454.CMB.1.raw
  modified_base (204)..(204): a, c, t, g, unknown or other
  misc_feature (204)..(204): n is a, c, g, or t
  modified_base (220)..(220): a, c, t, g, unknown or other
  misc_feature (220)..(220): n is a, c, g, or t
  modified_base (233)..(233): a, c, t, g, unknown or other
  misc_feature (233)..(233): n is a, c, g, or t
  modified_base (249)..(249): a, c, t, g, unknown or other
  misc_feature (249)..(249): n is a, c, g, or t
  modified_base (265)..(265): a, c, t, g, unknown or other
  misc_feature (265)..(265): n is a, c, g, or t
  modified_base (275)..(275): a, c, t, g, unknown or other
  misc_feature (275)..(275): n is a, c, g, or t
  modified_base (451)..(451): a, c, t, g, unknown or other
  misc_feature (451)..(451): n is a, c, g, or t
  modified_base (453)..(453): a, c, t, g, unknown or other
  misc_feature (453)..(453): n is a, c, g, or t
  modified_base (458)..(462): a, c, t, g, unknown or other
  misc_feature (458)..(462): n is a, c, g, or t
  modified_base (464)..(492): a, c, t, g, unknown or other
  misc_feature (464)..(492): n is a, c, g, or t
tcagtacagatcgtcacgaccggtgctcgatttagtgtagtgtgaaggggcgtggagtgggtctcaactattgatggtagtgctcataacacatggtacgcagactccgtgaggggccggttcaccatctcagagacaattccaggaacacgctgtatctacaaatggacagtctgagagccgaggacacggccttatattacngtgcgaagttcgaacngtgctggcacggnggtcggatatgactgngggccaggacctgtcncgctcctcancctcacagggccatcgtcctcccctgcctaccctccacagacgcctaccgtgcggggcacgacggtccggcccgtggggctcgaccgtcggtacgaacgggtacttaccgtttccgacgtattcgtagtccttagggacggccggtacgttcggacgaagggtcggacagttacgntncgtgnnnnngnnnnnnnnnnnnnnnnnnnnnnnnnnnnn

SEQ ID NO: 130790 - DNA, 764 bp, Homo sapiens
  misc_feature: GYAE6OF01ELNWF.35.20.B09.1.454.CMB.1.raw
  modified_base (272)..(272): a, c, t, g, unknown or other
  misc_feature (272)..(272): n is a, c, g, or t
tcagtacagatcgtcacgaccggtgctcgatttagtgtagtgtgaaggggagctctgagagaggagcccagccctgggattttcaggtgttttcatttggtgatcaggactgaacagagagaactcaccatggagtttgggctgagcgtggtcgttttctaggtggctaattttaaaaggtgtcagtgtgaggtgcagctgttggagtcgtgggggagcttggcacacgccgtcggggggtccctggacgactcgtcctgtcgcacgccctntggtacttccacctttagcctacctatcggcagtgagcgtcgggtcccgaccggggctccggaggggacgggctgggagtgggtcctacaacgtagttgagttggtagtcgctacaataaaccacgtagtacgggtaccgacgaacggtaacccgttccgggttacgggaacgggggttccccggtttaccaaaccccgttaagttccccgttaacccggaaaggtaacggaaaccttaaacgtttacccccggaaaggggaaaccctaccgggtccgttaaggttaaccttaccgtaaaacgaaacgttcgggaacttaacggttacgtacgggaacggtaccgacccgggtaaggaacccgtaccgggttacctttaaagttacgtttaaccgtagggttaccggtaaaccggttaaaacggttcccggaaaacgttacgggtacgggtaccgtacgggaccgtaacggggtacggggttcgggtaaacg

SEQ ID NO: 130791 - DNA, 730 bp, Homo sapiens
  misc_feature: GYAE6OF01CY71S.35.20.B09.1.454.CMB.1.raw
tcagtacagatcgtcacgaccggtgctcgatttagtgtagtgtgaaggggagctctgagagaggagcccagccctgggattttcaggttgttttcatttggtgatcaggactgaacagagagaactcaccagtggtagtttgggctgagctggttctttttcttgtggtacttaagttttaaaaggtgtaccagtgtgaggtgcagctgttggagtcggtgggggaggtcgttggcacgacgccggttcggggggtccctaggacgtaccttccgtccgtgtgccgacgtcctcgtggtactttacctaccttagacctacctagtcgctagtggacggtccgtcgggtcccgcccgggcgtacccggaagggggacgggtcgtgggtaggttcgggtacctacgtaacgttagttagacgttaggttacggtgtacctacaacgtaaacacgtagtacggtacacgtacgtccgttaccggtagggaccggggtcccgttaccaccgtaccgtacgtaccgaagtaaccgaactaaccgttaccggaacgggtaaacctaccggtacgttaacgtacttaaccgtaaacgaacgttacggaacctacggtactagggacggaacggaccgaacggaccgttacgtacctttaagtacgttaccaggtacccgtaaggtaacttacggacgtaggtacggtcgtaacgagacgggtacgggacggtaacg

SEQ ID NO: 130792 - DNA, 693 bp, Homo sapiens
  misc_feature: GYAE6OF01CTBN8.35.20.B09.1.454.CMB.1.raw
  modified_base (264)..(264): a, c, t, g, unknown or other
  misc_feature (264)..(264): n is a, c, g, or t
  modified_base (269)..(269): a, c, t, g, unknown or other
  misc_feature (269)..(269): n is a, c, g, or t
  modified_base (282)..(282): a, c, t, g, unknown or other
  misc_feature (282)..(282): n is a, c, g, or t
  modified_base (361)..(361): a, c, t, g, unknown or other
  misc_feature (361)..(361): n is a, c, g, or t
  modified_base (380)..(380): a, c, t, g, unknown or other
  misc_feature (380)..(380): n is a, c, g, or t
tcagtacagatcgtcacgaccggtgctcgatttagtgtagtgtgaaggggagctctgagagaggagcccagccctgggattttcaggtgttttcatttggtgatcaggactgaacagagagaactcacatggagtttgggctgagcgtggtcttttctggtggtctaattttaaaaggtgtccagtgtgaggtgcagctggtggaggtccgggggagtcttagttcgacggccgtggggggtccctgtagactcctcctgtgcngcctntgacttcaccttnagtagtcactggatgctacgtgggtacctcgaagttccgagggagggtcgtggttgtcgggtttacacgtagttacggngtagagtcggactgaacanaatccgaagccggactccgtgaaacgggtccacgttcccaccccgtcaagacgaccgaacgaccaaacgacgaactaactatactcctagaacctaaatcggaaactacggtactagggaacgtacggaaccgggtacggaaccgtaccgggtaacttcggttaacctaacgtttaccgtaggtacggtaaccggtaaggggtaacggttcgaacccgttaaacgttaaccttaccgtttaaaggttttccgggttttaacggtaacctttcccgggttaggggttaaccccggggtaacggtaaaaacgggg

SEQ ID NO: 130793 - DNA, 502 bp, Homo sapiens
  misc_feature: GYAE6OF01ATXSK.35.20.B09.1.454.CMB.1.raw
  modified_base (424)..(424): a, c, t, g, unknown or other
  misc_feature (424)..(424): n is a, c, g, or t
  modified_base (489)..(502): a, c, t, g, unknown or other
  misc_feature (489)..(502): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatctccagagacaattccaggaacacgctgtatctaacaaatggacagtctgagagccgaggacacggccttatattactgtgcgagaagcgagtgggagccctacccccggatggagcacgtgggggccagggcacccgtcggtccgccgtcctcttcacgccctccaccgaacggccccactccggtccttccccctcggccacccctccctcccaacgacgccaccctccgtcgggggccgaccgacggccggcccgtcgggccgtcggcccgtcggtacgaacggactaccgttnaccccccccccccccccccccgtatctcgtacgtgacggcgggcgtcggacgacggcgacatagnnnnnnnnnnnnnn

SEQ ID NO: 130794 - DNA, 455 bp, Homo sapiens
  misc_feature: GYAE6OF01B62JL.35.20.B09.1.454.CMB.1.raw
  modified_base (442)..(455): a, c, t, g, unknown or other
  misc_feature (442)..(455): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatctccagagacaattccaggaacacgctgtatctacaaatggacagtctgagagccgaggacacggccttatattactgtgcgaaagttcgaacagtggctggcacggaggtcgggatatgactacgtggggccagggaaccctggtcaccgtctcagcttccaccgaaggcccatccggtccttccccctggccgccctgcctccaggacgcaccgtcgtggggcacgaggtcggcccgtgggctcgccgtcggtcaacggactaccttaccacgactcgtgtactggacggcgggctgggcgaaggcgcatagnnnnnnnnnnnnnn

SEQ ID NO: 130795 - DNA, 773 bp, Homo sapiens
  misc_feature: GYAE6OF01DC8SX.35.20.B09.1.454.CMB.1.raw
  modified_base (773)..(773): a, c, t, g, unknown or other
  misc_feature (773)..(773): n is a, c, g, or t
tcagtacagatcgtcacgaccggtgctcgatttagtgtagtgtgaagggctggagtgggtctcaactattgatggtagtgctcataacacatggtacgcagactccgtgaggggccggttcaccatctccagagacaattccaggtaacacgtctgtatctacaaatggacagtctgagagccgaggacacggccttagtattactgtgcgaaagttcgaacagtggctggcacgaggtcggatatgactactgggccagggaaccctggtcaccgcctcctcacgcctcctaccgaaggggcccacgtcgggtccttcccccgtcgggccaccccgttcctccgtaaagacgtaccacccttcggtcggggggtcaaccgacggtcccgggtccccttcgggggcccttcgggcccctttaggggtacccgtaaacgggggacccgtttaaaccgtttccccgtaaacggtaaacgtttcccgtttacggttaacccgtttacgggaacgggtaccccggggggtacccgttaaccggggggttaaaccctaaaacccggggggtaccccggaacccgtaaacggttttaaacggggtacccgtaccggtaacgtacggtaccggtaaccgtaccgtaccgtaccggtaaccggtaaccggtaccggtaaccgggtaccggtaccggttaacgttaacggttacgttaaccggttaccggttaaccggtaccggttaaccggttacccgtttaaccgggttaacggtaaccn

SEQ ID NO: 130796 - DNA, 365 bp, Homo sapiens
  misc_feature: GYAE6OF01B9TT9.35.20.B09.1.454.CMB.1.raw
  modified_base (356)..(365): a, c, t, g, unknown or other
  misc_feature (356)..(365): n is a, c, g, or t
tcagtacagatcgtcacgaccggtgctcgatttagtgtagtgtgaggggccggttcaccatctccagagacaattccaggaacacgctgtatctacaaatggacagtctgagagccgaggacacggccttatattactgtgcgaaagttcgaacagtggctggcacgaggtcgggatatgactactggggccagggaaccctggtcaccgcctcctcagcctccaccaagggcccatcggtccttccccctggccaccctcctccaagacgcacctcgtgggggcacagcggccctgggctgcctggcaaggactacttccacgatctgtactgagcggctggcaaggcgcatagnnnnnnnnnn

SEQ ID NO: 130797 - DNA, 462 bp, Homo sapiens
  misc_feature: GYAE6OF01BPHJ1.35.20.B09.1.454.CMB.1.raw
  modified_base (338)..(338): a, c, t, g, unknown or other
  misc_feature (338)..(338): n is a, c, g, or t
  modified_base (423)..(423): a, c, t, g, unknown or other
  misc_feature (423)..(423): n is a, c, g, or t
  modified_base (428)..(428): a, c, t, g, unknown or other
  misc_feature (428)..(428): n is a, c, g, or t
  modified_base (431)..(462): a, c, t, g, unknown or other
  misc_feature (431)..(462): n is a, c, g, or t
tcagtacagatcgtcacgaccggtgctcgatttagtgtagtgtgaaggggctggagtgggtctcaactattgatggtagtgctcataacacatggtacgcagactccgtgaggggccgttcaccatctccagagactaattccaggaacacgctgtatctacaaatggacagtctgagagccgagggacacgggccttatattactggtgcgaaaagttcgaaacaggtggctggcacgagggtccggatatgactactggggccagggaaccctggtcacgcctcctcagcctccacaagggcccatcggtctccccctggccaccctcctccaagngcaccgtctggggcacagcgcccgtgggctgcctggtcaaggctacttcacgatcttactgagcggctcggcaaggcgcatacgnagctncgnnnnnnnnnnnnnnnnnnnnnnnnnnnnnnnn

SEQ ID NO: 130798 - DNA, 653 bp, Homo sapiens
  misc_feature: GYAE6OF01C7A86.35.20.B09.1.454.CMB.1.raw
  modified_base (613)..(613): a, c, t, g, unknown or other
  misc_feature (613)..(613): n is a, c, g, or t
  modified_base (616)..(617): a, c, t, g, unknown or other
  misc_feature (616)..(617): n is a, c, g, or t
  modified_base (619)..(622): a, c, t, g, unknown or other
  misc_feature (619)..(622): n is a, c, g, or t
  modified_base (624)..(639): a, c, t, g, unknown or other
  misc_feature (624)..(639): n is a, c, g, or t
  modified_base (641)..(653): a, c, t, g, unknown or other
  misc_feature (641)..(653): n is a, c, g, or t
tcagtacagatcgtcacgaccggtgctcgatttagtgtagtgtgaaggggctggagtgggtctcaactattgatggtagtgctcataacacatggtacgcagactccgtgaggggccgttcaccatctccagagacaattccaggaacacgctgtatctacaaatggacagtctgagagccgaggacacggccttatattactgtgacgtaaaagttcgaaacagttggctggcgaacggagggtcgggatagtgaacctagtcggggaccgaacggggtaaccctggtaccacccggtcctacctcgacgtccctcccaaccgaaccgggacccctagttcccggttcccctttccccccgtcgggcccctaacccccgttccctaacccgaaacggtaccgacccgtacccgttccgggtccggggggaccaaccggaccgggtcccgggtaccccggttacggggtccgttcccggtccggttaccgggtaaccgaaacggggtaaccctttaccgttaccccgtaacgtacttccgtttaggaaccgtttcgggacgggtaccggggtcgttacggggaaccgtaacgggaccgacgtaagtaccgggntgnngnnnngnnnnnnnnnnnnnnnngnnnnnnnnnnnnn

SEQ ID NO: 130799 - DNA, 628 bp, Homo sapiens
  misc_feature: GYAE6OF01DERL8.35.20.B09.1.454.CMB.1.raw
  modified_base (374)..(374): a, c, t, g, unknown or other
  misc_feature (374)..(374): n is a, c, g, or t
  modified_base (384)..(384): a, c, t, g, unknown or other
  misc_feature (384)..(384): n is a, c, g, or t
  modified_base (395)..(395): a, c, t, g, unknown or other
  misc_feature (395)..(395): n is a, c, g, or t
  modified_base (429)..(429): a, c, t, g, unknown or other
  misc_feature (429)..(429): n is a, c, g, or t
  modified_base (479)..(479): a, c, t, g, unknown or other
  misc_feature (479)..(479): n is a, c, g, or t
tcagtacagatcgtcacgaccggtgctcgatttagtgtagtgtgaaggggagctctgagagaggagcccagccctgggattttcaggtgttttcatttggtgatcaggactgaacagagagaactcaccatggagtttgggctgagctggtctttttcttgtggtcttattttaaaaggtgtccagtgtgaggtgcagctgttggagtcgtgggggagcttggcacgagccgtgggggtccctgagctctcctgtgcacgcctctggtacttctaacctttagcctaacctagtggcattggacgtctcgggtccgccgggctccggaagggagggctggaggtcgggtctcaacttgtgagtggtagtgctanaacgtaaacnctagtggtacnctagaccgtcggtgacggggtccgtacacactcncaagacgaacattcgaagacacgcttagtactactaacaaagtcggaacngttaccgtaggaacggacggacccggaaggtaccgaaccgggttaccctttaagtactttaacggtagttacggaacgttaaaacggtttcggaaaaccgtaggttacgggaccgttacgggaccgacgggttaaggggtcgggtaaag

SEQ ID NO: 130800 - DNA, 541 bp, Homo sapiens
  misc_feature: GYAE6OF01CCQ67.35.20.B09.1.454.CMB.1.raw
  modified_base (520)..(541): a, c, t, g, unknown or other
  misc_feature (520)..(541): n is a, c, g, or t
tcagtacagatcgtcacgaccggtgctcgatttagtgtagtgtgaaggggctggagtgggtctcaactattgatggtagtgctcataacacatggtacgcagactccgtgaggggccgttcaccatctcagagacattccaggacacgctgtatctacaaatggacagtctgagagccgagacacggccttatattactgtgacgaaagttcgaacaggtggctggcacggaggtcgggatatgactacgtggggccgaggaacccgtggtacaccgccctcctcacgccctcccaccgaacgggccacgtccggttcccttccccctcggccctacccctccctaccgaaacgcgccaccgtcgtcggggggaccaccgacggccggcccgtcggggccgtcggtcccgtcgggttaccgaaacgggtacctttaaccgttcccgtaacgtacgttccgttacgtacggttacgacgggtccggggtccgttcgggacgaaacgggcgacgtagtaggnnnnnnnnnnnnnnnnnnnnnn

SEQ ID NO: 130801 - DNA, 529 bp, Homo sapiens
  misc_feature: GYAE6OF01D4AM5.35.20.B09.1.454.CMB.1.raw
  modified_base (234)..(234): a, c, t, g, unknown or other
  misc_feature (234)..(234): n is a, c, g, or t
  modified_base (336)..(336): a, c, t, g, unknown or other
  misc_feature (336)..(336): n is a, c, g, or t
  modified_base (349)..(349): a, c, t, g, unknown or other
  misc_feature (349)..(349): n is a, c, g, or t
  modified_base (355)..(355): a, c, t, g, unknown or other
  misc_feature (355)..(355): n is a, c, g, or t
  modified_base (458)..(458): a, c, t, g, unknown or other
  misc_feature (458)..(458): n is a, c, g, or t
  modified_base (472)..(472): a, c, t, g, unknown or other
  misc_feature (472)..(472): n is a, c, g, or t
  modified_base (496)..(496): a, c, t, g, unknown or other
  misc_feature (496)..(496): n is a, c, g, or t
  modified_base (498)..(499): a, c, t, g, unknown or other
  misc_feature (498)..(499): n is a, c, g, or t
  modified_base (501)..(529): a, c, t, g, unknown or other
  misc_feature (501)..(529): n is a, c, g, or t
tcagtacagatcgtcacgaccggtgctcgatttagtgtagtgtgaaggggctggagtgggtctcaactattgatggtagtgctcataacacatggtacgcagactccggtggaggggccggttcaccatctccagagacaattccaaggaacacgctgtatactaacaaatggacagtctgagaggccgagacacggtcttatattacgtgtgacgaaagttcgaacagtcggntggcgacggaggtcggatgttgacgtacgtgggaccgacggaaccgtgtccaccgcctcctgaccgccctaccacgaacggcccagtccgtcccttccccgngcccacccgtccnccgaancgtacctaccgtcggacggggacacggaccggccggtccgtacgggccttcggccgtacggacgtaacggtacccttaccttaccgacgtactcgtacgtcgnggacggccgggtancgggaccgaacggccgagtaacgngnngnnnnnnnnnnnnnnnnnnnnnnnnnnnnn

SEQ ID NO: 130802 - DNA, 512 bp, Homo sapiens
  misc_feature: GYAE6OF01BEMOJ.35.20.B09.1.454.CMB.1.raw
  modified_base (354)..(354): a, c, t, g, unknown or other
  misc_feature (354)..(354): n is a, c, g, or t
  modified_base (475)..(475): a, c, t, g, unknown or other
  misc_feature (475)..(475): n is a, c, g, or t
  modified_base (479)..(498): a, c, t, g, unknown or other
  misc_feature (479)..(498): n is a, c, g, or t
  modified_base (500)..(512): a, c, t, g, unknown or other
  misc_feature (500)..(512): n is a, c, g, or t
tcagtacagatcgtcacgaccggtgctcgatttagtgtagtgtgaagggggctggggagtgggtctcaactattgatggtagtgctcataacacatggtacgcagactccgtgaggggccggttcaccatctccagagacaattccaggaacacgctgtatctacaaatggacagtctgagagccgaggacacggccttaatattactgtgcgtaaaagttcgaaacaggtggctggcacggagggtcgggatatgactacgtggggccagggaaccctggtccaccgccctcctcacgcctccaccgaacggccccatccggtccttcccctcggccaccctccaccaagacnccacctcgtcgggggccacacggccggcccgtgggcctcgcctcggtcgaacggtactaccttccgacgactcctagtactcggacggcgggtcgtgggaccgaacggcggacagtaacgncgtnnnnnnnnnnnnnnnnnnnngnnnnnnnnnnnnn

SEQ ID NO: 130803 - DNA, 439 bp, Homo sapiens
  misc_feature: GYAE6OF01AYX5G.35.20.B09.1.454.CMB.1.raw
  modified_base (425)..(439): a, c, t, g, unknown or other
  misc_feature (425)..(439): n is a, c, g, or t
tcagtacagatcgtcacgaccggtgctcgatttagtgtagtgtgaagggggctggagtgggtctcaactattgatggtagtgctcataacacatggtacgcagactccgtgaggggccggttcaccatctccagagacaattccaggaacacgctgtatctacaaatggacagtctgagagccgaggacacggccttatattactgtgcgaaagttcgaacagtggctggcacgaggtcgggatatgactactggggccagggaaccctggtcaccgcctcctcagcctccaccaacgggccccatcggtcttccccctggcaccctcctccaagagcacctctggggcacgagcggccctgggctgcctggtcaacggactacttccacgatctgtactgagcgggctgggcaaggcgcatagnnnnnnnnnnnnnnn

SEQ ID NO: 130804 - DNA, 581 bp, Homo sapiens
  misc_feature: GYAE6OF01DUYUG.35.20.B09.1.454.CMB.1.raw
  modified_base (122)..(122): a, c, t, g, unknown or other
  misc_feature (122)..(122): n is a, c, g, or t
  modified_base (187)..(187): a, c, t, g, unknown or other
  misc_feature (187)..(187): n is a, c, g, or t
  modified_base (203)..(203): a, c, t, g, unknown or other
  misc_feature (203)..(203): n is a, c, g, or t
  modified_base (326)..(326): a, c, t, g, unknown or other
  misc_feature (326)..(326): n is a, c, g, or t
  modified_base (548)..(581): a, c, t, g, unknown or other
  misc_feature (548)..(581): n is a, c, g, or t
tcagtacagatcgtcacgaccggtgctcgatttagtgtagtgtgaaggggctggagtgggtctcaactattgatggtagtgctcataacacatggtacgcagactccgtgaggggcccgttnaccatctccagagacaattccaggacacgctgtatctacaaatggacagtctggagcgcgagacncgtcttatacttacgngtcgaacgtaaagttccgaacgtaggtggcgtcggacgaaccgggtagggtacggtatacgtcgaccgtacggtcggggacccgaacgggtaacccgtggtccccaccgtccctcctcgaccnccctacccaaccggaaccgggccctacggttccggttccccttccccgcggacccctccctcccgtacaacgtaccgcctacccgttcgggcggggaccacggacggcccggccggtcggtccgtacgtcccgttacggaccgtaaacgtccttacccgtaccgaacgttcttacgtcgttacgacggcggcggtcggtacgaacggacggccgatacgagnnnnnnnnnnnnnnnnnnnnnnnnnnnnnnnnnn

SEQ ID NO: 130805 - DNA, 784 bp, Homo sapiens
  misc_feature: GYAE6OF01EGWRJ.35.20.B09.1.454.CMB.1.raw
tcagtacagatcgtcacgaccggtgctcgatttagtgtagtgtgaaggggagctctgagagaggagcccagccctgggattttcaggtgtttcatttggtgatcaggactgaacagagagaactcacctatggtagtttgggactgagcgtggtctttttctagtcggcttaattttaaaaggtgtccagtgtgagtgcagctgttgagtcggtggggagcttggcacgaggccgtcgggggtccctagacgtaccttcgtccttggtcgacgacggtccctcgttacggtaactttcctaacccgttttacgaccctaaccgtagttcgggacctaagtcggtacggtccgttccggggtaccccggccgggggtccgtacccgggaaagggggtaacggggtcgttaggggacggtttcgggtacctaaccgtaaacgttagttacggaagttgggtaagtcggactaacccgaattaaaaccctacgtaacggtaggttaacccgacgtaacggtaaccgtcccgggttagggaccgggggtacccgttaaccacgtactcgtaccaaggtaacgaactaacgttaccgaaggacctaacggcttaacgtacttacgtaaactaagtcgaacgtagtacgaggaacgaccgtaccgaacggaccgtacccggttacttaaacgttacgttaacgttacggtacggtaaccggttaaaccggttacggtaaacgtcggtaggcccggttaggaaccggtaaccgggtggggtacggtaaacg

SEQ ID NO: 130806 - DNA, 720 bp, Homo sapiens
  misc_feature: GYAE6OF01CF3Z2.35.20.B09.1.454.CMB.1.raw
  modified_base (571)..(571): a, c, t, g, unknown or other
  misc_feature (571)..(571): n is a, c, g, or t
tcagtacagatcgtcacgaccggtgctcgatttagtgtagtgtgaaggggagctctgagagaggagcccagccctgggattttcaggtgttttcatttggtgatcaggactgaacagagagaactcacatggagtttgggctgagctggtctttttcttgtggtcttaattttaaaaggtgtccagtgtgaggtgcagctggtggagtcgtggggggagtcgttggcacgacggcccggttcgggggggtcccctaggacgtaccgttccttcccgtggtcgcgacgtccctcgtcggtactttcctaaccgtttacgcctaacctagtcggcagttggacgtcggtcggggcccggccgggccgtacccggaagggggaacggggtcgtagggaggttcgggttcctacgtaaacttagttggtaagttcggtaagtcgtactaactaactaaacgacgtaagtacgggtacgctaacgtaccgttacgggtggggtaccggggtacccgttaccgacctaactcccgtaaccgaaggaacctaactaaacgttcccgaaaggtaaaccncgtcctagtaactacgaactaaagtcgaactagtcagacgacgtacggaagtaccacgggttaccttaagttactacgtaggtacgaagttaaaggtccaaagtagtcgggtcttaacggggaccgtaacgggtagggtcggttaaacg

SEQ ID NO: 130807 - DNA, 497 bp, Homo sapiens
  misc_feature: GYAE6OF01C9124.35.20.B09.1.454.CMB.1.raw
  modified_base (160)..(160): a, c, t, g, unknown or other
  misc_feature (160)..(160): n is a, c, g, or t
  modified_base (183)..(183): a, c, t, g, unknown or other
  misc_feature (183)..(183): n is a, c, g, or t
  modified_base (264)..(264): a, c, t, g, unknown or other
  misc_feature (264)..(264): n is a, c, g, or t
  modified_base (303)..(303): a, c, t, g, unknown or other
  misc_feature (303)..(303): n is a, c, g, or t
  modified_base (470)..(497): a, c, t, g, unknown or other
  misc_feature (470)..(497): n is a, c, g, or t
tcagtacagatcgtcacgaccggtgctcgatttagtgtagtgtgaaggggctggagtgggtctcaactattgatggtagtgctcaataaacacatggtacgcagactccgtgaggggccggttcaccatctccagagacaattccaggaacacgctgtanctaacaaaatggacagtctgagngccgagggacacggcctttaataattactggtgacgtaaaaagttccgaaacaggtggctgggcacggaggtcgggataangactagtggggccaaggaacctggtcacccggcctcctnacgctccaccaagggccccatcggtccttcccctggccacccctcctccaagacgccacctctgggggcacacggccggccctcgggctcgcccgtggtcgaaaggacctaacgttccacgtatacgtgtaacgtgagcgggtctacggggcaagggcgacatagannnnnnnnnnnnnnnnnnnnnnnnnnnn

SEQ ID NO: 130808 - DNA, 706 bp, Homo sapiens
  misc_feature: GYAE6OF01CYPWF.35.20.B09.1.454.CMB.1.raw
  modified_base (123)..(123): a, c, t, g, unknown or other
  misc_feature (123)..(123): n is a, c, g, or t
  modified_base (433)..(433): a, c, t, g, unknown or other
  misc_feature (433)..(433): n is a, c, g, or t
  modified_base (447)..(447): a, c, t, g, unknown or other
  misc_feature (447)..(447): n is a, c, g, or t
tcagtacagatcgtcacgaccggtgctcgatttagtgtagtgtgaaggggagctctgagagaggagcccagccctgggtattttcaggttgttttcatttggtgatcaggactgaacagaganaactcacagtggagtttgggctgagctggtctttttctgtggtcttaagttttaaaggtgtccagtgtgaggtgcagctggttggagtcgtgggggagtcttcggcacgacggtccggtgggggtccctggacgtaccttcctccgtgtcgcgacgtccttcgtaggtactttcctaacctttagccctaaccttagtcggctagtggagtccggtcgggtcccgccgggcctaccggaaggggacgggtcgtgggtacggttcgggtctactaaacgttgtgacgttggtagtcgactacaactaaacncgtagtcgggaccncgtaagtcccgtcgggtacgggtaccggggtcccgttaccaccgtacgtcctaccgaacgactaaacgtaactaccgaacggtaaaccaccgtctatactaacgtaactaagtcgggtaactggtacgtagaccggtaagccgggaacgacggtaaccggttacttaacgttaacgttacgtaggtaacggtaacgttaaacggttccgaaaggtacggtcggtcggtacggtacgaaacggggtggggtacgtaaagg

SEQ ID NO: 130809 - DNA, 592 bp, Homo sapiens
  misc_feature: GYAE6OF01DMPFE.35.20.B09.1.454.CMB.1.raw
  modified_base (179)..(179): a, c, t, g, unknown or other
  misc_feature (179)..(179): n is a, c, g, or t
  modified_base (220)..(220): a, c, t, g, unknown or other
  misc_feature (220)..(220): n is a, c, g, or t
  modified_base (245)..(245): a, c, t, g, unknown or other
  misc_feature (245)..(245): n is a, c, g, or t
  modified_base (547)..(547): a, c, t, g, unknown or other
  misc_feature (547)..(547): n is a, c, g, or t
  modified_base (552)..(552): a, c, t, g, unknown or other
  misc_feature (552)..(552): n is a, c, g, or t
  modified_base (560)..(564): a, c, t, g, unknown or other
  misc_feature (560)..(564): n is a, c, g, or t
  modified_base (566)..(592): a, c, t, g, unknown or other
  misc_feature (566)..(592): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatctccagagacaattccaggaacacgctgtatctacaaatggacagtctgagngccgagacacggccttatattactgtgcgaaagttcgaacngtggctggcacgagggtcgggatangactagtcgggccgagggaccctggtccaccgcctcctcaccgcctcccgaccgaacggccccgacgtcggttcccttcccccgtcggcccaccccgttcctcccaaacgtcaccgacccgtccgtcggggacaccgtacggcccggtcccgtcgggccgttcggtcccgttcggtaccgtaaaccgggtacctttaacccgtttacccgaacggttaacttcccgtttaggtaaccgttacggtacggggtaccggggtcggttacggggaccgtaaacgggcccgtaacgacgttacggnacgtnccgagtcnnnnncnnnnnnnnnnnnnnnnnnnnnnnnnnn

SEQ ID NO: 130810 - DNA, 872 bp, Homo sapiens
  misc_feature: GYAE6OF01B9RL0.35.20.B09.1.454.CMB.1.raw
  modified_base (247)..(247): a, c, t, g, unknown or other
  misc_feature (247)..(247): n is a, c, g, or t
  modified_base (330)..(330): a, c, t, g, unknown or other
  misc_feature (330)..(330): n is a, c, g, or t
tcagtacagatcgtcacgaccggtgctcgatttagtgtagtgtgaagggagctctgagagagagccagccctgggtatttcaggtgtttcatttggtgatcaggactgaacagagagaactcaccagtggagtttcggctggagcgtggtctttttcttggtggtcttaagtttttaaaaggtgtaccgtaaggttgtggtaggtcgacctagcgtgttggagtcgtgggggaagtcttgggcacgnggccggttagggggtccctgaacgtctcgtccgtgtcgccgtacgtcctcgttggactttacaccgtttagacctaccgttancggtctaagtggacggtccggttcgggccccgtaccgggtctaccggaaggggacggtctgggaacggtgggttacctagaaccgttagttgaagttcggtaagtcgtaccgtattaaactaaccgacgttaacggtcggttaaacgacccgtaagggttaaccctcccggggtaggggtaaccggggtccccggttaccggtaaaccgtaccttacccggttacggaaccgtaaacgtacccgttaaacgttacccggaacgggtaaacctaccggtaccgttacgttaacgtaaccgttaacgtaaaacgtttacggaacgtaacgtacccgttaacgggacggtaaaccgggtacccggtaacgggacccaaaccgggttacccggttaaacttaaacccgggtttacgtacggttacgggttaaacccgttaaaacccgggtttccggaaaaaaccgggttcgggttaaccggggttaacccttcgggggtaaccgttaaaacccgggggttggggtaacccccgggtttaaaacggg

SEQ ID NO: 130811 - DNA, 510 bp, Homo sapiens
  misc_feature: GYAE6OF01EOIQS.35.20.B09.1.454.CMB.1.raw
  modified_base (489)..(510): a, c, t, g, unknown or other
  misc_feature (489)..(510): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatctccagagacaattccaggaacacgctgtatctacaaatggacagtctgagagccgaggacacggccttatattactgtgacgtaaagttcgaacagtggctggcacggaggtcgggatatgactacgtgggaccgacgggaaccctggtccaccgcctcctcacgcctccaaccgaacggcccacgtccggttcccttccccccgcggcccaccccttccctaccaagaccgacctaccctcggtcggggccacgacggccggccgtcggcctcggccgtcggtacgaacggtacctaccgttaccacgtcgtcgtcgtacgtacggacggcgggcgtacgggacgaacggcgacgatgannnnnnnnnnnnnnnnnnnnnn

SEQ ID NO: 130812 - DNA, 757 bp, Homo sapiens
  misc_feature: GYAE6OF01A4WOY.35.20.B09.1.454.CMB.1.raw
  modified_base (317)..(317): a, c, t, g, unknown or other
  misc_feature (317)..(317): n is a, c, g, or t
tcagtacagatcgtcacgaccggtgctcgatttagtgtagtgtgaaggggagctctgagagaggagcccagccctgggattttcaggtgttttcatttggtgatcaggactgaacagagagaactcaccatggagtttgggctgagcgtggtctttttcttgtggcttaattttaaaaggtgtccagtgtgaggtgcagctggttggagtcgtgggggaggcgttggcacgagtccggtggggggtccctggacgtacctcctcctggtgcacgcctcgtggtacttcctacctttacgctaccgtatcggcagtgngcggtccgggtccggccgggtcctaccggagggggacgggtcgtagggtacggttgggtacctacgtaacgtttagttaggacgttaggttagtcgtacgtacaacgtaaccaacgtacgttacgggtaccgacgtacggtacccgttccgggtacgggacgggggttcccgttaccacccgttagtaccccgtaccgaaagggaacctaaccttaaccgttaaccgaacggaacctaacgttccgtaacgtacttaacgtaaaccgtaaagttcggaactacggttacgtaaggaacggtaccggtaaccggaaccggtaaccggtacccggttaacctttaacggttaccttacggttcggtacgggtaaacgttaaacgggttaccgaaacggtggtacggtcggtaccggtacggaacgggtggtaacggggtaac

SEQ ID NO: 130813 - DNA, 749 bp, Homo sapiens
  misc_feature: GYAE6OF01AC5U5.35.20.B09.1.454.CMB.1.raw
  modified_base (197)..(197): a, c, t, g, unknown or other
  misc_feature (197)..(197): n is a, c, g, or t
  modified_base (200)..(200): a, c, t, g, unknown or other
  misc_feature (200)..(200): n is a, c, g, or t
  modified_base (226)..(226): a, c, t, g, unknown or other
  misc_feature (226)..(226): n is a, c, g, or t
  modified_base (258)..(258): a, c, t, g, unknown or other
  misc_feature (258)..(258): n is a, c, g, or t
  modified_base (283)..(283): a, c, t, g, unknown or other
  misc_feature (283)..(283): n is a, c, g, or t
  modified_base (603)..(603): a, c, t, g, unknown or other
  misc_feature (603)..(603): n is a, c, g, or t
tcagtacagatcgtcacgaccggtgctcgatttagtgtagtgtgaaggggagctctgagagaggagcccagccctgggatttttcgaggttgttttcatttggtgatcaggactgaacagagagaactcaccatggagtttggctgagcgtgtcgttttcgtggtcgcgtaatttaaaggtgtcagtgtgaggtgcncgntgttgagtcgtgggagtcgtgcacgngccgtcgggtccagacgtcgtctcctgctcgntcccgtgcggtactccgtacttacnccgtaacctgtcgtccgtaagttcgagtccggtttcgggccccgaacggtcctaccgggaggggtaacggtcgaccgggtggttccggtacctaaaccgttaaggttgttaccgtacggttggtacgtcgtactaacgaacctaacacggttaacgcggtaacgtcgaccgtaacggtccggtagggaccgggtacccgttcaaacgtccgtactaccggtaacgaactaaccgtaacgttaaacccgaaggtaaccctaccggtagttaactaaccctttaagaaacgtttacggaacgtacccgtaggttaaccgganaaccggggtacctagggaaaccggtccgttaaccgttacgttaacggttaaaccttcggtacgtacgggtaaacctaacgggtaaaccctggtaacccggtgttaccccgggaggtaacccgtaggggttaccgtagggtaaaccg

SEQ ID NO: 130814 - DNA, 467 bp, Homo sapiens
  misc_feature: GYAE6OF01EAEL1.35.20.B09.1.454.CMB.1.raw
  modified_base (451)..(467): a, c, t, g, unknown or other
  misc_feature (451)..(467): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatctccagagacaattccaggaacacgctgtatctacaaatggacagtctgagagccgaggacacggcctttatattactatgcgaaaagttcgaacagtggctggcacgaggtcgggatatgactacgtggggccagggaccctggtccaccgcctcctcagcctccaccaacgggcccatccggtccttcccccgtggccaccctcctccaagacgcaccctcgtcggggccacgacgccggcccgtgggctcgccgtggtcaaggactaccgttccacgtactcgtagtactgacggcgggctgggacaaggccgacgatagnnnnnnnnnnnnnnnnn

SEQ ID NO: 130815 - DNA, 714 bp, Homo sapiens
  misc_feature: GYAE6OF01EF3DH.35.20.B09.1.454.CMB.1.raw
  modified_base (386)..(386): a, c, t, g, unknown or other
  misc_feature (386)..(386): n is a, c, g, or t
  modified_base (561)..(561): a, c, t, g, unknown or other
  misc_feature (561)..(561): n is a, c, g, or t
tcagtacagatcgtcacgaccggtgctcgatttagtgtagtgtgaagggggagctctgagagaggagcccagccctgggattttcaggtgttttcatttggtgatcaggactgaacagagagaactcaccagtggagtttgggctggagcttggtctttttcttgtggtacttaattttaaaaggtgtccagtgtgaggtgcagtcgttgttgggacggtcggtggggggaggcgtttggccgtaacgaggtccggttcggggggttcccctggaacgaccttcctccgttgcgcacgtcctcgtgtattcgtaagttttgactacctagtggcataggtacgcgtcggaccgtcccggaccgggcgtaccggaaggggaacgggngtgggtaggtcggtctacgtaagttagtggagttggtagtcgctactaagtaaaccagtaacggtacggtacacgaagtaccgtaccggtaacgaaccgggtcccgtacgaaccgtactctaccgtaagaactaacgtaacttaccgaagaaccacgtactaacgtactacgtanaacgtaaagtacgaacgacggtaccgaggtaacgaccgggaccggaaccggacctaaccggttacttaacgttaattaccgttagacccgttaaaggtaaacggtttacgagggtttacggtggtacggttgggttaacgggtcgggtaaggg

SEQ ID NO: 130816 - DNA, 789 bp, Homo sapiens
  misc_feature: GYAE6OF01DVE3S.35.20.B09.1.454.CMB.1.raw
  modified_base (195)..(195): a, c, t, g, unknown or other
  misc_feature (195)..(195): n is a, c, g, or t
tcagtacagatcgtcacgaccggtgctcgatttagtgtagtgtgaaggggagctctgagagaggagcccagccctgggattttcaggtgttttcatttggtgatcaggactgaacagagagaacctcaccatggtaggtttgggctgagctggtcttttctgtgcttaatttaaaaggtgtccagtgtgagtgcngctgtggagtcgtggggagtctggcacgacggccgtcgggggttccctggacgtacctctccgtgtcgcgacgtcctcgtagtaccgtttacctaacccgtttacgacctaaccgttagtcggactagtcgacgtccggtccgggtcccggccggaccgtaccggaggggacggggtccgtagggtacggttcggttactaccgtaaactttgttacggtaacggtggttacggtcgtacctaacgtaactaaaccgtaactacggttacggtaacccgacgtaacggtacccgttccgggtacgggtacccggggttacccttaccgaaccccgttagtttccccgaaacgtacgtaaacgaaaccgttaacgtacccgtaacgggaaccgtcgtacttaacggttacctaaccgtaaacgtaaccggtcgaaaccttacgttaccgaagtaaccggacggttaacccgggaacgacccgtacgttaaccctttagtaaccgttagtacggtaacgtaaaccggttaactaacccggaggtaaccgtggtaaccccgtaggtaacccgtaaacgggtccggtaagttaaccgg

SEQ ID NO: 130817 - DNA, 734 bp, Homo sapiens
  misc_feature: GYAE6OF01EJAC8.35.20.B09.1.454.CMB.1.raw
  modified_base (149)..(149): a, c, t, g, unknown or other
  misc_feature (149)..(149): n is a, c, g, or t
  modified_base (593)..(593): a, c, t, g, unknown or other
  misc_feature (593)..(593): n is a, c, g, or t
tcagtacagatcgtcacgaccggtgctcgatttagtgtagtgtgaaggggagctctgagagaggagcccagccctgggattttcaggttgttttcatttggtgatcaggactgaacagagagaactcaccagtggtagtttgggctagngcgtggttcttttttcttgtggtacttaagtttttaaaaggtgtccagttggtgaggtgcagcttgtggagtcggtgggggtagcgttggccacgcggccggtcgggggtaccctgacgtacctcttccgtggtacgctacgccttgtacggtctttacctacctttacgcctaccttagtcgactagtagcggtccggtaccggggtccccgggaccggggtaccgtaccgggaagggggaacggggtcgtgggtagggttcgggttacctacgttaaacgtagttgacggtttaggtaccgtgtaccctaacaactaaaccgtaggacgttagggtaacccgcgtacgggtaccgtacccgggtagggtaccgggggttacccttacgaacccgtactacccgtaaccgacgaacggaactaacgtaccggaacggtaaccncgttaccgtgtaactactaacgaagtacgactaggttacagagacggacgaacggacctacggtacttgttactacgtggtaacgtaggtaaacggtcgaagtacggtacggtcgtaccgagggtacgggtggtggtaacg

SEQ ID NO: 130818 - DNA, 903 bp, Homo sapiens
  misc_feature: GYAE6OF01BP2UE.35.20.B09.1.454.CMB.1.raw
tcagtacagatcgtcacgaccggtgctcgatttagtgtagtgtgaaggggagctctgagagaggagcccagccctgggattttcaggtgttttcatttggtgatcaggactgaacagagagaactcaccatggagtttgggctgagctggtctttttcttgtggtacttaattttaaaaggtgtccagtgtgaggtgcagcttggttggagtcggtgggggagtcgttggccacgacggccggtcggggggtccctaggacgaccttccttccgtagtcgccacgtcccttcgtcggttactttcccgtaacctttacgacctaaccttagtcggacctagtaggtacggtccggttccggggacccgggtcccgggtaccgttaccggggaaggggggtaacgggggtcggttacgggggtacgggttcggggttacccttaaccggtaaaccgtttaggttacggtacgggttacgggttaacggttcggtacccttaaacgtaaaccttaaaccgtaaccgttacggttaaccggggtaaccgtaccggtaacggtaacccgggttacccgggttacggggggtaaccccggggggttaccccgtttaacccgaaccccggtttaaccgttaccccgttaacccggtaaaccggtaaacccgtaaacccggttaaaccgtttaaccccgggaaaccgggttaaacccggtaacccgttaaccgtttaacgttaacgttaaacccttaaacgtaaacggttaccggtaacgtacgttacggtaagacggtaccgacggtaacggacctaacggttcgttaattcgtacggttcgtacggtaagttaaccggttacgaacgttggaccggtcggtacggaccggaaggtcgggtacggtaag

SEQ ID NO: 130819 - DNA, 597 bp, Homo sapiens
  misc_feature: GYAE6OF01C6TZF.35.20.B09.1.454.CMB.1.raw
  modified_base (121)..(121): a, c, t, g, unknown or other
  misc_feature (121)..(121): n is a, c, g, or t
  modified_base (174)..(174): a, c, t, g, unknown or other
  misc_feature (174)..(174): n is a, c, g, or t
  modified_base (188)..(188): a, c, t, g, unknown or other
  misc_feature (188)..(188): n is a, c, g, or t
  modified_base (204)..(204): a, c, t, g, unknown or other
  misc_feature (204)..(204): n is a, c, g, or t
  modified_base (206)..(206): a, c, t, g, unknown or other
  misc_feature (206)..(206): n is a, c, g, or t
  modified_base (556)..(556): a, c, t, g, unknown or other
  misc_feature (556)..(556): n is a, c, g, or t
  modified_base (560)..(561): a, c, t, g, unknown or other
  misc_feature (560)..(561): n is a, c, g, or t
  modified_base (566)..(566): a, c, t, g, unknown or other
  misc_feature (566)..(566): n is a, c, g, or t
  modified_base (568)..(571): a, c, t, g, unknown or other
  misc_feature (568)..(571): n is a, c, g, or t
  modified_base (573)..(597): a, c, t, g, unknown or other
  misc_feature (573)..(597): n is a, c, g, or t
tcagtacagatcgtcacgaccggtgctcgatttagtgtagtgtgaaggggctggagtgggtctcaactattgatggtagtgctcataacacatggtacgcagactccgtgaggggccgttnaccatctccagagacaattccaggaacacgctgtatctacaaatggacagtcngagagccgaggacncggcctttatattacngngacgaaagttcgaacaggtggctggcaggtagggtcggatagtcgacgtacgtcggggccgacgggtaacccgtggtccacccggtccctccctacgacgtccctacccaaccgaacgggcccctacgtccggttcccctttacccccgtcggacccctaccccgttaccctacccgaaacggtaccgacccgtaccccgttcgggcgggggtaccacgaccggcccgggtcccgtagggtccgtcgtcccgtacggtacgtaacggtacctttaacgtacccgacgtactcgttacgtacgtacgggtacggccgggtacgtcgggaaccgaggaccgacgtagtcgtncagnnactgncnnnntnnnnnnnnnnnnnnnnnnnnnnnnn

SEQ ID NO: 130820 - DNA, 624 bp, Homo sapiens
  misc_feature: GYAE6OF01CT373.35.20.B09.1.454.CMB.1.raw
  modified_base (129)..(129): a, c, t, g, unknown or other
  misc_feature (129)..(129): n is a, c, g, or t
  modified_base (135)..(135): a, c, t, g, unknown or other
  misc_feature (135)..(135): n is a, c, g, or t
  modified_base (165)..(165): a, c, t, g, unknown or other
  misc_feature (165)..(165): n is a, c, g, or t
  modified_base (191)..(191): a, c, t, g, unknown or other
  misc_feature (191)..(191): n is a, c, g, or t
  modified_base (560)..(560): a, c, t, g, unknown or other
  misc_feature (560)..(560): n is a, c, g, or t
  modified_base (584)..(584): a, c, t, g, unknown or other
  misc_feature (584)..(584): n is a, c, g, or t
  modified_base (596)..(596): a, c, t, g, unknown or other
  misc_feature (596)..(596): n is a, c, g, or t
  modified_base (605)..(624): a, c, t, g, unknown or other
  misc_feature (605)..(624): n is a, c, g, or t
tcagtacagatcgtcacgaccggtgctcgatttagtgtagtgtgaagggctggagtgggtctcaactattgatggtagtgctcaataacacatggtacgcagactccgtggaggggccgttcaccatcnccaganacaattccgaagaacacgctgtatctgcanatgaacagtcgtgggacctggagacncggctgtctattactgtgacgagagtaataagaaatgtttgcgtacgtagtagcgtagttcgtaccgttacggttccttttttacgaagttaacggtcgtaaccgtttaacgggcgggggaacccggtaaccggggtaaacccccgttggggtaccctaacgtttcccggttacccttccctaccgaccgtacccctaacccgaacccggaaaccggggtacccctaccgttcccgggttcccccttcccccgttacggacccctacccccgtaccctacgaaacggacgcctaacccggtcggtcgggggccaacgaccgccggtccgtcggcctcgcgtacggtacgaacgtacctcttaccaagtntcgtacgtacgtggaacggcggtncggaacgacggnacgtaatgnnnnnnnnnnnnnnnnnnnn

SEQ ID NO: 130821 - DNA, 442 bp, Homo sapiens
  misc_feature: GYAE6OF01D6W2K.35.20.B09.1.454.CMB.1.raw
  modified_base (421)..(421): a, c, t, g, unknown or other
  misc_feature (421)..(421): n is a, c, g, or t
  modified_base (427)..(442): a, c, t, g, unknown or other
  misc_feature (427)..(442): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatctccagagacaattccaggaacacgctgtatctacaaatggacagtctgagagccgaggacacggccttatattactgtgcgaaagttcgaacagtgctggcacgaggtcgggatatgactactgggccagggaaccctggtcaccgcctcctcagcctccaccaacggccatcggtcttcccctgccaccctcctccaagacgcacctcgtcggggcacgacgcggccctgggctgccgtggtcaacggactacttccgacgtatcgtgtactggacgcgggctggcaggcgnagtagnnnnnnnnnnnnnnnn

SEQ ID NO: 130822 - DNA, 690 bp, Homo sapiens
  misc_feature: GYAE6OF01DDRTA.35.20.B09.1.454.CMB.1.raw
  modified_base (635)..(635): a, c, t, g, unknown or other
  misc_feature (635)..(635): n is a, c, g, or t
  modified_base (644)..(644): a, c, t, g, unknown or other
  misc_feature (644)..(644): n is a, c, g, or t
  modified_base (653)..(653): a, c, t, g, unknown or other
  misc_feature (653)..(653): n is a, c, g, or t
  modified_base (656)..(657): a, c, t, g, unknown or other
  misc_feature (656)..(657): n is a, c, g, or t
  modified_base (659)..(661): a, c, t, g, unknown or other
  misc_feature (659)..(661): n is a, c, g, or t
  modified_base (664)..(664): a, c, t, g, unknown or other
  misc_feature (664)..(664): n is a, c, g, or t
  modified_base (667)..(668): a, c, t, g, unknown or other
  misc_feature (667)..(668): n is a, c, g, or t
  modified_base (671)..(673): a, c, t, g, unknown or other
  misc_feature (671)..(673): n is a, c, g, or t
  modified_base (675)..(679): a, c, t, g, unknown or other
  misc_feature (675)..(679): n is a, c, g, or t
  modified_base (683)..(684): a, c, t, g, unknown or other
  misc_feature (683)..(684): n is a, c, g, or t
  modified_base (686)..(686): a, c, t, g, unknown or other
  misc_feature (686)..(686): n is a, c, g, or t
  modified_base (688)..(688): a, c, t, g, unknown or other
  misc_feature (688)..(688): n is a, c, g, or t
tcagtacagatcgtcacgaccggtgctcgatttagtgtagtgtgaagggctggagtgggtctcaactattgatggtagtgctcataaacacatggtacgcagactccgtgaggggccgttcaccatctccagagacaattccaggaacacgctgtatctaacaaatggacagtctgagagccgaggacacggtcctttatattacgtgtacgacgtaaaacgttcgaaacgagttggctggcaacggaggtcgggatagtcgaacgtacgtcgggaccgaacgggtaaccctggtaccaacccggtcccttacctcgaccgtccctaccccgaaccgaaccggggcccctacggttacccggttccccttcccccggtcggacccctaccccgttcccgtaaccgaaacgtaccgaccctaacccgttccgggtacgggggaccctaaccggaccggtaccccgggtccccggttcggggtcccgttaccggtacccggtttacgggtaacccggtaaaccgggtaccctttacccgttaccccgaacggttaccttaccgtttacggtaacgttcgggaccgggtccgggtcgttacggggacgtaaaccgggcggtaacgtaacgtacggacncgagcgcgncgatgagcncgnngnnncgncgnncannnannnnncacnncngngc

SEQ ID NO: 130823 - DNA, 654 bp, Homo sapiens
  misc_feature: GYAE6OF01AP83T.35.20.B09.1.454.CMB.1.raw
  modified_base (152)..(152): a, c, t, g, unknown or other
  misc_feature (152)..(152): n is a, c, g, or t
  modified_base (172)..(172): a, c, t, g, unknown or other
  misc_feature (172)..(172): n is a, c, g, or t
  modified_base (248)..(248): a, c, t, g, unknown or other
  misc_feature (248)..(248): n is a, c, g, or t
  modified_base (258)..(258): a, c, t, g, unknown or other
  misc_feature (258)..(258): n is a, c, g, or t
  modified_base (368)..(368): a, c, t, g, unknown or other
  misc_feature (368)..(368): n is a, c, g, or t
  modified_base (381)..(381): a, c, t, g, unknown or other
  misc_feature (381)..(381): n is a, c, g, or t
  modified_base (405)..(405): a, c, t, g, unknown or other
  misc_feature (405)..(405): n is a, c, g, or t
tcagtacagatcgtcacgaccggtgctcgatttagtgtagtgtgaaggggagctctgagagaggagcccagccctgggattttcaggtgttttcatttggtgatcaggactgaacagagagaactcaccatggagtttgggctgagcgtgtntttctgtgctatttaaaggntcagtgtgagtgcagcgtgttggagtcgtggggagtcttggcacgagtccgtgggggtccctgacgactctcgtgngctagcctcnggtatccgacctttagactacctactggcctagtgagccgtggtcccgcggctacgagggtaagggccgaggtacggtgggtctacgtaacgttaattggagtcggtagngtaccgtacgtanaaacgtccgtagtcggtacgacgngtaaccgtccggttggaccgggacgttcgacctataccgtaccgagacgtaactacgtaccgaacgaaccggtactcttaacgtactactaaacgaacgtacggtaactaaggttcaagggtacgtacgtacccggaacggtaacacccggtttacttacctaaaagtttcccaggttccgaacggtaaacgttacccgaaagtggtacgtacggtaccggaagttacccgggtaaggtcccgggtaag

SEQ ID NO: 130824 - DNA, 560 bp, Homo sapiens
  misc_feature: GYAE6OF01DR5KD.35.20.B09.1.454.CMB.1.raw
  modified_base (520)..(520): a, c, t, g, unknown or other
  misc_feature (520)..(520): n is a, c, g, or t
  modified_base (527)..(560): a, c, t, g, unknown or other
  misc_feature (527)..(560): n is a, c, g, or t
tcagtacagatcgtcacgaccggtgctcgatttagtgtagtgtgaaggggctggagtgggtctcaactattgatggtagtgctcataaacacatggtacgcagactccgtgaggggcccggttcaccatctccagagacaattccaggaacacgctgtatctacaaaatggacagtctgagagccgaggacacggccttaatattactgtgacgaaaagttcgaacagtggctggcacgaggtcgggatatgactacgtgggccaagggaacccgtggccacccgcctcctcacgcctccaccgaacgggccccatccggtcccttcccccgtggacccacccctcctcccaaagacgacctaccctcggtcgggggacacgacggccggccccgtaggggcctcggcccgttacgggtaccgaaacggaccttacccgttacccgaacgtacttccgttgttacgtacggaccgggcggggtacgtaggggaccgaacggggtaccgacgtagtaaggnactgatnnnnnnnnnnnnnnnnnnnnnnnnnnnnnnnnnn

SEQ ID NO: 130825 - DNA, 975 bp, Homo sapiens
  misc_feature: GYAE6OF01BRMOS.35.20.B09.1.454.CMB.1.raw
  modified_base (927)..(927): a, c, t, g, unknown or other
  misc_feature (927)..(927): n is a, c, g, or t
  modified_base (965)..(965): a, c, t, g, unknown or other
  misc_feature (965)..(965): n is a, c, g, or t
tcagtacagatcgtcacgaccggtgctcgatttagtgtagtgtgaaggggagctctgagagaggagcccagccctgggtattttcgaggttgttttcatttggtgatcaggactgaacagagagaactcaaccagtgggtaggtttagggctggagtcgtggttctttttcgttgtggtactttaagttttaaaaggtcgtccgtaggtggtacggaggtgcgtagtcgttaggttagggtacggttccgggtaggggggacgttcgttcggaccgacggtaccggtcccgggtcggggggtcccgtaggtaaccggtccgttccgtccggttacgtcggacgtaccgtcccgtttcggtacgttaccgtttaccgttacccttacggtacccttaaccgtagtcggtacgtacgtaggtaaccgggtccgggttacccgggggtcccggacccggggtaccggtaccgggggaagggggtacgggtcgggtagggttacgggttccgggttaaccttacggtaaacgttaggttaggtaacggttacggtaggtacgtactaaccgtaaacgtaccgtaacgtacgggttaccggtaccgaacggttaaaccggtccccgggttacgggttacgggggtttaacccgggggtccccgttaacctacccgttaacccggtacccgtaaccggaaggtttaaaaccgggaaccgttaaacggttaaccccgggaaccggttaaaccggttaccccggttaagttaaaccgttaacccttaagttaaaaccgggtaaccgggttacgaacccgttaggtttacccggacgggtaaaccggaacggggtacccggtaacgaacccggttccgttaaacttcggttaaaccttaggtacgggtaactaacgggttaacggtcgggttaaancccgggttgaacggtacgggttaacgacggggttacgngggttaaccg

SEQ ID NO: 130826 - DNA, 641 bp, Homo sapiens
  misc_feature: GYAE6OF01E5HE3.35.20.B09.1.454.CMB.1.raw
  modified_base (175)..(175): a, c, t, g, unknown or other
  misc_feature (175)..(175): n is a, c, g, or t
  modified_base (178)..(178): a, c, t, g, unknown or other
  misc_feature (178)..(178): n is a, c, g, or t
  modified_base (186)..(186): a, c, t, g, unknown or other
  misc_feature (186)..(186): n is a, c, g, or t
  modified_base (189)..(189): a, c, t, g, unknown or other
  misc_feature (189)..(189): n is a, c, g, or t
  modified_base (197)..(197): a, c, t, g, unknown or other
  misc_feature (197)..(197): n is a, c, g, or t
  modified_base (205)..(205): a, c, t, g, unknown or other
  misc_feature (205)..(205): n is a, c, g, or t
  modified_base (211)..(211): a, c, t, g, unknown or other
  misc_feature (211)..(211): n is a, c, g, or t
  modified_base (214)..(214): a, c, t, g, unknown or other
  misc_feature (214)..(214): n is a, c, g, or t
  modified_base (229)..(229): a, c, t, g, unknown or other
  misc_feature (229)..(229): n is a, c, g, or t
  modified_base (529)..(529): a, c, t, g, unknown or other
  misc_feature (529)..(529): n is a, c, g, or t
  modified_base (559)..(559): a, c, t, g, unknown or other
  misc_feature (559)..(559): n is a, c, g, or t
  modified_base (629)..(629): a, c, t, g, unknown or other
  misc_feature (629)..(629): n is a, c, g, or t
tcagtacagatcgtcacgaccggtgctcgatttagtgtagtgtgaaggggagctctgagagaggagcccagccctgggattttcaggttgttttcatttggtgatcaggactgaacagagagaactcaccatggagtttggctgagcgtcgtgtttctaggcgctaattaaaggntcngtgtgagncantgttgagngtgggagngtcganacngtcgtcggggtcccngactccgtcgtccgtagtacgtaacgtccgttgtcgtacttccttacctagtaacgtaggtccaggtagtgcgtaacgtccggtcggttacgaccttacggaccggtaaggggtaccgtggtttacggtggttacgtttacgagttaacttcggattagacggtacgtaacacgtaccaaggtactacgacggcgttactgggacgacgaccgtcctcccggacctacgcgaactaacacgaaccaaacgtacacctaagtaactcgtaacgacctaagaaccgtaagacctatacgganacgacgaaccggtcgaaaccgttccggttnttaccgtcgtaagtgtcgacgacggtacgtcgacctaacgtgttacgtacgtttgttcgtagtcgtacgnggtaaccggacg

SEQ ID NO: 130827 - DNA, 526 bp, Homo sapiens
  misc_feature: GYAE6OF01BILW1.35.20.B09.1.454.CMB.1.raw
  modified_base (501)..(526): a, c, t, g, unknown or other
  misc_feature (501)..(526): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatctccagagacaattccaggaacacgctgtatctacaaatggacagtctgagagccgaggacacggccttatattactgtgcgaaagttcgaacagtggctggcacgagggtcgggatatgactacgtggggccagggaaccctggtcaccgcctcctcagcctccaccaacgggcccacgtccggtccttccccccgtggccacccctcctaccaacgacgccaccgtcgtcgggggaccacgacggccggcccgtggggcctcggccgttcggtaccgaaacggtaccctacctttccccgacggtacttccgttacggttacgtcggacgggccggggtcgttacggggaccgaaacgggcgcaagttacgnnnnnnnnnnnnnnnnnnnnnnnnnn

SEQ ID NO: 130828 - DNA, 674 bp, Homo sapiens
  misc_feature: GYAE6OF01DG4Z2.35.20.B09.1.454.CMB.1.raw
  modified_base (172)..(172): a, c, t, g, unknown or other
  misc_feature (172)..(172): n is a, c, g, or t
  modified_base (208)..(208): a, c, t, g, unknown or other
  misc_feature (208)..(208): n is a, c, g, or t
  modified_base (217)..(217): a, c, t, g, unknown or other
  misc_feature (217)..(217): n is a, c, g, or t
  modified_base (223)..(223): a, c, t, g, unknown or other
  misc_feature (223)..(223): n is a, c, g, or t
  modified_base (424)..(424): a, c, t, g, unknown or other
  misc_feature (424)..(424): n is a, c, g, or t
  modified_base (551)..(551): a, c, t, g, unknown or other
  misc_feature (551)..(551): n is a, c, g, or t
tcagtacagatcgtcacgaccggtgctcgatttagtgtagtgtgaaagggaaaggggtctgagagaggacgccccgacgcccgtgggtatttttcgaggtttgtttttctagttttgggtagaacgaggtactagaaacgagagaagaacgtccacagtggtggttggctgngtcgttcgttcgtttcgtgtcgtcttaagtttaagntcagtgtgngtcgcngtgtcggtgcgtcggtgggctgtaggtcgcggtcggtcgggtccagcgtcgtcctcgtgtcgacgtcgtccgttggcgtactcctaagttggagttacgcgttagtgcgtagcggtggtccggtacggtccgtccggacggccggttacggacgggtcggttacggtggttcgttcggtccttaacggttttcacggtttntccggtaggttcggttaggtcctctaacgtactacgtacgcgtctagcggttgtacgcggtacgtcgtcacggtcacgagtacgaactacgaactagaccttgtcgtacacgtactacgacgacgancgtacgtacgacgcgtaccgacgtaccgtataccgtacgtataccgtagtacggaaagtaccggtagaacggttaggtacggttacgtcgtttacgcgtaggtttacggccggttcggtcccg

SEQ ID NO: 130829 - DNA, 436 bp, Homo sapiens
  misc_feature: GYAE6OF02H3LLH.35.20.B09.1.454.CMB.1.raw
  modified_base (391)..(436): a, c, t, g, unknown or other
  misc_feature (391)..(436): n is a, c, g, or t
tcagtacagatcgtcacgaccggtgctcgatttagtgtagtgtgagggtccgggtttcgaccactctccaggagacaattccaggaacacgctgtagtcctacaaatggacagtcgtgagagccgaggacacggccttatacttacgtgtgacgaaagttcgaacagtggctggcaccgaggtcgggactatgctactggggccagggaaccctggtcaccggctcctcagcctccaccaagggccccatccgggtcttccccctggcaccctcctccaagagcacctctcgggggcacagcggcccctggggacctggaccctcggtacaacgggactaacttccacgatctgtactgagtcggggactgggccaaggcgacgatacggnnnnnnnnnnnnnnnnnnnnnnnnnnnnnnnnnnnnnnnnnnnnnn

SEQ ID NO: 130830 - DNA, 436 bp, Homo sapiens
  misc_feature: GYAE6OF02GH1KU.35.20.B09.1.454.CMB.1.raw
  modified_base (431)..(436): a, c, t, g, unknown or other
  misc_feature (431)..(436): n is a, c, g, or t
tcagtacagatcgtcacgaccggtgctcgatttagtgtagtgtgaaggggctggagtgggtctcaactattgatggtagtgctcataacacatggtacgcagactccgtggaggggccggttaaccatctccagagacaattccaggaacacgctgtatctaacaaatggacagtctgagagccgaggacacggccttatattactgtgacgaaagttcgaacagtggctggcacgaggtcgggatatgactacgtggggccgagggaaccctggtcaccgcctcctcagcctccaccaacggcccatcggtccttccccctggccaccctcctccaagagcacctcgtgggggcacagccggcccgtgggctcgcctggtcaaggactacttccacgatctgtactgagcgggctggcaaggcgcatagnnnnnn

SEQ ID NO: 130831 - DNA, 417 bp, Homo sapiens
  misc_feature: GYAE6OF02I8XYT.35.20.B09.1.454.CMB.1.raw
  modified_base (416)..(417): a, c, t, g, unknown or other
  misc_feature (416)..(417): n is a, c, g, or t
tcagtacagatcgtcacgaccggtgctcgatttagtgtagtgtgaagggctggagtgggtctcaactattgatggtagtgctcataacacatggtacgcagactccgtgaggggccggttcaccatctccagagataattccaggaacacgctgtatctacaaatggacagtctgagagccgaggacacggccttatattactgtgcgaaacttgccgactacgatattttgagtggtcttgactactggggccagggagccctggtcatcgtctcctcagcctccaccaagggcccatcggtcttccccctggcaccctcctccaagagcacctctgggggcacagcggccctgggctgcctggtcaaggactacttccacgatctgtactgagcgggctggcaaggcgcatagnn

SEQ ID NO: 130832 - DNA, 422 bp, Homo sapiens
  misc_feature: GYAE6OF02HLORV.35.20.B09.1.454.CMB.1.raw
  modified_base (412)..(412): a, c, t, g, unknown or other
  misc_feature (412)..(412): n is a, c, g, or t
  modified_base (418)..(422): a, c, t, g, unknown or other
  misc_feature (418)..(422): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatctccagagacaattccaggaacacgctgtatctacaaatggacagtctgagagccgaggacacggccttatattactgtgcgaaagttcgaacagtggctggcacgaggtcgggatatgactactggggccagggaaccctggtcaccgcctcctcagcctccaccaagggcccatcggtcttccccctggcaccctcctccaagagcacctctgggggcacagcggccctgggctgcctggtcaaggctactccacgatctgtactgagcgggctggcaaggcncatagnnnnn

SEQ ID NO: 130833 - DNA, 425 bp, Homo sapiens
  misc_feature: GYAE6OF02IK8KT.35.20.B09.1.454.CMB.1.raw
  modified_base (420)..(425): a, c, t, g, unknown or other
  misc_feature (420)..(425): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatctccagagacaattccaggaacacgctgtatctacaaatggacagtctgagagccgaggacacggccttatattactgtgcgaaagttcgaacagtggctggcacgaggtcgggatatgactactggggccagggaaccctggtcaccgcctcctcagcctccaccaagggcccatcggtcttccccctggccaccctcctccaagagcacctctggggcacagcggccctgggctgcctggtcaaggactacttccacgatctgtactgagcgggctggcaaggcgcatagnnnnnn

SEQ ID NO: 130834 - DNA, 420 bp, Homo sapiens
  misc_feature: GYAE6OF02HQM1J.35.20.B09.1.454.CMB.1.raw
  modified_base (418)..(420): a, c, t, g, unknown or other
  misc_feature (418)..(420): n is a, c, g, or t
tcagtacagatcgtcacgaccggtgctcgatttagtgtagtgtgaaggggctggagtgggtctcaactattgatcgtagtgctcataacacatggtacgcagactccgtgaggggccggttcaccatctccagagacaattccaggaacacgctgtatctacaaatggacagtctgagagccgaggacacggccttatattactgtgcgaaagttcgaacagtggctggcacgaggtcgggatatgactactggggccagggaaccctggtcaccgcctcctcagcctccaccaagggcccatcggtctccccctggcaccctcctccaagagcacctctggggcacagcggccctgggctgcctggtcaaggactacttccacgatctgtactgagcgggctggcaaggcgcatagnnn

SEQ ID NO: 130835 - DNA, 423 bp, Homo sapiens
  misc_feature: GYAE6OF02FYSJA.35.20.B09.1.454.CMB.1.raw
  modified_base (418)..(423): a, c, t, g, unknown or other
  misc_feature (418)..(423): n is a, c, g, or t
tcagtacagatcgtcacgaccggtgctcgatttagtgtagtgtgaagggctggagtgggtctcaactattgatggtagtgctcataacacatggtacgcagactccgtgagggccggttcaccatctccagagacaattccaggaacacgctgtatctacaaatggacagtctgagagccgaggacacggccttatattactgtgcgaaagttcgaacagtggctggcacgaggtcgggatatgactactggggccagggaaccctggtcaccgcctcctcagcctccaccaagggcccatcggtcttccccctggcaccctcctccaagagcacctctgggggcacagcggccctgggctgcctggtcaaggactacttccacgatctgtactgagcgggctggcaaggcgcatagnnnnnn

SEQ ID NO: 130836 - DNA, 427 bp, Homo sapiens
  misc_feature: GYAE6OF02GEJJ4.35.20.B09.1.454.CMB.1.raw
  modified_base (419)..(427): a, c, t, g, unknown or other
  misc_feature (419)..(427): n is a, c, g, or t
tcagtacagatcgtcacgaccggtgctcgatttagtgtagtgtgaagggcgtgagtggtacgtcaactattagatggtagtgctcataacacatggtacgcagactccgtgaggggccggttcaccatctccagagacaattccaggaacacgctgtatctacaaatggacagtctgagagccgaggacacggccttatattactgtgcgaaagttcgaacagtggctggcacgaggtcgggatatgactactggggccagggaaccctggtcaccgcctcctcagcctccaccaagggcccatcggtcttcccctggcaccctcctccaagacgcacctctggggcacagcggcctgggctgcctggtcaaggactacttccacgatctgtactgagcgggctggcaaggcgcatagnnnnnnnnn

SEQ ID NO: 130837 - DNA, 429 bp, Homo sapiens
  misc_feature: GYAE6OF02GYL9Q.35.20.B09.1.454.CMB.1.raw
  modified_base (422)..(429): a, c, t, g, unknown or other
  misc_feature (422)..(429): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatctccagagacaattccaggaacacgctgtatctacaaatggacagtctgagagccgaggacacggccttatattactgtgcgaaagttcgaacagtggctggcacgaggtcgggatatgactactggggccagggaaccctggtcaccgcctcctcagcctccaccaagggccccatcggtcttcccccctggcaccctcctccaagagcacctctgggggcacagcggccctgggctgcctggtcaaggactacttccacgatctgtactgagcgggctggcaaggcgcatagnnnnnnnn

SEQ ID NO: 130838 - DNA, 425 bp, Homo sapiens
  misc_feature: GYAE6OF02G4X7C.35.20.B09.1.454.CMB.1.raw
  modified_base (419)..(425): a, c, t, g, unknown or other
  misc_feature (419)..(425): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatctccagagacaattccaggaacacgctgtatctacaaatggacagtctgagagccgaggacacggccttatattacttgtgcgaaagttcgaacagtggctggcacgaggtcgggatatgactactggggccagggaaccctggtcaccgcctcctcagcctccaccaagggcccatcggtcttccccctggcaccctcctccaagagcacctctgggggcacagcggccctgggctgcctggtcaggctacttccacgatctgtactgagcgggctggcaaggcgcatagnnnnnnn

SEQ ID NO: 130839 - DNA, 431 bp, Homo sapiens
  misc_feature: GYAE6OF02H719M.35.20.B09.1.454.CMB.1.raw
  modified_base (420)..(420): a, c, t, g, unknown or other
  misc_feature (420)..(420): n is a, c, g, or t
  modified_base (426)..(431): a, c, t, g, unknown or other
  misc_feature (426)..(431): n is a, c, g, or t
tcagtacagatcgtcacgaccggtgctcgatttagtgtagtgtgaagggggctggagtgggtctcaactattgatggtagtgctcataacacatggtacgcagactccgtgaggggccggttcaccatctccagagacaattccaggaacacgctgtatctacaaatggacagtctgagagccgaggacacggccttatattactgtgacgaaaagttcgaacagtggctggcacgaggtcgggatatgactactgggccaggaaccctggtcacgcctcctcagcctccaccaaggcccatcggtccttccccctggccaccctcctccaagagcacctctgggggcacacgccggccctgggctgccctggtacaggaactacttccacgatcctgtactgagcgggctggcaaggcncatagnnnnnn

SEQ ID NO: 130840 - DNA, 561 bp, Homo sapiens
  misc_feature: GYAE6OF02IAC04.35.20.B09.1.454.CMB.1.raw
  modified_base (150)..(150): a, c, t, g, unknown or other
  misc_feature (150)..(150): n is a, c, g, or t
  modified_base (161)..(161): a, c, t, g, unknown or other
  misc_feature (161)..(161): n is a, c, g, or t
  modified_base (172)..(172): a, c, t, g, unknown or other
  misc_feature (172)..(172): n is a, c, g, or t
  modified_base (175)..(175): a, c, t, g, unknown or other
  misc_feature (175)..(175): n is a, c, g, or t
  modified_base (177)..(177): a, c, t, g, unknown or other
  misc_feature (177)..(177): n is a, c, g, or t
  modified_base (185)..(186): a, c, t, g, unknown or other
  misc_feature (185)..(186): n is a, c, g, or t
  modified_base (188)..(188): a, c, t, g, unknown or other
  misc_feature (188)..(188): n is a, c, g, or t
  modified_base (193)..(193): a, c, t, g, unknown or other
  misc_feature (193)..(193): n is a, c, g, or t
  modified_base (196)..(196): a, c, t, g, unknown or other
  misc_feature (196)..(196): n is a, c, g, or t
  modified_base (200)..(200): a, c, t, g, unknown or other
  misc_feature (200)..(200): n is a, c, g, or t
  modified_base (205)..(205): a, c, t, g, unknown or other
  misc_feature (205)..(205): n is a, c, g, or t
  modified_base (225)..(225): a, c, t, g, unknown or other
  misc_feature (225)..(225): n is a, c, g, or t
  modified_base (233)..(233): a, c, t, g, unknown or other
  misc_feature (233)..(233): n is a, c, g, or t
  modified_base (266)..(266): a, c, t, g, unknown or other
  misc_feature (266)..(266): n is a, c, g, or t
  modified_base (299)..(299): a, c, t, g, unknown or other
  misc_feature (299)..(299): n is a, c, g, or t
  modified_base (335)..(335): a, c, t, g, unknown or other
  misc_feature (335)..(335): n is a, c, g, or t
  modified_base (354)..(354): a, c, t, g, unknown or other
  misc_feature (354)..(354): n is a, c, g, or t
  modified_base (387)..(387): a, c, t, g, unknown or other
  misc_feature (387)..(387): n is a, c, g, or t
  modified_base (392)..(392): a, c, t, g, unknown or other
  misc_feature (392)..(392): n is a, c, g, or t
  modified_base (397)..(397): a, c, t, g, unknown or other
  misc_feature (397)..(397): n is a, c, g, or t
  modified_base (425)..(425): a, c, t, g, unknown or other
  misc_feature (425)..(425): n is a, c, g, or t
tcagtacagatcgtcacgaccggtgctcgatttagtgtagtgtgaaggggagctctgagagaggagcccagccctgggattttcaggtgttttcatttggtgatcaggactgaacagagagaactcaccatggagtttgggctgagcggngtgttctaggngctattaaagntcngngtgagtgnngntgtgngtngggngctgnacagctggggtcctgagctntcctgtgnacgctctggattcactttagcactatgcatganctgggccgccgggactccgagggacggcgtggngtcgggtctacgaacttgtgaagtcggtgttgctanactaactcgaatggtaacncacgtactccgtggacggggtccttcaaccgtnttacnccganagactaacgtccgaaggaaccacggttntacgtactactaacgaagtcgtactagtcaggacgacgacgacgacgtaccgttacttaagtacgttacgtgacggtaacgttaacggtccgaagtaggtcggtacgaccggtacgtacgggttacgggtacgtag

SEQ ID NO: 130841 - DNA, 583 bp, Homo sapiens
  misc_feature: GYAE6OF02F8P7C.35.20.B09.1.454.CMB.1.raw
  modified_base (337)..(337): a, c, t, g, unknown or other
  misc_feature (337)..(337): n is a, c, g, or t
  modified_base (367)..(367): a, c, t, g, unknown or other
  misc_feature (367)..(367): n is a, c, g, or t
tcagtacagatcgtcacgaccggtgctcgatttagtgtagtgtgaaggggagctctgagagaggagcccagccctgggattttcaggtgttttcatttggtgatcaggactgaacagagagaactcaccatggagtttgggctgagcgtgcgttttctaggtggctattttaaaaggtgtccagtgtgaggtgcagctgttggagtctgggggaggcttggcacagcctggggggtccctgagactctcctgtgcagcctctggattcacctttagcactatggcatgagctgggtccgccgggctccgagggaagggctggagtgggtctcaactnttgatggtagtgctcataacacatggtacncagtactccgtaggacggggccgttacaccgtatcctacccaggacgaactaacgttcccgaagggtaaccacgtctagttaactcctaacaaattggaacagttctagacgagcccgaaggaccaacgggtccttaagtattaccgtgttcggaacgttaaaggttccgaaacgtaggttcggtacgtaggaccgaacgggtagggtccgggtaa

SEQ ID NO: 130842 - DNA, 441 bp, Homo sapiens
  misc_feature: GYAE6OF02H5ORK.35.20.B09.1.454.CMB.1.raw
  modified_base (303)..(303): a, c, t, g, unknown or other
  misc_feature (303)..(303): n is a, c, g, or t
  modified_base (397)..(397): a, c, t, g, unknown or other
  misc_feature (397)..(397): n is a, c, g, or t
  modified_base (424)..(441): a, c, t, g, unknown or other
  misc_feature (424)..(441): n is a, c, g, or t
tcagtacagatcgtcacgaccggtgctcgatttagtgtagtgtgaagggcgtggagtgggtctcaactattgatggtagtgctcataacacatggtacgcagactccgtgaggggccggttcaccatctccagagacaattccaggaacacgctgtatctacaaatggacagtctgagagccgaggacacggcctttatattactgtgcgaaaagttcgaacagtggctggcacgaggtagggatatgactacgtggggccagggaaccctggtcaccgcctcctcagcctcaccaggcccancggtcttcccctggcaccctcctccagacgcacctctgggggcacgacgcggccctgggctcgcctggtcaggactacttccacgatctgtacngtagcgggctggcaaggcgcagtagcnnnnnnnnnnnnnnnnnn

SEQ ID NO: 130843 - DNA, 619 bp, Homo sapiens
  misc_feature: GYAE6OF02HYXWQ.35.20.B09.1.454.CMB.1.raw
tcagtacagatcgtcacgaccggtgctcgatttagtgtagtgtgaaggggagctctgagagaggagcccagccctgggattttcaggtgttttcatttggtgatcaggactgaacagagagaactcaccatggagtttgggctgagcgtgcgttttctagtggctattttaaaaggtgtcaatgtgaagtgcacctgttggagtcgtggggaggcttggtacaggtggggggggtccctggagactctcctgtgcatcctctggattcacctttagcaactatgccatgagctgggtccgccaggctccgagggggagggctggcggtgggtctcaactattagtgctaggcggtggtaatagagactacgcagactctctaggacgggccggtttcattcgatcctaccgagggacaaattccaaagcgcgaacggtgtaaccctggactaaaagtcgaaacacggcccgtaggggaacgaccggaacgggaccgaaccgggaccgtttaataacgtttacccgttgacgcgaaccgtagttccgtggaccgggtaggggttcctaccccgttttaataggttacgaaacgttaaggttacggtttgggttttaccgg

SEQ ID NO: 130844 - DNA, 675 bp, Homo sapiens
  misc_feature: GYAE6OF02I8F88.35.20.B09.1.454.CMB.1.raw
tcagtacagatcgtcacgaccggtgctcgatttagtgtagtgtgaaggggagctctgagagaggagcccagccctgggattttcaggtgttttcatttggtgatcaggactgaacagagagaactcaccatggagtttgggctgagcgtggcgttttctaggtggctaattttaaaaggtgtccagtgtgaggtgcagctgttggagtctgggggagcttggcacagcctggggggtccctgagactctcctgtgcagcctctggattcacctttagcacctatggcatgagctggggtccgccggggctccgagggaaggggctgggagtgggtctcgaactattgatggtacgtgctcgataacacttggtacgcagacctcgtggacggggtccggttcaaccctatcctccgagaacgtacaaacttccaaggaaccaccgcttagtacttacttaaccgaaaattcggggaacctaggtacccgttaggaacggaacggacccggtaaggggaaaccgtaacccggggttaccgtttaaactttaacgttttaacccgttgggttacggtaaccggttaaaaacggttttccggaaaaccgtagggttacgggtaacgttccgggggacctaaccggggtaacggggttaccgggggtaatttaaacggg

SEQ ID NO: 130845 - DNA, 430 bp, Homo sapiens
  misc_feature: GYAE6OF02FF15R.35.20.B09.1.454.CMB.1.raw
  modified_base (419)..(430): a, c, t, g, unknown or other
  misc_feature (419)..(430): n is a, c, g, or t
tcagtacagatcgtcacgaccggtgctcgatttagtgtagtgtgaaggggctggagtgggtctcaactattgatggtagtgctcataacacatggtacgcagactccgtgagggccggttcaccatctccagagacaattccaggaacacgctgtatctacaaatggacagtctgagagccgaggacacggccttatattactgtgcgaaagttcgaacagtggctggcacgaggtcgggatatgactactggggccagggaaccctggtcaccgcctcctcagcctccaccaagggcccatcggtcttcccccctggccaccctcctccaagagcacctctggggcacagcggccctgggctgcctggtcaaggctacttccacgatctgtactgagcgggctggcaaggcgcatagnnnnnnnnnnnn

SEQ ID NO: 130846 - DNA, 429 bp, Homo sapiens
  misc_feature: GYAE6OF02G9PNZ.35.20.B09.1.454.CMB.1.raw
  modified_base (423)..(429): a, c, t, g, unknown or other
  misc_feature (423)..(429): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatctccagagacaattccaggaacacgctgtatctacaaatggacagtctgagagccgaggacacggccttatattactgtgcgaaagttcgaacagtggctggcacgaggtcgggatatgactactggggccagggaaccctggtcaccgcctcctcagcctccaccaagggcccatcggtcttccccctggcacccctcctccaagagcacctctgggggcacagcggccctgggctgccctggtcaaggactacttccacgatctgtactgagcgggctgggcaaggcgcatagnnnnnnn

SEQ ID NO: 130847 - DNA, 435 bp, Homo sapiens
  misc_feature: GYAE6OF02HDRNY.35.20.B09.1.454.CMB.1.raw
  modified_base (424)..(435): a, c, t, g, unknown or other
  misc_feature (424)..(435): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatctccagagacaattccaggaacacgctgtatctacaaatggacagtctgagagccgaggacacggccttatattactgtgcgaaagttcgaacagtggctggcacgaggtcgggatatgactactggggccagggaaccctggtcaccgcctcctcagcctccaccaagggcccatcggtcttccccctggccaccctcctccaacgagcacctctgggggcacacgcggccctgggctgcctggtcaaggactacttccacgatctgtactgacgcgggctggcaaggcgcatagnnnnnnnnnnnn

SEQ ID NO: 130848 - DNA, 567 bp, Homo sapiens
  misc_feature: GYAE6OF02IFY6A.35.20.B09.1.454.CMB.1.raw
  modified_base (430)..(430): a, c, t, g, unknown or other
  misc_feature (430)..(430): n is a, c, g, or t
tcagtacagatcgtcacgaccggtgctcgatttagtgtagtgtgaaggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgttggagtcgtggggggaggcttgggcacgaggccgtggggggtccctggacgactctcctgtgcagcctctggattcacctttagcacctatggcatgagtctgggtccgccggggctcccggaggggaacggggctgggaggtggggtcttcgttctattagtgctaggtggtggtctcactatactacgcagactctggtcgaacggggtccgttcgaccgtctccaganacaattccaagaacctaccctagtactctgacaaatcgaacagcctagagacgccgaccgacgacggaccgtatacttactgtacgacgtaaagtggacgaacgtggggaagtggtacgttcgattccgtgtcgggg

SEQ ID NO: 130849 - DNA, 429 bp, Homo sapiens
  misc_feature: GYAE6OF02HN3LY.35.20.B09.1.454.CMB.1.raw
  modified_base (420)..(429): a, c, t, g, unknown or other
  misc_feature (420)..(429): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatctccagagacaattccaggaacacgctgtatctacaaatggacagtctgagagccgaggacacggccttatattactgtgcgaaagttcgaacagtggctggcacgaggtcgggatatgactactggggccagggaaccctggtcaccgcctcctcagcctccaccaagggcccatcggtctcccctggcaccctcctccagagcacctctgggggcacgagccggccctgggctcgcctggtcaaggactacttccacgatctgtactgagcgggctggcaaggcgcatagnnnnnnnnnn

SEQ ID NO: 130850 - DNA, 561 bp, Homo sapiens
  misc_feature: GYAE6OF02IN9JE.35.20.B09.1.454.CMB.1.raw
  modified_base (358)..(358): a, c, t, g, unknown or other
  misc_feature (358)..(358): n is a, c, g, or t
  modified_base (378)..(378): a, c, t, g, unknown or other
  misc_feature (378)..(378): n is a, c, g, or t
tcagtacagatcgtcacgaccggtgctcgatttagtgtagtgtgaaggggagctctgagagaggagcccagccctgggattttcaggtgttttcatttggtgatcaggactgaacagagagaactcaccatggagtttgggctgagcgtggtcgttttctaggtggctaattttaaaaggtgtcagtgtgaggtgcagctgttggagtcgtgggggaggcttgggcacagccgtggggggtccctgagactctcctgtgcagcctctggattcacctttagcacctatggcatgagctgggtccgccgggctccgaggggaaggggctgggagtgggtctacaactattgatggtagngctcataacacagtggtacncagacctccgtgggacggggtcccgttcaacctacgtcctacccgaagaacgaactaacttacccgaagggaaacaccgtcttagtactactaacaaatggacagtctagagagaccgagacacgtacttatattacgtgtgacgtaaagttcgaactagtgcgtggcacggtaggtacggta

SEQ ID NO: 130851 - DNA, 416 bp, Homo sapiens
  misc_feature: GYAE6OF02FNS0D.35.20.B09.1.454.CMB.1.raw
  modified_base (404)..(416): a, c, t, g, unknown or other
  misc_feature (404)..(416): n is a, c, g, or t
tcagtacagatcgtcacgaccggtgctcgatttagtgtagtgtgaggggccggttcaccatctccagagacaattccaggaacacgctgtatctacaaatggacagtctgagagccgaggacacggccttatattactgtgcgaaagttcgaacagtggctggcacgaggtcggagtatgactactgggccgacgggaacccgtacggtcgaccgcccgtccctccacgcctccctaccaacgggacccgacctcggtccgttcccccttccggcgaccctaccctccaacgagcgacctcctgggggcgacacgcgggccccgtcgggcgtcgcccgtcggttcgaaacggacgtaccttcccgtacgatctgtactgagcgggcgtgcgaacgcggcatagnnnnnnnnnnnnn

SEQ ID NO: 130852 - DNA, 425 bp, Homo sapiens
  misc_feature: GYAE6OF02G5JXV.35.20.B09.1.454.CMB.1.raw
  modified_base (419)..(425): a, c, t, g, unknown or other
  misc_feature (419)..(425): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatctccagagacaattccaggaacacgctgtatctacaaatggacagtctgagagccgaggacacggccttatattactgtgcgaaagttcgaacagtggctggcacgaggtcgggatatgactactggggccagggaaccctggtcaccgcctcctcagcctcaccaaggcccatcggtctcccctggcaccctcctccaagacgcacctctcgggggcacagcggccctgggctgcctggtcaaggactacttccacgactctgtactgagcgggctggcaaggcgcatagnnnnnnn

SEQ ID NO: 130853 - DNA, 428 bp, Homo sapiens
  misc_feature: GYAE6OF02FH9MD.35.20.B09.1.454.CMB.1.raw
  modified_base (423)..(428): a, c, t, g, unknown or other
  misc_feature (423)..(428): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatctccagagacaattccaggaacacgctgtatctacaaatggacagtctgagagccgaggacacggccttatattactgtgcgaaagttcgaacagtggctggcacgaggtcgggatatgactactggggccagggaaccctggtcaccgcctcctcagcctccaccaagggcccatcggtcttccccctggccaccctcctccaagacgcacctctgggggcacagcggccctgggctgcctggtcaaggactacttccacgactctgtactgagcgggctggcaaggcgcatagnnnnnn

SEQ ID NO: 130854 - DNA, 638 bp, Homo sapiens
  misc_feature: GYAE6OF02GZVHZ.35.20.B09.1.454.CMB.1.raw
  modified_base (345)..(345): a, c, t, g, unknown or other
  misc_feature (345)..(345): n is a, c, g, or t
tcagtacagatcgtcacgaccggtgctcgatttagtgtagtgtgaaggggagctctgagagaggagcccagccctgggattttcaggtgttttcatttggtgatcaggactgaacagagagaactcaccatggagtttgggctgagcgtggtcttttcttggtggctaattttaaaaggtgtccagtgtgaggtgcagctgttggagtctgggggagcttggcacagccgtgggggtccctggagactctcctgtgcagcctctggattcacctttagcctacctatggcatgagcgtgggtcccgccgggctccgagggacgggctggagtcgggtctcaactnttgatggtagtgctacataacacagttcggtacgcagactccggtgggacggggtccgttacacctatccgtaccagacgaactaattcccgaaggaacctacgtcgttagtactaccgtaaacaaaacgttcgggaaacctaggttaccgtaggaaggtaacgcccggtaaaggaccgaaccggttacctttaagttacgtttacgtggttacggaaccggttaaaggttacccggaacgtaggttaccgggtcttaccgggaccggtaacgggtacggggttcggtaaacg

SEQ ID NO: 130855 - DNA, 427 bp, Homo sapiens
  misc_feature: GYAE6OF02I6IBF.35.20.B09.1.454.CMB.1.raw
  modified_base (413)..(413): a, c, t, g, unknown or other
  misc_feature (413)..(413): n is a, c, g, or t
  modified_base (419)..(427): a, c, t, g, unknown or other
  misc_feature (419)..(427): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatctccagagacaattccaggaacacgctgtatctacaaatggacagtctgagagccgaggacacggccttatattactgtgcgaaagttcgaacagtggctggcacgaggtcgggatatgactactggggccagggaaccctggtcaccgcctcctcagcctccaccaagggcccatcggtcttccccctggccaccctcctccaagagcacctctggggcacagcggccctgggctgcctggtcaaggctacttccacgatctgtactgagcgggctggcaaggcncatagnnnnnnnnn

SEQ ID NO: 130856 - DNA, 430 bp, Homo sapiens
  misc_feature: GYAE6OF02H4ZZ9.35.20.B09.1.454.CMB.1.raw
  modified_base (315)..(315): a, c, t, g, unknown or other
  misc_feature (315)..(315): n is a, c, g, or t
  modified_base (420)..(430): a, c, t, g, unknown or other
  misc_feature (420)..(430): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatctccagagacaattccaggaacacgctgtatctacaaatggacagcctgagagccgacgacacggccgtatattactgtgcgaaaattggcgaactggggaagtggtacttcgatctctggggccgtggcaccctggtcactgtctcctcagcctccaccaagggcccatccggtcttccccctggcnccctgcctccaggacgcacctccgagagcacagccggcctgggctgcctggtcaacggactacttccacgatctgtactgaggcgggctggcaaggcgcagtagnnnnnnnnnnn

SEQ ID NO: 130857 - DNA, 367 bp, Homo sapiens
  misc_feature: GYAE6OF02G5YO2.35.20.B09.1.454.CMB.1.raw
  modified_base (359)..(367): a, c, t, g, unknown or other
  misc_feature (359)..(367): n is a, c, g, or t
tcagtacagatcgtcacgaccggtgctcgatttagtgtagtgtgaggggaccgggttcaccatctccagagtaccaacttcccaggaacacgctgtatctacaaagtggacagtacgtgagagccgaggacacggccttatattactgtgcgaaagttcgaacagtggctggcacgaggtcgggatatgactactggggccagggaaccctggtcaccgcctcctcggcctccaccaaggcccatcggtctccccctggccaccctcctccaagagcacctctggggcacagcgccctgggctgcctggtcaaggactacttccacgatctgtactgagcggctggcaaggcgcatagnnnnnnnnn

SEQ ID NO: 130858 - DNA, 574 bp, Homo sapiens
  misc_feature: GYAE6OF02IIWJQ.35.20.B09.1.454.CMB.1.raw
tcagtacagatcgtcacgaccggtgctcgatttagtgtagtgtgaaggggagctctgagagaggagcccagccctgggattttcaggtgttttcatttggtgatcaggactgaacagagagaactcaccatggagtttgggctgagcgtggtctttttcttgtggctaattttaaaaggtgtccagtgtgaggtgcagctgttggagtcgtgggggaggcttggcacagccgtgggggtccctgagactctcctgtgcagcctctggattcacctttagcacctatgcatgagcgtgggtccggccgggctccgaggggagggcgtggagtggtctcaactattgatggtagtgctcaataacacagttggtacgcagacctccggtggacggggtccgttacaccatcctaccgagacgaactacttccaagggaacacgtctagtaactctaacaaatggacaggtcaggacgacgccgaagaccaccggtcttaatacttacgtggtacgacgtaaacgttacgaacgtaggttcgaccgttagggaccaacgggtacgggtacggtaacg

SEQ ID NO: 130859 - DNA, 446 bp, Homo sapiens
  misc_feature: GYAE6OF02J1S8F.35.20.B09.1.454.CMB.1.raw
  modified_base (419)..(419): a, c, t, g, unknown or other
  misc_feature (419)..(419): n is a, c, g, or t
  modified_base (421)..(446): a, c, t, g, unknown or other
  misc_feature (421)..(446): n is a, c, g, or t
tcagtacagatcgtcacgaccggtgctcgatttagtgtagtgtgaagggctggagtgggtctcaactattgatggtagtgctcataacacatggtacgcagactccgtgaggggccggttcaccatctccagagacaattccaggaacacgctgtatctacaaatggacagtctgagagccgaggacacggccttatattactgtgcgaaagttcgaacagtggctggcacgaggtcgggatatgactactggggccagggaaccctggtcaccgcctcctcagcctccaccaaggcccatcggtcttcccccctggccaccctcctccaagagcacctctggggcacagcggccctgggctgcctggtcagctacttccacgatctgtacctgagcgggctgggcaaggcgcagtagngnnnnnnnnnnnnnnnnnnnnnnnnnn

SEQ ID NO: 130860 - DNA, 426 bp, Homo sapiens
  misc_feature: GYAE6OF02GQPUR.35.20.B09.1.454.CMB.1.raw
  modified_base (420)..(426): a, c, t, g, unknown or other
  misc_feature (420)..(426): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatctccagagacaattccaggaacacgctgtatctacaaatggacagtctgagagccgaggacacggccttatattactgtgcgaaagttcgaacagtggctggcacgaggtcgggatatgactactggggccagggaaccctggtcaccgcctcctcagcctccaccaagggcccatcggtcttccccctggcaccctcctccaagagcacctctggggcacagcggccctgggctgcctggtcaacggactacttccacgactctgtactgagcgggctggcaaggcgcatgnnnnnnn

SEQ ID NO: 130861 - DNA, 423 bp, Homo sapiens
  misc_feature: GYAE6OF02IZVLT.35.20.B09.1.454.CMB.1.raw
  modified_base (389)..(423): a, c, t, g, unknown or other
  misc_feature (389)..(423): n is a, c, g, or t
tcagtacagatcgtcacgaccggtgctcgatttagtgtagtgtgaggggccggttcaccatctccagagacaattccaggaacacgctgtatctacaaatggacagtctgagagccgaggacacggccttatattactgtgcgaaagttcgaacagtggctggcacgaggtcgggatatgactacgtggggccagggaaccctggtcaccgcctcctcagcctccacgaacggcccatcggtcctcccctggccaccctcctcaagcgccacctcgtgggggcacgacgccggcccgtgggcctcggccgtggtaccaacgggaccttaccgttccgacgtactcgtcgtacgtggacggcgggctcggacgaaggccgacagtaggcnnnnnnnnnnnnnnnnnnnnnnnnnnnnnnnnnnn

SEQ ID NO: 130862 - DNA, 427 bp, Homo sapiens
  misc_feature: GYAE6OF02FUXQQ.35.20.B09.1.454.CMB.1.raw
  modified_base (418)..(427): a, c, t, g, unknown or other
  misc_feature (418)..(427): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatctccagagacaattccaggaacacgctgtatctacaaatggacagtctgagagccgaggacacggccttatattactgtgcgaaagttcgaacagtggctggcacgaggtcgggatatgactactggggccagggaaccctggtcaccgcctcctcagcctccaccaaggcccatcggtcttccccctggcaccctcctccaagagcacctctggggcacagcggccctgggctgcctggtcaaggactacttccacgatctgtactgagcgggctggcaaggcgcatagnnnnnnnnnn

SEQ ID NO: 130863 - DNA, 429 bp, Homo sapiens
  misc_feature: GYAE6OF02F4HWS.35.20.B09.1.454.CMB.1.raw
  modified_base (421)..(429): a, c, t, g, unknown or other
  misc_feature (421)..(429): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatctccagagacaattccaggaacacgctgtatctacaaatggacagtctgagagccgaggacacggccttatattactgtgcgaaagttcgaacagtggctggcacgaggtcgggatatgactactggggccagggaaccctggtcaccgcctcctcagcctccaccaagggcccatcggtcttccccctggccaccctcctccaagagcacctctgggggcacagcggccctgggctgcctggtcaaggactacttccacgatctgtactgagcgggctggcaaggcgcatagnnnnnnnnn

SEQ ID NO: 130864 - DNA, 586 bp, Homo sapiens
  misc_feature: GYAE6OF02GOD8C.35.20.B09.1.454.CMB.1.raw
  modified_base (262)..(262): a, c, t, g, unknown or other
  misc_feature (262)..(262): n is a, c, g, or t
  modified_base (282)..(282): a, c, t, g, unknown or other
  misc_feature (282)..(282): n is a, c, g, or t
  modified_base (291)..(291): a, c, t, g, unknown or other
  misc_feature (291)..(291): n is a, c, g, or t
  modified_base (331)..(331): a, c, t, g, unknown or other
  misc_feature (331)..(331): n is a, c, g, or t
  modified_base (353)..(353): a, c, t, g, unknown or other
  misc_feature (353)..(353): n is a, c, g, or t
  modified_base (370)..(370): a, c, t, g, unknown or other
  misc_feature (370)..(370): n is a, c, g, or t
  modified_base (384)..(384): a, c, t, g, unknown or other
  misc_feature (384)..(384): n is a, c, g, or t
  modified_base (402)..(402): a, c, t, g, unknown or other
  misc_feature (402)..(402): n is a, c, g, or t
tcagtacagatcgtcacgaccggtgctcgatttagtgtagtgtgaaggggagctctgagagaggagcccagccctgggattttcaggtgttttcatttggtgatcaggactgaacagagagaactcaccatggagtttgggctgagcgtgtgtttctaggtggctatttaaaggtgtccagtgtgaggtgcagctgttggagtcgtgggggaggcttggcacagccgtggggggtccctggagactctcctgtgcagccctntggatcacctttagcacctntggcatganctgggtccgcggctcgagggaacgggctggagtgggtctnaactattgagtggtagtgactnataacactatggtaacncagacttcccgggnggtacgggtccgtacacncgtccacgagtacactactaccgaagaacgacgtctacgtactacaaatacgtaagacgtagttcgtaggaacgtacggaacgtacgaaccgtaccgtacttaacttacgttaacgtggtaacgtaacggttaacgtaccggtaacgtggtacgtcgacggtacgtaacgggtaggtacggtac

SEQ ID NO: 130865 - DNA, 361 bp, Homo sapiens
  misc_feature: GYAE6OF02F9470.35.20.B09.1.454.CMB.1.raw
  modified_base (356)..(361): a, c, t, g, unknown or other
  misc_feature (356)..(361): n is a, c, g, or t
tcagtacagatcgtcacgaccggtgctcgatttagtgtagtgtgaggggccggttcaccatctccagagacaattccaggaacacgctgtatctacaaatggacagtctgagagccgaggacacggccttatattactgtgcgaaagttcgaacagtggctggcacgaggtcgggatatgactactggggccagggaaccctggtcaccgcctcctcagcctccaccaagggcccatcggtccttccccctggccaccctcctccaagacgcacctctgggggcacagcggccctgggctgcctggtcaaggactactccacgatctgtactgagcgggctggcaaggcgcatagnnnnnn

SEQ ID NO: 130866 - DNA, 523 bp, Homo sapiens
  misc_feature: GYAE6OF02I3MSI.35.20.B09.1.454.CMB.1.raw
  modified_base (390)..(390): a, c, t, g, unknown or other
  misc_feature (390)..(390): n is a, c, g, or t
  modified_base (398)..(398): a, c, t, g, unknown or other
  misc_feature (398)..(398): n is a, c, g, or t
tcagtacagatcgtcacgaccggtgctcgatttagtgtagtgtgaaggggagctctgagagaggagcccagccctgggattttcaggtgttttcatttggtgatcaggactgaacagagagaactcaccatggagtttgggctgagcgtggcttttctgtggctattttaaaaggtgtccagtgtgaggtgcagctgttggagtctgggggagcttggcacagcctggggggtccctgagactctcctgtgcagcctctggattcacctttagcacctatggcatgagctgggtccgcgggctccgagggaagggctggagtgggtctcactatgatggtagtgctcataacacatggtacgcagactccgtgacggggtccgttcaccntctcaganacattccgagaacacgctgtatctacaatgacagtcagagagccgaaggacacggccttagtacttactaggtcgtacgaaagttcgaacgtaggttcgcgttaggacacggacgggtggtaacg

SEQ ID NO: 130867 - DNA, 693 bp, Homo sapiens
  misc_feature: GYAE6OF02IVNZZ.35.20.B09.1.454.CMB.1.raw
  modified_base (179)..(179): a, c, t, g, unknown or other
  misc_feature (179)..(179): n is a, c, g, or t
  modified_base (186)..(186): a, c, t, g, unknown or other
  misc_feature (186)..(186): n is a, c, g, or t
  modified_base (362)..(362): a, c, t, g, unknown or other
  misc_feature (362)..(362): n is a, c, g, or t
  modified_base (386)..(386): a, c, t, g, unknown or other
  misc_feature (386)..(386): n is a, c, g, or t
tcagtacagatcgtcacgaccggtgctcgatttagtgtagtgtgaaggggagctctgagagaggagcccagccctgggattttcaggtgttttcatttggtgatcaggactgaacagagagaactcaccatggagtttgggctgagcgtgtcgttttcgtaggtggctaatttaaaggngtcagtntgagtgcagctgtggagtgtgggggagtgttggtacaggccgtgggggtccctggagtgtcctccgtgtgctgcctgtggatcgtaaccttggagtatctagtggcatggagcgttcggggcccacgtaacggcccgtccggtaaggggacgggccgttaggcggtgggttacctntacgttagttgcgtgtagtgggtntctactactagtacgtacgcgtaagtactggtagtacggtacggtccgttacgaccgtccgtacgagtaacgacttaactaaccgaaacgtacctacgttacttaacgtacgtacgtaacgaaacgtacgaaccgtacgaccgtagaacgtaaccgacccgaaccgtaaaccgtaacccgtaaccgtttaacgttacgttaaccggttacggtaacggtaaacggtaaacggttaccgggaaaccggttaagggtaacggggttaacggtaccggtttaaccgttacggttaccttcgggttacggg

SEQ ID NO: 130868 - DNA, 685 bp, Homo sapiens
  misc_feature: GYAE6OF02GAYM1.35.20.B09.1.454.CMB.1.raw
  modified_base (260)..(260): a, c, t, g, unknown or other
  misc_feature (260)..(260): n is a, c, g, or t
  modified_base (265)..(265): a, c, t, g, unknown or other
  misc_feature (265)..(265): n is a, c, g, or t
tcagtacagatcgtcacgaccggtgctcgatttagtgtagtgtgaaggggagctctgagagaggagcccagccctgggattttcaggtgttttcatttggtgatcaggactgaacagagagaactcaccatggagtttgggctgagcgtggtcgttttctagtcggctaattttaaaggtgtccagtgtgaggtgcagctgttggagtcgtgggggaggcgttggcacagccgtgggggtccctgagactctcctgtgcngcctntggattccactttagcacctatggcatggagtcgtcgggtcccggccgggtcctaccgaggggaacgggtctgggaggtcgggtcctcgaacttagtgtagtaggtgtgacttcaataacgacgagttacggacgacaacgtcgttaccggtggaaccgggggtcccgttaccgaccgtacgtccgtaccgtaaggtacgtaaacctagttacccgaacggtaaacctacgtaccgttagttacctaccgttaaacgtaacgtacggtacaacggttcgtaaggacggaaccgacggaacgtacggaaccggttaccgttaacgttacgttaacgttcggtaacggtaaccgtaaacggttccgaaacggttacggtacggtaccggttgggaccgtaaccgggtacgggtacggtaacg

SEQ ID NO: 130869 - DNA, 358 bp, Homo sapiens
  misc_feature: GYAE6OF02IVIZS.35.20.B09.1.454.CMB.1.raw
  modified_base (264)..(264): a, c, t, g, unknown or other
  misc_feature (264)..(264): n is a, c, g, or t
  modified_base (351)..(358): a, c, t, g, unknown or other
  misc_feature (351)..(358): n is a, c, g, or t
tcagtacagatcgtcacgaccggtgctcgatttagtgtagtgtgaggggccggttcaccatctccagagacaattccaggaacacgctgtatctacaaatggacagtctgagagccgaggacacggccttatattactgtgcgaaagttcgaacagtggctggcacgaggtcgggatatgactactggggccagggaaccctggtcaccgcctcctcggcctccaccaagggcccatcggtcttcccctgcaccctctccaagngcacctctgggggcacagcggccctgggctgcctggtcaaggactacttccacgatctgtactgagcgggctggcaaggcgcatagnnnnnnnn

SEQ ID NO: 130870 - DNA, 485 bp, Homo sapiens
  misc_feature: GYAE6OF02JV5EB.35.20.B09.1.454.CMB.1.raw
  modified_base (179)..(179): a, c, t, g, unknown or other
  misc_feature (179)..(179): n is a, c, g, or t
  modified_base (285)..(285): a, c, t, g, unknown or other
  misc_feature (285)..(285): n is a, c, g, or t
  modified_base (301)..(301): a, c, t, g, unknown or other
  misc_feature (301)..(301): n is a, c, g, or t
  modified_base (313)..(313): a, c, t, g, unknown or other
  misc_feature (313)..(313): n is a, c, g, or t
  modified_base (316)..(316): a, c, t, g, unknown or other
  misc_feature (316)..(316): n is a, c, g, or t
  modified_base (329)..(329): a, c, t, g, unknown or other
  misc_feature (329)..(329): n is a, c, g, or t
  modified_base (334)..(334): a, c, t, g, unknown or other
  misc_feature (334)..(334): n is a, c, g, or t
  modified_base (354)..(354): a, c, t, g, unknown or other
  misc_feature (354)..(354): n is a, c, g, or t
  modified_base (446)..(446): a, c, t, g, unknown or other
  misc_feature (446)..(446): n is a, c, g, or t
  modified_base (452)..(452): a, c, t, g, unknown or other
  misc_feature (452)..(452): n is a, c, g, or t
  modified_base (456)..(485): a, c, t, g, unknown or other
  misc_feature (456)..(485): n is a, c, g, or t
tcagtacagatcgtcacgaccggtgctcgatttagtgtagtgtgaaggggctggagtgggtctcaactattgatggtagtgctcataacacatggtacgcagactccgtgaggggccgggttcaccatctccagagacaattccaggaacacgctgtatctacaaatggacagtctganagccgaggacacggccttatattactgtgcgaaagttcgaacagttggctggcgacgaggtcgggatatgactacgtgggccagggaccgtgtcaccgcctctcancctccacacggcccancggtcctccccngcnccctctccagacncaccncgtcgggcacgcgccggccnggacctcgccgtaggtccaacgggcctaacctcccgacgtactcgtacgtctcggtaggccgggtccgttcggacggaacggccggtaccgngtaagncggnnnnnnnnnnnnnnnnnnnnnnnnnnnnnn

SEQ ID NO: 130871 - DNA, 489 bp, Homo sapiens
  misc_feature: GYAE6OF02HTBVW.35.20.B09.1.454.CMB.1.raw
  modified_base (352)..(352): a, c, t, g, unknown or other
  misc_feature (352)..(352): n is a, c, g, or t
  modified_base (442)..(442): a, c, t, g, unknown or other
  misc_feature (442)..(442): n is a, c, g, or t
  modified_base (449)..(449): a, c, t, g, unknown or other
  misc_feature (449)..(449): n is a, c, g, or t
  modified_base (452)..(452): a, c, t, g, unknown or other
  misc_feature (452)..(452): n is a, c, g, or t
  modified_base (457)..(457): a, c, t, g, unknown or other
  misc_feature (457)..(457): n is a, c, g, or t
  modified_base (460)..(489): a, c, t, g, unknown or other
  misc_feature (460)..(489): n is a, c, g, or t
tcagtacagatcgtcacgaccggtgctcgatttagtgtagtgtgaaggggctggagtgggtctcaactattgatggtagtgctcataacacatggtaacgcagactccgtgaggggccggttcacccatctccagagacaattccaggaacacgctgtactctacaaatggacagtctgagagccgaggacacggccttatattactgtgcgaaagttcgaacagtggctggcacggagggtcgggatatgactacgtggggccgacgggaaccctggtaccaccgcctcctcacgcctccaccgaacgggcccagtcggtccttccccgtggccaccctcctccaacgacncctacctcgtggggcacgacgccggcctggctcgcctggcaagactactaccacactctacgtactgacggccggctaggcaacggcganacgagcngcngcagncgnnnnnnnnnnnnnnnnnnnnnnnnnnnnnn

SEQ ID NO: 130872 - DNA, 491 bp, Homo sapiens
  misc_feature: GYAE6OF02JM2OR.35.20.B09.1.454.CMB.1.raw
  modified_base (341)..(341): a, c, t, g, unknown or other
  misc_feature (341)..(341): n is a, c, g, or t
  modified_base (464)..(491): a, c, t, g, unknown or other
  misc_feature (464)..(491): n is a, c, g, or t
tcagtacagatcgtcacgaccggtgctcgatttagtgtagtgtgaagggctggagtgggtctcaactattgatggtagtgctcataacacatggtacgcagactccgtgagggccggttcaccatctccagagacaattccaggaacacgctgtatctacaaatggacagtctgagagccgaggacacggccttatattactgtgcgaaagttcgaacagtggctggcacgaggtcgggatatgactactggggccgagggaacccgtggtcagtccggtctcctcacgcctccaccaaggcccatccggtccttcccctggccacccgtcctccaacgcnccaccgtcgtcggggccacgacgcggctcgtggggctcggtcctgggtaccaacgggtaccttaccgttacccgacgattcctgtaacctggacggtcggcctgggcgaaggccgcgataggnnnnnnnnnnnnnnnnnnnnnnnnnnnn

SEQ ID NO: 130873 - DNA, 535 bp, Homo sapiens
  misc_feature: GYAE6OF02JCBTN.35.20.B09.1.454.CMB.1.raw
  modified_base (500)..(535): a, c, t, g, unknown or other
  misc_feature (500)..(535): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatctccagagacaattccaggaacacgctgtatctacaaatggacagtctgagagccgaggacacggccttatatttactgtgacgaaagttcgaacagtggctggcacggaggtcgggatatgactacgtggggccagggaaccctggtcaccgcctcctcacgtcctcccaccgaacgggccccatccggtccttccccccgtggccacccctcctccaagacgccacctcggtcgggggacacgacggccggcccgtggggcctacggccctgggtccaaagggaccttaccgttcccacggacttcgttcgtaccgtggacggtccggggacttcggggaccaaggggtccgacgtaacgtacggtgacgnnnnnnnnnnnnnnnnnnnnnnnnnnnnnnnnnnnn

SEQ ID NO: 130874 - DNA, 570 bp, Homo sapiens
  misc_feature: GYAE6OF02JE3DZ.35.20.B09.1.454.CMB.1.raw
  modified_base (222)..(222): a, c, t, g, unknown or other
  misc_feature (222)..(222): n is a, c, g, or t
  modified_base (522)..(522): a, c, t, g, unknown or other
  misc_feature (522)..(522): n is a, c, g, or t
  modified_base (525)..(525): a, c, t, g, unknown or other
  misc_feature (525)..(525): n is a, c, g, or t
  modified_base (531)..(531): a, c, t, g, unknown or other
  misc_feature (531)..(531): n is a, c, g, or t
  modified_base (536)..(536): a, c, t, g, unknown or other
  misc_feature (536)..(536): n is a, c, g, or t
  modified_base (538)..(538): a, c, t, g, unknown or other
  misc_feature (538)..(538): n is a, c, g, or t
  modified_base (540)..(540): a, c, t, g, unknown or other
  misc_feature (540)..(540): n is a, c, g, or t
  modified_base (543)..(544): a, c, t, g, unknown or other
  misc_feature (543)..(544): n is a, c, g, or t
  modified_base (546)..(547): a, c, t, g, unknown or other
  misc_feature (546)..(547): n is a, c, g, or t
  modified_base (549)..(550): a, c, t, g, unknown or other
  misc_feature (549)..(550): n is a, c, g, or t
  modified_base (552)..(553): a, c, t, g, unknown or other
  misc_feature (552)..(553): n is a, c, g, or t
  modified_base (555)..(555): a, c, t, g, unknown or other
  misc_feature (555)..(555): n is a, c, g, or t
  modified_base (557)..(570): a, c, t, g, unknown or other
  misc_feature (557)..(570): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatctccagagacaattccaggaacacgctgtatctacaaatggacagtctgagagccgaggcacggccttatattactgtgacgaaagttcgaaacngtggctggcagaggtcgggatatgactacgtgggccgagggaacctggtcaccgcctcctcagcctccaccaacgggcccacgtccggttccttcccccgtggccacccctcctccaacgacgccacctcgtggggccacgacgccggacccgtcggggcctcggccgtcggtaccgtaaacggtaccttaaccttacccgaccgtacgttaccgttacggttaaccgttcggaacgggtcccgggggtcgttaccggggaccgtaaacgggggacccgaccgtaaagttacgacgcganacngacgcncgcgnangncgnngnngnngnnangnnnnnnnnnnnnnn

SEQ ID NO: 130875 - DNA, 471 bp, Homo sapiens
  misc_feature: GYAE6OF02FJP84.35.20.B09.1.454.CMB.1.raw
  modified_base (220)..(220): a, c, t, g, unknown or other
  misc_feature (220)..(220): n is a, c, g, or t
  modified_base (440)..(440): a, c, t, g, unknown or other
  misc_feature (440)..(440): n is a, c, g, or t
  modified_base (442)..(442): a, c, t, g, unknown or other
  misc_feature (442)..(442): n is a, c, g, or t
  modified_base (444)..(471): a, c, t, g, unknown or other
  misc_feature (444)..(471): n is a, c, g, or t
tcagtacagatcgtcacgaccggtgctcgatttagtgtagtgtgaaggggctggagtgggtctcaactattgatggtagtgctcataacacatggtacgcagactccgtgagggccggttcaccatctccagagacaattccaggaacacgctgtatctacaaatggacagtctgagagccgaggacacggccttatattactgtgcgaaagttcgaacngtggctggcacgaggtcgggatatgactacgtgggccagggaccctggtcaccgcctcctcagcctccaccaacgggcccatcggtcttcccgtggcaccctcctccaagagccacctcgtggggcacacgcggccctgggcttgcccgtggtccaagggaccttaccttcccacggtatcctgtactggacgccgggctcggcaaaggtccgcataggntncnnnnnnnnnnnnnnnnnnnnnnnnnnnn

SEQ ID NO: 130876 - DNA, 732 bp, Homo sapiens
  misc_feature: GYAE6OF02JLHAN.35.20.B09.1.454.CMB.1.raw
tcagtacagatcgtcacgaccggtgctcgatttagtgtagtgtgaaggggagctctgagagaggagcccagccctgggattttcaggtgttttcatttggtgatcaggactgaacagagaggactcaccatggagtttgggctgagctggattttccttgctactatttaaaggtgtccagtgtgaggtgcagctggtggagtcgtgggggagtcgttaggtaaagccgtgggggtccctgagactctcctgtacagtctctggattcagtctaagtgacgccgtgatgaacgtcgggtccgcgaggcctaccgacggccgaggggcgtgggtaggtggggttacgggaccgttaaacgttaaaaacccgaaggtccggttagggacggggtaacgggaaccgtaaacgacggtaaccgtaacggtccgtacgggaaccccggtaggaaaacgggtcgtaacgggttaccaaccgtataccgtacgaaagaagtacgtagaatttaaccgaaacgtaaaaccgttcctttaagaaccgttagaaactaaacgtagaaacctaccgacctaaacggaaaaccgaaggaaccaaaccgtacgtacccgttttaattaccgttaccgtaaccctaaacccgttacaacttacttaacgtgtaaacttaagacggtacgggtacttaccgggtcgggtaaccgaagggtacctacccgtaggtacccttaacccgg

SEQ ID NO: 130877 - DNA, 433 bp, Homo sapiens
  misc_feature: GYAE6OF02IV5SQ.35.20.B09.1.454.CMB.1.raw
  modified_base (425)..(433): a, c, t, g, unknown or other
  misc_feature (425)..(433): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatctccagagacaattccaggaacacgctgtatctacaaatggacagtctgagagccgaggacacggccttatattactgtgcgaaagttcgaacagtggctggcacgaggtcgggatatgactactgggccagggaaccctggtcaccgcctcctcagcctccaccaaggcccatcggtcttccccctggccacccctcctcccaacgacgacacctctcgggggcacgagccggccctgggctgcctggtcgaagactactccacgatctgtactgagcgggctggcaaggcgcatgnnnnnnnnn

SEQ ID NO: 130878 - DNA, 679 bp, Homo sapiens
  misc_feature: GYAE6OF02HPVY8.35.20.B09.1.454.CMB.1.raw
  modified_base (204)..(204): a, c, t, g, unknown or other
  misc_feature (204)..(204): n is a, c, g, or t
  modified_base (304)..(304): a, c, t, g, unknown or other
  misc_feature (304)..(304): n is a, c, g, or t
  modified_base (404)..(404): a, c, t, g, unknown or other
  misc_feature (404)..(404): n is a, c, g, or t
  modified_base (431)..(431): a, c, t, g, unknown or other
  misc_feature (431)..(431): n is a, c, g, or t
tcagtacagatcgtcacgaccggtgctcgatttagtgtagtgtgaaggggagctctgagagaggagcccagccctgggattttcaggtgttttcatttggtgatcaggactgaacagagagaactcaccatggagtttgggctgagcgtgtcgttttctgtggctaagtttaaaggtgtccagtgtgaggtgcagctggttggngtcgtgggggagtcgttggcacgcgccggttcgggggtccctggacgcttccgtccgtgtgcagccttcgtggtacttctacctttgctacctagtcggnagtgacgtcggtcgggtcccggtccgggtccgtacccggaggggaacgggtccgtaggggtcggttcgggtcctacgtaacttagttgtaagtggtcgtncgtactaagtaacactagtcggaaccncgtaacgtccgtccgggtgggacggggttcccgtacgacctacgtactccgtagacgtaactaacgttaccgaagtaaccgacgtacgtagtactaactaacgaagtcggtaacaggttacgaggtagaaccggtacgaaccggtacgtaccgttaccttaagtacgttagttacggtagtaaccggtaaaggtaccgtaacgtacggtcgtaccggtacggaaccgggttacgaggggtaccgtaag

SEQ ID NO: 130879 - DNA, 630 bp, Homo sapiens
  misc_feature: GYAE6OF02JH6J9.35.20.B09.1.454.CMB.1.raw
  modified_base (180)..(180): a, c, t, g, unknown or other
  misc_feature (180)..(180): n is a, c, g, or t
  modified_base (227)..(227): a, c, t, g, unknown or other
  misc_feature (227)..(227): n is a, c, g, or t
  modified_base (254)..(254): a, c, t, g, unknown or other
  misc_feature (254)..(254): n is a, c, g, or t
  modified_base (267)..(267): a, c, t, g, unknown or other
  misc_feature (267)..(267): n is a, c, g, or t
  modified_base (432)..(432): a, c, t, g, unknown or other
  misc_feature (432)..(432): n is a, c, g, or t
  modified_base (574)..(574): a, c, t, g, unknown or other
  misc_feature (574)..(574): n is a, c, g, or t
  modified_base (624)..(624): a, c, t, g, unknown or other
  misc_feature (624)..(624): n is a, c, g, or t
tcagtacagatcgtcacgaccggtgctcgatttagtgtagtgtgaaggggagctctgagagaggagcccagccctgggattttcaggtgttttcatttggtgatcaggactgaacagagagaactcaccatggagtttgggctgagcggtgtcgtttctaggtcggctaatttaaaggtntcagtgtgaggtgcagctgttggagtcgtgggggaggcttggcacgngccgtgggggtccctgagctctcctgngcagcctcgtggnttctacctttagctacctatggcatgagcgtcgggtccgccgggctccgaggggtagggctgggcgtgggtctactaacgtgttgatggtagtgtctacaataccaatagtggtaaccgctaacggtcctccgggtaggacggggggttcccgttacaacccgtnttaccgtacccgaaggaaggtaaccctaacgtttacccggaaggaaccgaacgtcgttacggtactaccgtaactaaagtcgaacgtacgtcgtagacgacgtacccggaggtaccaccggtacttaactagtttacccggnggtaacgtaacgtaacgtacgacgtagtcggtcgaggcgtacggtacggngtaacg

SEQ ID NO: 130880 - DNA, 470 bp, Homo sapiens
  misc_feature: GYAE6OF02HE0FU.35.20.B09.1.454.CMB.1.raw
  modified_base (436)..(436): a, c, t, g, unknown or other
  misc_feature (436)..(436): n is a, c, g, or t
  modified_base (457)..(470): a, c, t, g, unknown or other
  misc_feature (457)..(470): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatctccagagacaattccaggaacacgctgtatctacaaatggacagtctgagagccgaggacacggccttatattactgtgcgaaagttcgaacagtggctggcacgaggtcgggatatgactacgtggggccagggaaccctggtcaccgcctcctcagcctccaccgaacgggccccagtccggtccttccccctggccacccctcctccaagacgccaaccctcgtcgggggccacgacggccggcccgtgggcctgcccgtggtcaacggacttaccttccgacgtactctgtactgaggccgggntcggacgaagggcgacatagnnnnnnnnnnnnnn

SEQ ID NO: 130881 - DNA, 428 bp, Homo sapiens
  misc_feature: GYAE6OF02F7O4R.35.20.B09.1.454.CMB.1.raw
  modified_base (421)..(428): a, c, t, g, unknown or other
  misc_feature (421)..(428): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatctccagagacaattccaggaacacgctgtatctacaaatggacagtgtgagagccgaggacacggccttatattactgtgcgaaagttcgaacagtggctggcacgaggtcgggatatgactactggggccagggaaccctggtcaccggcctcctcagcctccaccaagggcccatcggtcttccccctggcaccctcctccaagagcacctctggggcacagcggccctgggctgcctggtcaaggactacttccacgatctgtactgagcgggctgggcaaggcgcatagnnnnnnnn

SEQ ID NO: 130882 - DNA, 509 bp, Homo sapiens
  misc_feature: GYAE6OF02GWAVB.35.20.B09.1.454.CMB.1.raw
  modified_base (485)..(486): a, c, t, g, unknown or other
  misc_feature (485)..(486): n is a, c, g, or t
  modified_base (488)..(509): a, c, t, g, unknown or other
  misc_feature (488)..(509): n is a, c, g, or t
tcagtacagatcgtcacgaccggtgctcgatttagtgtagtgtgaaggggctggagtgggtctcaactattgatggtagtgctcataaacacatggtacgcagactccgtgaggggccggttcaccatctccagagacaattccaggaacacgctgtatctaacaaatggacagtctgagacgccgaggacacggccttatattactgtgacgtaaagttcgaaacagtggctggcacggagggtcggatatgacgtacgtcggggccgacgggaacctggtccaccgcctcctcacgccctccaaccgaacgggccctagtccggtcccttccccgtcggccctacccctccctaccaagacgccaccgtcggtacgggggcacgacggccggccgtgggctcgccggtcggtacgaacggtaccttacttccacgtactctagtacgcggacgggcgggtcgtcggacggtaggcgcaagtgnngnnnnnnnnnnnnnnnnnnnnnn

SEQ ID NO: 130883 - DNA, 509 bp, Homo sapiens
  misc_feature: GYAE6OF02HH9RK.35.20.B09.1.454.CMB.1.raw
  modified_base (492)..(509): a, c, t, g, unknown or other
  misc_feature (492)..(509): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatctccagagacaattccaggaacacgctgtatctacaaatggacagtctgagagccgaggacacggccttatattactgtgcgaaagttcgaacagtggctggcacggaggtcgggatatgactacgtggggccagggaacccctggtcaccgcctcctcagcctcccaccgaagggccccatccggtccttcccccctcggcccacccctcctccaacgtacgcctacctcgtcgggggcaccgacggccgggcccgtcggggcctcggcccgtcgggtacgaaacgggtaccttaaccgttcccacgtacttcgttcgtacgtggacggcggggcgttcgggacgaacgggcgacgtagtacgnnnnnnnnnnnnnnnnnn

SEQ ID NO: 130884 - DNA, 519 bp, Homo sapiens
  misc_feature: GYAE6OF02IIY98.35.20.B09.1.454.CMB.1.raw
  modified_base (222)..(222): a, c, t, g, unknown or other
  misc_feature (222)..(222): n is a, c, g, or t
  modified_base (249)..(249): a, c, t, g, unknown or other
  misc_feature (249)..(249): n is a, c, g, or t
  modified_base (331)..(331): a, c, t, g, unknown or other
  misc_feature (331)..(331): n is a, c, g, or t
  modified_base (352)..(352): a, c, t, g, unknown or other
  misc_feature (352)..(352): n is a, c, g, or t
  modified_base (484)..(485): a, c, t, g, unknown or other
  misc_feature (484)..(485): n is a, c, g, or t
  modified_base (487)..(505): a, c, t, g, unknown or other
  misc_feature (487)..(505): n is a, c, g, or t
  modified_base (507)..(519): a, c, t, g, unknown or other
  misc_feature (507)..(519): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatctccagagacaattccaggaacacgctgtatctaacaaatggacagtctgagagccgaggacacggcctttatattactgtgcgaaagttcgaanaggtggctggcacggaggtcgggatangactagtgggccagggaaccctggtccaccggcctcctcacgccctaccaccgaacgggcccatccggttccttccccccgnggccaccctcctaccaagacnccacctcggtggggcagtcgccggccgtcgggctcgccgtggacgaaggtaacctaccgttaccacgtacttcctacgtacgtggaacggccgggtcgtacggaccgaaacgggccgacgtaagtagcacgnnannnnnnnnnnnnnnnnnnngnnnnnnnnnnnnn

SEQ ID NO: 130885 - DNA, 656 bp, Homo sapiens
  misc_feature: GYAE6OF02JQUD4.35.20.B09.1.454.CMB.1.raw
  modified_base (221)..(221): a, c, t, g, unknown or other
  misc_feature (221)..(221): n is a, c, g, or t
  modified_base (271)..(271): a, c, t, g, unknown or other
  misc_feature (271)..(271): n is a, c, g, or t
  modified_base (286)..(286): a, c, t, g, unknown or other
  misc_feature (286)..(286): n is a, c, g, or t
tcagtacagatcgtcacgaccggtgctcgatttagtgtagtgtgaaggggagctctgagagaggagcccagccctgggattttcaggtgttttcatttggtgatcaggactgaacagagagaactcaccatggagtttgggctgagctggcttttctgtggctattttaaaggtgtccagtgtgaggtgcagctgttggagtcgtgggggagcgttggcanggccgtgggggtccctgagctctctagtgaagcgtcgtggattcatcttnaatactatgcatgcncgtcgggtaccgccgaggcctcgaggcgaagggctgggagtcggtggcaggttgtgtggtatgagttaggaagtaagtacgtatacgtagtgacagtacgacgaggaacggccgtagttacacgtatcctacagtaacaacgtaactacgaaaacgtaaccttacgtttacgttcctaaggtaactaaacgttaccgaaacgtaccgtaccttaggaaacgaccgggtaacccggaaacgggttaacccgaacgggttaccggaacgttttaacgtaacgtttaccggttaaggtaacggttaacccggaaggtaacggaccgggtaacggttacggggaacccgtacccggtacccccgggttaaacgg

SEQ ID NO: 130886 - DNA, 366 bp, Homo sapiens
  misc_feature: GYAE6OF02HK0PL.35.20.B09.1.454.CMB.1.raw
  modified_base (353)..(366): a, c, t, g, unknown or other
  misc_feature (353)..(366): n is a, c, g, or t
tcagtacagatcgtcacgaccggtgctcgatttagtgtagtgtgaggggccggttcaccatctccagagacaattccaggaacacgctgtatctacaaatggacagtctgagagccgaggacacggccttatattactgtgcgaaagttcgaacagtggctggcacgaggtcgggatatgactactggggccagggaaccctggtcaccgcctcctcagcctccaccaagggcccatcggtcttccccctggccaccctcctccaagagccacctcgtggggcacagcggccctgggctgcctgtcaaggctacttccacgatctgtactgagcgggctgcgaggcgcatagnnnnnnnnnnnnnn

SEQ ID NO: 130887 - DNA, 850 bp, Homo sapiens
  misc_feature: GYAE6OF02JO71P.35.20.B09.1.454.CMB.1.raw
  modified_base (160)..(160): a, c, t, g, unknown or other
  misc_feature (160)..(160): n is a, c, g, or t
  modified_base (213)..(213): a, c, t, g, unknown or other
  misc_feature (213)..(213): n is a, c, g, or t
tcagtacagatcgtcacgaccggtgctcgatttagtgtagtgtgaagggctggagtgggtctcgaactattgatggtagtgcgtcataacacatggtacgcagactccgtgagggccggttcgaccactctccagagaccaattccaggacacgctgtanctacaaactggacagtctgagacgccgagtacacggtccttaatattacttgngaccgaaagttcgaacacggtaggcctgggactaccggaaggggtccgggtatacgtacggaccttaacggtcggggtaccgacggggtaaaaccccgtggggttaccgacccgggtacccttcccgttaccgaacggtcccttccccaacccgtaacccgggaaccccgaacgtccggttccccgttacccccgttccggtacccgtaacccctccccgtttacccgaaaccggttaccgggaccaaccccggtttaccgttaccgggggggaaccttacccggtaaccggaacccggggtacccccggtacgggggttaccgtcccggggttaaccccgtcgggttaacccggtaaccgggtaaccgttaaacccgttttacccggaacccgttacgtttaaccgtcggtaaacccgtttcgggaaagggtcccccggggtccggtttagggtacccgaaagggggtccccgtaaaggaacccggttaggctaaccgtacgacccgttaggacttaccggtacgttcctaaaacggggtcgtacgtacgtacgtacgcgtacgtacgagtccgtcgtacgtacgcgtcgtacgtacgacgcggtacgtcgtacgtacgtacgtaccgtacgctcg

SEQ ID NO: 130888 - DNA, 727 bp, Homo sapiens
  misc_feature: GYAE6OF02I24AA.35.20.B09.1.454.CMB.1.raw
tcagtacagatcgtcacgaccggtgctcgatttagtgtagtgtgaaggggagctctgagagaggagcccagccctgggattttcaggtgttttcatttggtgatcaggactgaacagagagaactcaccatggagtttgggctgagctggtcttttttcttgtggtcttaagttttaaaaggtgtccagtgtgaggtgcagctgttggagtcgtgggggaggcgttggcacgaggcccgttgggggggtcccctggagtacctcctccctggtcgctacgccttcgtggacttcctacctttagcctaccgtatggctagtgacgcgtcggggtcccgccggctcggaggggacgggtcagggcgtggtacctataactagtggtatggtacgtgacctacgaactaaaccaatgtacggtacgacaacggaccgtccggtagggtaccggggtaccccgttaccaaccgtaccttcccgtaccgaaggtaacgtaaactaaaccggtttacccgaaagggtaaccctacggttaccttaaggttaacctaaccttaaacaaaaggttccgggacttaaacggttctaaagggacgtaccgggaaccggtaacgggaaccgttacggtaaccctttaattaccgttacgtagggtactaacgggtaaacgtaccggaagtaggtaccggtactacgggtaacgtaccgggtacgggtaggtaaaccg

SEQ ID NO: 130889 - DNA, 713 bp, Homo sapiens
  misc_feature: GYAE6OF02HUHKM.35.20.B09.1.454.CMB.1.raw
  modified_base (207)..(207): a, c, t, g, unknown or other
  misc_feature (207)..(207): n is a, c, g, or t
  modified_base (350)..(350): a, c, t, g, unknown or other
  misc_feature (350)..(350): n is a, c, g, or t
tcagtacagatcgtcacgaccggtgctcgatttagtgtagtgtgaaggggagctctgagagaggagcccagccctgggattttcaggtgttttcatttggtgatcaggactgaacagagagaactcaccatggagtttgggctgagctggtctttttcttgtggtctaatttttaaaaggtgtccagtgtgaggtgcagctgttggngtcgtgggggaggcgttggcacagccgtgggggtccctgagactctcctgtcgcacgcctcgtggtacttcaccttttagcctaccttagtggcatgacgtctcggggtcccgccgggtctccggaaggggaggggctagggngtgggtctacgaacttagttgagttggtagtcgtacctacaataaacaactagtacgggtaaccgctaacggtaccgtacccgggtgggaaccgggggtcccggtttaccaacccgtacgttccgtacccgaaggtaacaacctaaacgttacccgaaaggaaaccctacggtctacgttaacttacctaacgtaaacgtggaactacggttcgtaggaacggacggtaccgaaagggtaccaacccgggttaccttaagttacctttaacggtacggttacggtaaaccggttaaaaggttcccgaaaggtcggttacggaccggttcggggaacctaacgggtaggggtaccggttaacgg

SEQ ID NO: 130890 - DNA, 360 bp, Homo sapiens
  misc_feature: GYAE6OF02FV4TS.35.20.B09.1.454.CMB.1.raw
  modified_base (345)..(345): a, c, t, g, unknown or other
  misc_feature (345)..(345): n is a, c, g, or t
  modified_base (351)..(360): a, c, t, g, unknown or other
  misc_feature (351)..(360): n is a, c, g, or t
tcagtacagatcgtcacgaccggtgctcgatttagtgtagtgtgaggggccggttcaccatctccagagacaattccaggaacacgctgtatctgcaaatgaacagcctgagagccgacgacacggctgtgtattactgtgcgagaacacgtagagatggctacaatttggacgtcttttgatatcgtggggccaagggacaatggtcaccgtctcttcacgcctccaccaagggcccatccggtcttccccctggccaccctcctccagagcacctctggggcacagcgcctggctgcctggtcaggactactccacgatctgtactgagcggctggcaaggcncatagnnnnnnnnnn

SEQ ID NO: 130891 - DNA, 732 bp, Homo sapiens
  misc_feature: GYAE6OF02I7MOG.35.20.B09.1.454.CMB.1.raw
tcagtacagatcgtcacgaccggtgctcgatttagtgtagtgtgaaggggagctctgagagaggagcccagccctgggattttcaggtgttttcatttggtgatcaggactgaacagagagaactcaccatggaggtttgggctgagctggtctttttcttgtggtcttaattttaaaaggtgtccagtgtgaggtgcagctggttggagtcgtgggggaggtcgttggcacgacggcccggttcggggggtcccgtggacgtacctcctccgtggtcgcacgtccctcgtaggtactttaccgtaacctttacgcctaaccttacgtcggactagtcggaggtccggttccggggtccccggccgggtccgtaccgggaacgggggaacgggggtccgtggggtacgggttccggggtacctacgtaaacttacgttaggtaggttacggttagtcgtaccttacgaacttaaacactacgtacggtaacgacgaacgtaccgtaccgggtacgggtaccggggtcccgttaacaccgtacgtcccacgaggaaccgtaactaccgttaccggaacgtaacacgtctacgtactaccaagaacgtcgactagtcgagacgcgaccggacgaccgaacgtcttaatacgtttacgtaggtccgaaacggttaacgttaacggaacgtacgggtcggtacgtacgggaaccggtgggtaacgggtagtaacgg

SEQ ID NO: 130892 - DNA, 605 bp, Homo sapiens
  misc_feature: GYAE6OF02JH15B.35.20.B09.1.454.CMB.1.raw
  modified_base (244)..(244): a, c, t, g, unknown or other
  misc_feature (244)..(244): n is a, c, g, or t
  modified_base (546)..(546): a, c, t, g, unknown or other
  misc_feature (546)..(546): n is a, c, g, or t
  modified_base (551)..(551): a, c, t, g, unknown or other
  misc_feature (551)..(551): n is a, c, g, or t
  modified_base (553)..(553): a, c, t, g, unknown or other
  misc_feature (553)..(553): n is a, c, g, or t
  modified_base (556)..(557): a, c, t, g, unknown or other
  misc_feature (556)..(557): n is a, c, g, or t
  modified_base (559)..(561): a, c, t, g, unknown or other
  misc_feature (559)..(561): n is a, c, g, or t
  modified_base (563)..(563): a, c, t, g, unknown or other
  misc_feature (563)..(563): n is a, c, g, or t
  modified_base (567)..(567): a, c, t, g, unknown or other
  misc_feature (567)..(567): n is a, c, g, or t
  modified_base (569)..(569): a, c, t, g, unknown or other
  misc_feature (569)..(569): n is a, c, g, or t
  modified_base (571)..(571): a, c, t, g, unknown or other
  misc_feature (571)..(571): n is a, c, g, or t
  modified_base (575)..(575): a, c, t, g, unknown or other
  misc_feature (575)..(575): n is a, c, g, or t
  modified_base (577)..(578): a, c, t, g, unknown or other
  misc_feature (577)..(578): n is a, c, g, or t
  modified_base (581)..(581): a, c, t, g, unknown or other
  misc_feature (581)..(581): n is a, c, g, or t
  modified_base (585)..(585): a, c, t, g, unknown or other
  misc_feature (585)..(585): n is a, c, g, or t
  modified_base (590)..(590): a, c, t, g, unknown or other
  misc_feature (590)..(590): n is a, c, g, or t
  modified_base (592)..(592): a, c, t, g, unknown or other
  misc_feature (592)..(592): n is a, c, g, or t
  modified_base (594)..(594): a, c, t, g, unknown or other
  misc_feature (594)..(594): n is a, c, g, or t
  modified_base (596)..(598): a, c, t, g, unknown or other
  misc_feature (596)..(598): n is a, c, g, or t
  modified_base (600)..(605): a, c, t, g, unknown or other
  misc_feature (600)..(605): n is a, c, g, or t
tcagtacagatcgtcacgaccggtgctcgatttagtgtagtgtgaaggggctggagtgggtctcaactattgatggtagtgctcataacacatggtacgcagactcgtgaggggccggttcaccatctccagagacaattccaggaacacgctgtatctacaaatggacagtctgagagccggaggacacggacttatattactgtgcgagagcggagtcgggacgcccgtaccccgggatagngcgaccggcgggaccgacggggccacccgtcggtccggcccgttaccttccttccgacgccctaccgaacccgaacgggcccaacgttccggtccctttcccccgcggaccctaccccttcctacccgaacgacgtccctaccgtcggcggggtccaaccggcgccggtacccggtgggccctacggtcccgttgggaacctaaccgggtaccttaccgttacccgaacgtacttcgtacgtacgtcgggacgggtcccgggtgtacgggacggtaacgggcccgaacgtaacgtagccgtncgtgngngcnncnnncngcgngngngtgngnngcncacngcgcngngncnnngnnnnnn

SEQ ID NO: 130893 - DNA, 647 bp, Homo sapiens
  misc_feature: GYAE6OF02JGFWD.35.20.B09.1.454.CMB.1.raw
  modified_base (205)..(205): a, c, t, g, unknown or other
  misc_feature (205)..(205): n is a, c, g, or t
  modified_base (247)..(247): a, c, t, g, unknown or other
  misc_feature (247)..(247): n is a, c, g, or t
  modified_base (577)..(577): a, c, t, g, unknown or other
  misc_feature (577)..(577): n is a, c, g, or t
tcagtacagatcgtcacgaccggtgctcgatttagtgtagtgtgaaggggctgggagtgggtctcaactattgatggtagtgctcataacacatggtacgcagactccgtgaggggccggttcaccatctccagagacaattccaggaacacgctgtatctaacaaatggacagtctgagagccgaggacacggcttatattacngtgacgtaaagttcaacagtggactggcacgaggtcggatangactacggtcgggcgacgggacctcggtcaccgcctcctcacgcctccaccgaacggccctagtccggttcccttacccccgtggtacccaccccttccgacccgtaaagcccgtacctacccgttaccgggtcgggggacctaaccgcggcccggtcccggtcgggcctcggccgttcggtaccgaacgggtaacctacgttacccgacgttaccgttcgtacgttacgacgggtacgggccggggttcgtacgggtaccgtaaggggccctaacggtaacgtacgggcttagacgtacacgtcacgtcgccgtagaccgcgcgcgtcncgtcgtactacgtcgacgtacgtacgtcgcacgtcgtacgacgactactacgaccgtacgtcgcgcgacg

SEQ ID NO: 130894 - DNA, 826 bp, Homo sapiens
  misc_feature: GYAE6OF02HJK84.35.20.B09.1.454.CMB.1.raw
  modified_base (261)..(261): a, c, t, g, unknown or other
  misc_feature (261)..(261): n is a, c, g, or t
tcagtacagatcgtcacgaccggtgctcgatttagtgtagtgtgaaggggagctctgagagaggagcccagccctgggattttcaggtgttttcatttggtgatcaggactgaacagagagaactcaccatggagtttgggctgagcgtgtcgttttctaggtggctaattttaaaggtgtccagtgtgaggtgcagctggtggaggtccgggggagtcgttagttcagccgtgggggtcctgagacctcgtcctgtcgcngcccttcgtggtactttcctaaccgtttcgagttaacgtcaacgtggattcggcctacggttcgggtcccgtaccgtaaacggttcccggaaaggggtacggggtccgttggggttggttaccggggttttaccgtaacggtttaactttaaccgggtagttacggtaagttcgggggtaacttacggaaacctaacgttaaacggttacccggttaaccgggtacggttaacccgtttccggggtacggaaaccgggggtacccgttaacccgttaccccgaaccccccctttacggtaacggtaaccgaacccgtaaaccggaccccgtaaaacggaaaccctaaccgaaacttaacgtaacctctaacgaactaaagtacgaacgtagtacgtacgacggtacgaccggacgaaccgaccggtcgttacgttaccgttaacgttaacgttacgtacggtacgtaacgggtacggtaacgtaacgttaaccgtaaagtaccgttaacggtttaggtttaccgtaccgtttacggttaccgggttcgggtaacggttaaacggg

SEQ ID NO: 130895 - DNA, 547 bp, Homo sapiens
  misc_feature: GYAE6OF02F3Z6X.35.20.B09.1.454.CMB.1.raw
  modified_base (505)..(505): a, c, t, g, unknown or other
  misc_feature (505)..(505): n is a, c, g, or t
  modified_base (507)..(507): a, c, t, g, unknown or other
  misc_feature (507)..(507): n is a, c, g, or t
  modified_base (509)..(509): a, c, t, g, unknown or other
  misc_feature (509)..(509): n is a, c, g, or t
  modified_base (511)..(511): a, c, t, g, unknown or other
  misc_feature (511)..(511): n is a, c, g, or t
  modified_base (513)..(517): a, c, t, g, unknown or other
  misc_feature (513)..(517): n is a, c, g, or t
  modified_base (519)..(519): a, c, t, g, unknown or other
  misc_feature (519)..(519): n is a, c, g, or t
  modified_base (521)..(522): a, c, t, g, unknown or other
  misc_feature (521)..(522): n is a, c, g, or t
  modified_base (524)..(532): a, c, t, g, unknown or other
  misc_feature (524)..(532): n is a, c, g, or t
  modified_base (535)..(540): a, c, t, g, unknown or other
  misc_feature (535)..(540): n is a, c, g, or t
  modified_base (542)..(547): a, c, t, g, unknown or other
  misc_feature (542)..(547): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatctccagagacaattccaggaacacgctgtatctaacaaatggacagtctgagagccgaggacacggccttatattactgtgacgaaaagttcgaaacagtggctggcacggaggtcgggatatgactacgtgggccagggaaccctggtcaccgcctcctcacgcctccaccaacgggcccatccggtccttcccccgtcggcccacccctcctccaagacgccacctcgtgggggccacgacggccggcccgtcgggctcggcccgtggtaccgaaacgggtaccttaccgttaccccaacggtactccgtttacgtaacgttacggacggccggggtccgttagggaccgaaacgggtccgaccgtaagtaacggngngngncnnnnnancnnannnnnnnnncgnnnnnncnnnnnn

SEQ ID NO: 130896 - DNA, 678 bp, Homo sapiens
  misc_feature: GYAE6OF02GXOWK.35.20.B09.1.454.CMB.1.raw
  modified_base (270)..(270): a, c, t, g, unknown or other
  misc_feature (270)..(270): n is a, c, g, or t
  modified_base (638)..(638): a, c, t, g, unknown or other
  misc_feature (638)..(638): n is a, c, g, or t
tcagtacagatcgtcacgaccggtgctcgatttagtgtagtgtgaaggggagctctgagagaggagcccagccctgggattttcaggtgttttcatttggtgatcaggactgaacagagagaactcaccatggagtttgggctgagtctggctttttcttgtggctattttaaaaggtgtccagtgtgaggtgcagctgttggagtcgtgggggaggcgttggcacagccgtggggggtcccctgacgactctcctgtgtcgagcctcgnggtacttcctacctttagccaaccctagtcggcagtgagcggtcgggtcccggccgggtcgtcccggaggggaacgggggctgggaggtacgggtcctacgaacttagttcgagttggtagtcgctacaataaacacagtcggtacgacagtaccgttccggagggacgggggtcccgttacacccgatccgtcaagacgaactaaccgtccgaacggaacaccgtacgttatacctacttaaacaagtacgactacgtcgtaggaacgtacggaccggtaaaggacccgtaacgggttaccttaagttacgttaccgttggtaacggtaaaccgttaaacgggtttcccgaaacgtgggttaccggnggtacccgggtagaacccggggttagggtacgggttaacg

SEQ ID NO: 130897 - DNA, 563 bp, Homo sapiens
  misc_feature: GYAE6OF02G5VAX.35.20.B09.1.454.CMB.1.raw
  modified_base (237)..(237): a, c, t, g, unknown or other
  misc_feature (237)..(237): n is a, c, g, or t
  modified_base (523)..(523): a, c, t, g, unknown or other
  misc_feature (523)..(523): n is a, c, g, or t
  modified_base (531)..(563): a, c, t, g, unknown or other
  misc_feature (531)..(563): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatcctccagagacaattccaggaacacgctgtatctacaaatggacagtctgagagccgaggacacggccttatattactgtgacgaaagttcgaacaggtgctggcaacgngggtcggatatggactacgtggggccacgggaaccctggtaccaccgcccgtcctcacgccctacccaaccgaacgggcccctacgtccggttcccttcccccgtacggccaaccccctcctaccgaacgaccgccacccgttcggtcggggacaccggacgccgggtcccgttgggcctcggtcccgtcggtacgaacggtaccttaaccttaccgacgtacttcgttaccggtactacggtacgggccgggtcgtacggacgaaacgggtcctacgtaagtagncgactgcnnnnnnnnnnnnnnnnnnnnnnnnnnnnnnnnn

SEQ ID NO: 130898 - DNA, 556 bp, Homo sapiens
  misc_feature: GYAE6OF02FZZV2.35.20.B09.1.454.CMB.1.raw
  modified_base (250)..(250): a, c, t, g, unknown or other
  misc_feature (250)..(250): n is a, c, g, or t
  modified_base (521)..(521): a, c, t, g, unknown or other
  misc_feature (521)..(521): n is a, c, g, or t
  modified_base (523)..(556): a, c, t, g, unknown or other
  misc_feature (523)..(556): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatctccagagacaattccaggaacacgctgtatctaacaaatggacagtctgagagccgaggacacggtccttatattactgtgacgaaaagttcgaaacagtggctggcacgaggtcgggatangacctacgtgggcgacgggaccctggtcaccgcctcctcacgcctccaaccgaacggcccacgtccggtccttcccccgtcggacccaccccgtccctaccgaaacgacgaccacccgtcggtacgggggaccacgaaccggcccggtcccgtacgggccttcggaccccgttgggtaaccgaaacgggtacctacctttacccgaacgtacttacgtacgttacgtggaacgggtcgggcgtacgggacaacgggcctacgagtacgcancnnnnnnnnnnnnnnnnnnnnnnnnnnnnnnnnnn

SEQ ID NO: 130899 - DNA, 397 bp, Homo sapiens
  misc_feature: GYAE6OF02JBY58.35.20.B09.1.454.CMB.1.raw
  modified_base (364)..(397): a, c, t, g, unknown or other
  misc_feature (364)..(397): n is a, c, g, or t
tcagtacagatcgtcacgaccggtgctcgatttagtgtagtgtgaggggccggttcaccatctccagagacaattccaggaacacgctgtatctacaaatggacagtctgagagccgaggacacggccttatattactgtgcgaaagttcgaacagtggctggcacgaggtcgggatatgactacgtggggccagggaaccctggtcaccgcctcctcggcctccaccagggcccatcggtccttccccctggccaccctccaccaagacgccacctctgggggcacgagccggcctggctgcctggtcaaggactacttccacgatctgtactggagcgggctgggacaaggcgtcagtagcnnnnnnnnnnnnnnnnnnnnnnnnnnnnnnnnnn

SEQ ID NO: 130900 - DNA, 635 bp, Homo sapiens
  misc_feature: GYAE6OF02FISJV.35.20.B09.1.454.CMB.1.raw
  modified_base (152)..(152): a, c, t, g, unknown or other
  misc_feature (152)..(152): n is a, c, g, or t
  modified_base (171)..(171): a, c, t, g, unknown or other
  misc_feature (171)..(171): n is a, c, g, or t
  modified_base (174)..(175): a, c, t, g, unknown or other
  misc_feature (174)..(175): n is a, c, g, or t
  modified_base (177)..(177): a, c, t, g, unknown or other
  misc_feature (177)..(177): n is a, c, g, or t
  modified_base (179)..(181): a, c, t, g, unknown or other
  misc_feature (179)..(181): n is a, c, g, or t
  modified_base (183)..(184): a, c, t, g, unknown or other
  misc_feature (183)..(184): n is a, c, g, or t
  modified_base (191)..(191): a, c, t, g, unknown or other
  misc_feature (191)..(191): n is a, c, g, or t
  modified_base (194)..(194): a, c, t, g, unknown or other
  misc_feature (194)..(194): n is a, c, g, or t
  modified_base (200)..(201): a, c, t, g, unknown or other
  misc_feature (200)..(201): n is a, c, g, or t
  modified_base (204)..(204): a, c, t, g, unknown or other
  misc_feature (204)..(204): n is a, c, g, or t
  modified_base (209)..(209): a, c, t, g, unknown or other
  misc_feature (209)..(209): n is a, c, g, or t
  modified_base (211)..(211): a, c, t, g, unknown or other
  misc_feature (211)..(211): n is a, c, g, or t
  modified_base (213)..(213): a, c, t, g, unknown or other
  misc_feature (213)..(213): n is a, c, g, or t
  modified_base (218)..(218): a, c, t, g, unknown or other
  misc_feature (218)..(218): n is a, c, g, or t
  modified_base (221)..(221): a, c, t, g, unknown or other
  misc_feature (221)..(221): n is a, c, g, or t
  modified_base (228)..(228): a, c, t, g, unknown or other
  misc_feature (228)..(228): n is a, c, g, or t
  modified_base (231)..(231): a, c, t, g, unknown or other
  misc_feature (231)..(231): n is a, c, g, or t
  modified_base (237)..(237): a, c, t, g, unknown or other
  misc_feature (237)..(237): n is a, c, g, or t
  modified_base (246)..(246): a, c, t, g, unknown or other
  misc_feature (246)..(246): n is a, c, g, or t
  modified_base (250)..(250): a, c, t, g, unknown or other
  misc_feature (250)..(250): n is a, c, g, or t
  modified_base (335)..(335): a, c, t, g, unknown or other
  misc_feature (335)..(335): n is a, c, g, or t
  modified_base (607)..(607): a, c, t, g, unknown or other
  misc_feature (607)..(607): n is a, c, g, or t
tcagtacagatcgtcacgaccggtgctcgatttagtgtagtgtgaaggggagctctgagagaggagcccagccctgggattttcaggtgttttcatttggtgatcaggactgaacagagtagaactcaccatggagtttgggctggagcggntggtctaggcgcattaggnagnngngnnngnntgagtcnggngctgcnngcnggtcngncnctctngcngcatggntcngtagcncctagcagngtanggtcgtggtcgacgtcgtacgaccggtaggtccgttggaacgttgggtcctaacgtaacgttaacttcgaaggtcggttaacggnggttaccctacggaatttaaaccgggcgttttaacccaggtaaaccgttcggacccgtaaattccggtacgaacgggtccgttacggaactttccggtacctcgtagaccggattaacgtacggacgaacggctacgtacggtattccgggaaagtactaacggccggtaaagttcaacggttcttaacgcggtaccgggtaaactccgggtaccttacgttacgtacgtacgttcggtaacggttaccgtactaaccggtactcgggttanacccgtagacggtacggtacgttaacgg

SEQ ID NO: 130901 - DNA, 465 bp, Homo sapiens
  misc_feature: GYAE6OF02GY4VY.35.20.B09.1.454.CMB.1.raw
  modified_base (452)..(465): a, c, t, g, unknown or other
  misc_feature (452)..(465): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatctccagagacaattccaggaacacgctgtatctacaaatggacagtctgagagccgaggacacggccttatattactgtgcgaaagttcgaacagtggctggcacgaggtcgggatatgactactggggccagggaaccctggtcaccgcctcctcagcctccaccaacgggccccaagtccgtcttcccccctggccaccccttcctcccaaagacgccaccctcgtcgggggcaccgagccgggccctggggcctcggccctcgggtacaaggacctaccttccacgtactctgtactgagcgggctgggcaaggcgcatagnnnnnnnnnnnnnn

SEQ ID NO: 130902 - DNA, 755 bp, Homo sapiens
  misc_feature: GYAE6OF02FSLFL.35.20.B09.1.454.CMB.1.raw
tcagtacagatcgtcacgaccggtgctcgatttagtgtagtgtgaaggggagctctgagagaggagcccagccctgggattttcaggtgttttcatttggtgatcaggactgaacagagagaactcaccatggagtttgggctgagctggtctttttcttgtggtctaattttaaaaggtgtccagtgtgagtgcagcttgttggagtcgtgggggagtcgttggcacgacgtccggttggggggttcccctggacgaccttccgtccgtgtcgcgacgtccttccgtggtacttacctaccgttttaacgcctaaccgttagtcggacagttaggacgtcggttcggggtcccggcgggtcctaccggaggggggtaacgggtcgtacggggaggttcggggttacctacgaaaccgtttagttaggtagttaggttacgtcgtcgttaacaaacttaaaccgacgtagtacgggtaaccgcctaagtaccgtccgggtagggaccggggttcccgttaccaccgtactaccgtaccgaagaacgaacctaagttcccgaaaggtaaccacgtacttagtaacttaacgtaaactaaacgtacggaacgtaagttcgtacggaacgacgggtaccggaacgaccgtaacgggttaacctttaattacgttacgtacgggtagaaccggttaaaacgttccgaaacgttggtacggtacgtaccggtacggaaacgggttcgggaagggttaacg

SEQ ID NO: 130903 - DNA, 834 bp, Homo sapiens
  misc_feature: GYAE6OF02JK4N2.35.20.B09.1.454.CMB.1.raw
tcagtacagatcgtcacgaccggtgctcgatttagtgtagtgtgaaggggagctctgagagaggagcccagccctgggattttcaggtgttttcatttggtgatcaggactgaacagagagaactcaccagtggagtttgggctgagctggtctttttcgttgtggtcttaagtttttaaaaggtcgttccgagttggtgtaggtgcgagcgtggttggagtcgtgggggacgtcgttggcacgacggccggttcgggggtccctggaacggtacctccgttccgtggtcgacctacggtcccgttcgtaggtaccttaccgttaacccgttttaggaccctaacccgttgtcggaccttagtacggtaacgtccgggttaccggggtccccggtcccggggtacccgtccggaaaggggggtacgggtacggtcgggtagggtcgggttacgtaccgtaaacgttggttacgtaggttaggtaacgtcgtacttaaccgaaacgttaaaccgtaacgtggttaacgggtaacccgacgtaaacggtccgttacccgggtagggacccggggtttcccgtaaccaacgttccgttccgtaccggaagtaaccggtacttaaccgtcccgaaaagaccctacgtcgttaactaccgtaacgtaaactaacggtcgaaccgtataccggtagaacggtccgtaacgggacggtaaccctaaccggttacgttaacgttacgttaacgttaggtaaccggtaaacgttaaacgggttccaaacggtccggttgggtaccctaggggaccccgtaagggttacccgggagttaaaccg

SEQ ID NO: 130904 - DNA, 806 bp, Homo sapiens
  misc_feature: GYAE6OF02GCDKX.35.20.B09.1.454.CMB.1.raw
tcagtacagatcgtcacgaccggtgctcgatttagtgtagtgtgaaggggagctctgagagaggagcccagccctgggattttcaggtgttttcatttggtgatcaggactgaacagagagaactcaccatggagtttggctgagcgtgtcttttcttgtgctatttaaaaggtgtccagtgtgtagtgcagtctgttggagtcgtaggggagtcgttggcacgtacgtccgtagggggtcctaggacgtacttcgtccgtaggtacgccgtagtcccgttgtcggtattactaccgttttagacctaaccgtagtcgggaccttagtacggaacgtccggttccggggttaccccggtaccgggtccgtaccccgggtaagggggaacggggtaccgttacggggtacggtttaccggggttacctaaccggtaaacgttacgttaggacgtttaggtaacgtcgtacgttaccgtaaagttaaaccgtaacgtaacggttcgggtaaaccgtcgaaacgtaccgggttaccggtagggtaccgggggtaccctttaaccaccggttaactcccgttaaccgacgtaacgtaaccgtaacgttccgaaacgtaacgtaacccgtaggttaacgttactaacgttaaaccgtaagtacggtaacgtacgtacgtagaacgtacggtaccggaacggtaccgtacggtaaccgttaatacgttacggttacgtacggtaaacgttaaacgttaccggtaaacgtggtacgtacccggttaggtaccgacggttacggtcggtaaacg

SEQ ID NO: 130905 - DNA, 639 bp, Homo sapiens
  misc_feature: GYAE6OF02GSFYK.35.20.B09.1.454.CMB.1.raw
  modified_base (563)..(563): a, c, t, g, unknown or other
  misc_feature (563)..(563): n is a, c, g, or t
  modified_base (573)..(573): a, c, t, g, unknown or other
  misc_feature (573)..(573): n is a, c, g, or t
  modified_base (584)..(584): a, c, t, g, unknown or other
  misc_feature (584)..(584): n is a, c, g, or t
  modified_base (597)..(597): a, c, t, g, unknown or other
  misc_feature (597)..(597): n is a, c, g, or t
  modified_base (613)..(613): a, c, t, g, unknown or other
  misc_feature (613)..(613): n is a, c, g, or t
  modified_base (637)..(638): a, c, t, g, unknown or other
  misc_feature (637)..(638): n is a, c, g, or t
tcagtacagatcgtcacgaccggtgctcgatttagtgtagtgtgaaggggtcgttgggacgtgggtctccaacgtatttcgatggtagttgctcataacacatggtacgcagactccgtgaggggccggttcaccatctccagagacaattccaggaacacgcttgtatctacaaattggacagtctgagagccgaggacacggccttatagttactgtagcgaaagttcgaacagtgctggcaccgaggtcgggatagtgacgtacgtgggccagggtaaccccgtggttaccgaccgtcccgtaccttcacgaccgtcccgaacccaacgggaccccacgtccggttaccgttacccccttacggccgtaccccttccctcccgaacgtaacgctaaccttccgttacgggggcctaaccggaacgtccggtacccgttagggaccgttacggacccgttcggtaccgtaacgggaccgttaacgttcccgaacgtacgttcgttagtaccgtacgacggaccggtacgttacggaccgaaagggcgtacgtagtagtacngtacagtcancgtatgaccgngagctaagcgtanctgatagatcgtatgntctcgcgaatcagtccagctgacnnc

SEQ ID NO: 130906 - DNA, 842 bp, Homo sapiens
  misc_feature: GYAE6OF02FG7ZP.35.20.B09.1.454.CMB.1.raw
  modified_base (180)..(180): a, c, t, g, unknown or other
  misc_feature (180)..(180): n is a, c, g, or t
  modified_base (227)..(227): a, c, t, g, unknown or other
  misc_feature (227)..(227): n is a, c, g, or t
  modified_base (283)..(283): a, c, t, g, unknown or other
  misc_feature (283)..(283): n is a, c, g, or t
tcagtacagatcgtcacgaccggtgctcgatttagtgtagtgtgaaggggagctctgagagaggagcccagccctgggattttcaggtgttttcatttggtgatcaggactgaacagagagaactcaccatggagtttgggctgagctggtctttttcttgtggctaattttaaaaggtntccagtgtgaggtgcagtctgttggagtcgtgggggagcttggccanagccgtgggggtccctggacgactctcctgtgcagcctgtggattcctacgtttanacctaccgttagtggactagtcgtacgtcgtccgggtccggccgggcctaccggaagggggtaacgggtcgtagggtacggttacggggtacctacgtaacgttagttacggagttcggtacgttcgaccttacgaacgtaaaccgtacgtaacggtacgggtaaccgacgtaaccggtaccgtaccgggtacgggaccgggggttacccgtttaccaaacccgttaccggttccctaacccggaaagggttaaccgaaccttaaacttacccgggaaagttaacccgaccgtttaccgttaaggttaaaccttaaaccggtaaacgttaaaacggtccgggttaacctaaggttttacccggaggggtaaacctaccgggtaaacccgtacgggttaaacccgaccggttttaccgtttaaactttacccgggtttaacctagggggtttaaaccccggaatttaaaacccggggttaccccggaaaaggtttccgggttacccggacggtttaaccgggggaaccgtaacggggtttaccgggggtacctttaacgg

SEQ ID NO: 130907 - DNA, 729 bp, Homo sapiens
  misc_feature: GYAE6OF02GA5VP.35.20.B09.1.454.CMB.1.raw
  modified_base (589)..(589): a, c, t, g, unknown or other
  misc_feature (589)..(589): n is a, c, g, or t
tcagtacagatcgtcacgaccggtgctcgatttagtgtagtgtgaagggagctctgagagaggagcccagccctgggattttcaggtgttttcatttggtgatcaggactgaacagagagaactcaccatggagtttgggctgagcgtggtctttttcttgtggtcttattttaaaaggtgtctagtgtgaggtgcagtcgtgttggagtcgtgggggaggcgttggcacgacggtccggttcggggggtccctaggacgtaccttccttccgtggtcgcgtacgtcccttcgtacgggtactttcccgtaaccgttttacgacctacccttaagtcggacctaagtcggtaacggtccggtcgggggttcccccggcccggggtcccttaccgggaagggggtaaccggggtcggtacgggtacggttcggggtcctacgtaacgttagttcggtagttacggttagtcgactacgtaagtaacacgtagtcggtacgacgacgtaccgtccggtaggtacggggtccctttacacctaacgtccgtaccgaagtacgtactaaacgtccggaaacgtaacgaccgtnttacgtacttaacaacgtaagtcgacgtgtctaggacgtaggcgaacgaccgtacgacgttttaatagtttccggagtaggaaccttaaaggtcgaaaccgttgggtacgccgtaggacccggttaggaacggttgaacg

SEQ ID NO: 130908 - DNA, 572 bp, Homo sapiens
  misc_feature: GYAE6OF02JVN5Y.35.20.B09.1.454.CMB.1.raw
  modified_base (177)..(177): a, c, t, g, unknown or other
  misc_feature (177)..(177): n is a, c, g, or t
  modified_base (205)..(205): a, c, t, g, unknown or other
  misc_feature (205)..(205): n is a, c, g, or t
  modified_base (299)..(299): a, c, t, g, unknown or other
  misc_feature (299)..(299): n is a, c, g, or t
  modified_base (526)..(526): a, c, t, g, unknown or other
  misc_feature (526)..(526): n is a, c, g, or t
  modified_base (528)..(529): a, c, t, g, unknown or other
  misc_feature (528)..(529): n is a, c, g, or t
  modified_base (531)..(531): a, c, t, g, unknown or other
  misc_feature (531)..(531): n is a, c, g, or t
  modified_base (533)..(533): a, c, t, g, unknown or other
  misc_feature (533)..(533): n is a, c, g, or t
  modified_base (539)..(539): a, c, t, g, unknown or other
  misc_feature (539)..(539): n is a, c, g, or t
  modified_base (541)..(541): a, c, t, g, unknown or other
  misc_feature (541)..(541): n is a, c, g, or t
  modified_base (543)..(546): a, c, t, g, unknown or other
  misc_feature (543)..(546): n is a, c, g, or t
  modified_base (548)..(550): a, c, t, g, unknown or other
  misc_feature (548)..(550): n is a, c, g, or t
  modified_base (552)..(552): a, c, t, g, unknown or other
  misc_feature (552)..(552): n is a, c, g, or t
  modified_base (554)..(555): a, c, t, g, unknown or other
  misc_feature (554)..(555): n is a, c, g, or t
  modified_base (557)..(564): a, c, t, g, unknown or other
  misc_feature (557)..(564): n is a, c, g, or t
  modified_base (566)..(572): a, c, t, g, unknown or other
  misc_feature (566)..(572): n is a, c, g, or t
tcagtacagatcgtcacgaccggtgctcgatttagtgtagtgtgaaggggctggagtgggtctcaactattgatggtagtgctcatacacatggtacgcagactccgtgaggggccggttcaccatctcagagacaattccaggaacacgctgtatctacaaatggacagtctgagngccgaggacacggccttatattacgtgngacgaaagttcgaaacaggtggctggacacggaggggtcgggtataagtgaaccgtacgtcggggaccacgggtaccctggaccaccgcctccncgacgccctaccgacccgaacgggcccacgtcggtccctccccgtcggcccgacccctcctcccaaacggctacccgtaccgtccggtacggggaccacgacggcccgggcccgtggacccttcgacgttacgggacgtaacggtccgtacccttccgtacgtacttacgtcgtacgtcggtacgggtccgggtacgtcgggaccggtacggcgaccgtaagtgcancnncncngcgagngngnnnncnnngncnngnnnnnnnngnnnnnnn

SEQ ID NO: 130909 - DNA, 583 bp, Homo sapiens
  misc_feature: GYAE6OF02JO6OS.35.20.B09.1.454.CMB.1.raw
  modified_base (179)..(179): a, c, t, g, unknown or other
  misc_feature (179)..(179): n is a, c, g, or t
  modified_base (239)..(239): a, c, t, g, unknown or other
  misc_feature (239)..(239): n is a, c, g, or t
  modified_base (261)..(261): a, c, t, g, unknown or other
  misc_feature (261)..(261): n is a, c, g, or t
  modified_base (473)..(473): a, c, t, g, unknown or other
  misc_feature (473)..(473): n is a, c, g, or t
  modified_base (520)..(520): a, c, t, g, unknown or other
  misc_feature (520)..(520): n is a, c, g, or t
  modified_base (525)..(525): a, c, t, g, unknown or other
  misc_feature (525)..(525): n is a, c, g, or t
  modified_base (533)..(533): a, c, t, g, unknown or other
  misc_feature (533)..(533): n is a, c, g, or t
  modified_base (539)..(540): a, c, t, g, unknown or other
  misc_feature (539)..(540): n is a, c, g, or t
  modified_base (542)..(542): a, c, t, g, unknown or other
  misc_feature (542)..(542): n is a, c, g, or t
  modified_base (544)..(544): a, c, t, g, unknown or other
  misc_feature (544)..(544): n is a, c, g, or t
  modified_base (548)..(548): a, c, t, g, unknown or other
  misc_feature (548)..(548): n is a, c, g, or t
  modified_base (554)..(554): a, c, t, g, unknown or other
  misc_feature (554)..(554): n is a, c, g, or t
  modified_base (559)..(559): a, c, t, g, unknown or other
  misc_feature (559)..(559): n is a, c, g, or t
  modified_base (561)..(561): a, c, t, g, unknown or other
  misc_feature (561)..(561): n is a, c, g, or t
  modified_base (569)..(570): a, c, t, g, unknown or other
  misc_feature (569)..(570): n is a, c, g, or t
  modified_base (572)..(572): a, c, t, g, unknown or other
  misc_feature (572)..(572): n is a, c, g, or t
  modified_base (575)..(575): a, c, t, g, unknown or other
  misc_feature (575)..(575): n is a, c, g, or t
  modified_base (577)..(577): a, c, t, g, unknown or other
  misc_feature (577)..(577): n is a, c, g, or t
  modified_base (581)..(582): a, c, t, g, unknown or other
  misc_feature (581)..(582): n is a, c, g, or t
tcagtacagatcgtcacgaccggtgctcgatttagtgtagtgtgaaggggctggagtgggtctcaactattgatggtagtgctcataacacatggtacgcagactcgtgaggggccgttcaccatcctccagacgacaattccaggaacacgtctgtaatctaacaaatggactacgtntagagaagccggaggaccaacggcctttaagtattactggacgtacggaaattcgaaacnggttcggactggacctaacggnggttacggaatagtgaacccgtagtcgggggtccaacgggtaacccgtcggtaccgaacccggtcctccttcgacgcccttccgaaccgaacgggcccaacgttccggtccgttccccctggtccaccccgtcctaccaagacccgtaacctcggtacgggctcgacgtccgccgtcggactcggtctcggtacaacgtactcgtccacgtntcgtacgtacgtggtgcggtacgcggacaaggtcacagtatcgatgnacgtnagctagcncggtanngnancagngcgacncgacngnactgcgcnncnctncnctcnnc

SEQ ID NO: 130910 - DNA, 485 bp, Homo sapiens
  misc_feature: GYAE6OF02GP1QH.35.20.B09.1.454.CMB.1.raw
  modified_base (266)..(266): a, c, t, g, unknown or other
  misc_feature (266)..(266): n is a, c, g, or t
  modified_base (297)..(297): a, c, t, g, unknown or other
  misc_feature (297)..(297): n is a, c, g, or t
  modified_base (299)..(299): a, c, t, g, unknown or other
  misc_feature (299)..(299): n is a, c, g, or t
  modified_base (317)..(317): a, c, t, g, unknown or other
  misc_feature (317)..(317): n is a, c, g, or t
  modified_base (349)..(349): a, c, t, g, unknown or other
  misc_feature (349)..(349): n is a, c, g, or t
  modified_base (444)..(446): a, c, t, g, unknown or other
  misc_feature (444)..(446): n is a, c, g, or t
  modified_base (448)..(448): a, c, t, g, unknown or other
  misc_feature (448)..(448): n is a, c, g, or t
  modified_base (451)..(455): a, c, t, g, unknown or other
  misc_feature (451)..(455): n is a, c, g, or t
  modified_base (457)..(470): a, c, t, g, unknown or other
  misc_feature (457)..(470): n is a, c, g, or t
  modified_base (472)..(485): a, c, t, g, unknown or other
  misc_feature (472)..(485): n is a, c, g, or t
tcagtacagatcgtcacgaccggtgctcgatttagtgtagtgtgaaggggctggagtggggtctcaactattgatggtagtgctcataacacatggtacgcagactccgtgaggggccggttcaccatctccagagacattccaggaacacgctgtatctacaaatggacagtctgagacgccgaggacacgggtccttatacttactgtgacgtaaagttcgaaactggtggctggacacggtagggtcgggatatgaactacgngggccgacggtacctgtacctccgtcctccncncgcctccaccgacggccncgtccgtccctcccgcgcctcctccacacgcncacgtcgcggcacgcgccgtcgtgctcgcgtcgtacgaacgtactactccgatacgtcgtgtacgtcggcggcggtcgcggacgacgcgtacagnnnangtnnnnncnnnnnnnnnnnnnngnnnnnnnnnnnnnn

SEQ ID NO: 130911 - DNA, 665 bp, Homo sapiens
  misc_feature: GYAE6OF02GXO73.35.20.B09.1.454.CMB.1.raw
  modified_base (229)..(229): a, c, t, g, unknown or other
  misc_feature (229)..(229): n is a, c, g, or t
  modified_base (252)..(252): a, c, t, g, unknown or other
  misc_feature (252)..(252): n is a, c, g, or t
  modified_base (277)..(277): a, c, t, g, unknown or other
  misc_feature (277)..(277): n is a, c, g, or t
  modified_base (295)..(295): a, c, t, g, unknown or other
  misc_feature (295)..(295): n is a, c, g, or t
  modified_base (320)..(320): a, c, t, g, unknown or other
  misc_feature (320)..(320): n is a, c, g, or t
  modified_base (343)..(343): a, c, t, g, unknown or other
  misc_feature (343)..(343): n is a, c, g, or t
  modified_base (373)..(373): a, c, t, g, unknown or other
  misc_feature (373)..(373): n is a, c, g, or t
  modified_base (453)..(453): a, c, t, g, unknown or other
  misc_feature (453)..(453): n is a, c, g, or t
tcagtacagatcgtcacgaccggtgctcgatttagtgtagtgtgaaggggagctctgagagaggagcccagccctgggatttcaggttgttttcatttggtgaacaggactgaacagagagaagtcaccatggagttgggctggagtcgtggtcgttttcttggtggtctagtttaaaggtgtccagtgtgaggtgcagtctgtcggagtcgtgggaggcgtttggacncggcgtcgggggtccctggacgngtctcctgtcgcagcctcgtggtancctcgtgagtagcttagngtacagtcacgtcgtcggccgacgngttccgacgtaggggtcgggtcncgggtgtcgggtctcgttctagtacgtcgngtacggtggtcggtctccgtaacgtcgttacgtacgcgaacgtccgttcaacgggtaggtaccgggttcccggtttaccncccggtaccgtacgactacgtaaactaacgttaccgaaacgtaccctacgtacttagtccgtagaacctaaacgtgtaaccgtacggtaccgagacgtaccgacccggaacgacgtacccgacgtacgttcgttagtccgtaacggaaacgaagtaccgaaggttaacttacgtaaccgttctaaccgttgttaacggtacgtagtaaacgg

SEQ ID NO: 130912 - DNA, 617 bp, Homo sapiens
  misc_feature: GYAE6OF02IL0YK.35.20.B09.1.454.CMB.1.raw
  modified_base (313)..(313): a, c, t, g, unknown or other
  misc_feature (313)..(313): n is a, c, g, or t
  modified_base (559)..(559): a, c, t, g, unknown or other
  misc_feature (559)..(559): n is a, c, g, or t
  modified_base (564)..(564): a, c, t, g, unknown or other
  misc_feature (564)..(564): n is a, c, g, or t
  modified_base (566)..(566): a, c, t, g, unknown or other
  misc_feature (566)..(566): n is a, c, g, or t
  modified_base (571)..(573): a, c, t, g, unknown or other
  misc_feature (571)..(573): n is a, c, g, or t
  modified_base (577)..(577): a, c, t, g, unknown or other
  misc_feature (577)..(577): n is a, c, g, or t
  modified_base (579)..(579): a, c, t, g, unknown or other
  misc_feature (579)..(579): n is a, c, g, or t
  modified_base (584)..(584): a, c, t, g, unknown or other
  misc_feature (584)..(584): n is a, c, g, or t
  modified_base (587)..(587): a, c, t, g, unknown or other
  misc_feature (587)..(587): n is a, c, g, or t
  modified_base (589)..(589): a, c, t, g, unknown or other
  misc_feature (589)..(589): n is a, c, g, or t
  modified_base (593)..(593): a, c, t, g, unknown or other
  misc_feature (593)..(593): n is a, c, g, or t
  modified_base (609)..(610): a, c, t, g, unknown or other
  misc_feature (609)..(610): n is a, c, g, or t
  modified_base (612)..(612): a, c, t, g, unknown or other
  misc_feature (612)..(612): n is a, c, g, or t
  modified_base (614)..(614): a, c, t, g, unknown or other
  misc_feature (614)..(614): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatctccagagacaattccaggaacacgctgtatactacaaatggactagtctggagacgccgagacacggtcttatattactgtagacgtaaagttcgaacaggtcggctggacgacggtagggtcggatagtcgtacgtacgtggggaccgaacggggtacccgtgtaccgaccgtccctccgtacncgtcctacccaaccggaacgggccctacgttccggttcccgttccccgtcggaccctacccctcctaccgtaacgacgtacctaccgttcggtcggggcacgcggcccggtcccgtcgggtcgtccgtcggttacggacggtaaacggtaccgtttacctacccgacgtacgttacgttacggtaccgtggtacgggccggtcggtacggaccggtacggaccgacgtacgtaagctgctgatcgnacgtngnacgtnnngtcngngtctnacncncgcncacacgctgcgacacnncncngtc

SEQ ID NO: 130913 - DNA, 680 bp, Homo sapiens
  misc_feature: GYAE6OF02I61LA.35.20.B09.1.454.CMB.1.raw
tcagtacagatcgtcacgaccggtgctcgatttagtgtagtgtgaaggggagctctgagagaggagcccagccctgggattttcaggtgttttcatttggtgatcaggactgaacagagagaactcaccatggagtttgggctgagctggctttttcttgtggctaattttaaaaggtgtccagtgtgaggtgcagctgttggagtcgtgggggaggcttggcacagccgtgggggtccctgacgactctcctgtgcacgcctcgtggtacttcctaaccttttagcctaacctagtcggacattcggacgtcgttcggggtccccggccggggtctacccggagggggaacggggtcgtaggggaggttcgggtacctacgtaacttagttcgagttgggtaacgtgtacctacaataaccgactagtcggtaaccgcgacgtaccgtccgggtagggacggggtcccgtacacctatccgtcagacgaactaacttaccgaagtaaccacgtacgtgtactactacgaaagtcggaactcgtacaggtaacaccgggccggaacggaacccgtaccggtactttaagttacgttacgtacggtacggtaaaccggttaaacggttccgaaaggttacggtcggtacgtacggcccggaacggtacgggtacggtaacg

SEQ ID NO: 130914 - DNA, 591 bp, Homo sapiens
  misc_feature: GYAE6OF02HRWLA.35.20.B09.1.454.CMB.1.raw
  modified_base (175)..(175): a, c, t, g, unknown or other
  misc_feature (175)..(175): n is a, c, g, or t
  modified_base (204)..(204): a, c, t, g, unknown or other
  misc_feature (204)..(204): n is a, c, g, or t
  modified_base (206)..(206): a, c, t, g, unknown or other
  misc_feature (206)..(206): n is a, c, g, or t
  modified_base (222)..(222): a, c, t, g, unknown or other
  misc_feature (222)..(222): n is a, c, g, or t
  modified_base (549)..(549): a, c, t, g, unknown or other
  misc_feature (549)..(549): n is a, c, g, or t
  modified_base (551)..(551): a, c, t, g, unknown or other
  misc_feature (551)..(551): n is a, c, g, or t
  modified_base (553)..(556): a, c, t, g, unknown or other
  misc_feature (553)..(556): n is a, c, g, or t
  modified_base (558)..(563): a, c, t, g, unknown or other
  misc_feature (558)..(563): n is a, c, g, or t
  modified_base (565)..(565): a, c, t, g, unknown or other
  misc_feature (565)..(565): n is a, c, g, or t
  modified_base (568)..(576): a, c, t, g, unknown or other
  misc_feature (568)..(576): n is a, c, g, or t
  modified_base (578)..(591): a, c, t, g, unknown or other
  misc_feature (578)..(591): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatctcagagacaattccaggaacacgctgtatctaacaaatggacagtcngagacgccgaggcacggccttatattacngngacgaaagttcgaaanggtgcgtggacacggagggtcggatagtgaactcggtggggacccgacgggaacccgtcggtaccgtaccgccctcctaccacgtcccctaccaacccgaacgggtccccaacgttcccggttacccgtttccccccgtcggaccctaccccctccgtaacccaacgacgcccacccgttcggacgggggccaacgacggccccgggtacccgtgggtccgtcgtcccggtacggacgtaacgggtaacctaccttacccgacgtaccgtctacggtaccgtcggtaacgggcgggtccgtaggacgaacggtcgaccagtagacgngngnnnnannnnnncncgnnnnnnnnngnnnnnnnnnnnnnn

SEQ ID NO: 130915 - DNA, 607 bp, Homo sapiens
  misc_feature: GYAE6OF02FYZLU.35.20.B09.1.454.CMB.1.raw
  modified_base (225)..(225): a, c, t, g, unknown or other
  misc_feature (225)..(225): n is a, c, g, or t
  modified_base (385)..(385): a, c, t, g, unknown or other
  misc_feature (385)..(385): n is a, c, g, or t
  modified_base (429)..(429): a, c, t, g, unknown or other
  misc_feature (429)..(429): n is a, c, g, or t
  modified_base (490)..(490): a, c, t, g, unknown or other
  misc_feature (490)..(490): n is a, c, g, or t
tcagtacagatcgtcacgaccggtgctcgatttagtgtagtgtgaaggggagctctgagagaggagcccagccctgggattttcaggtgttttcatttggtgatcaggactgaacagagagaactcaccatggagtttgggctgagctggctttttcttgtggcttattttaaaaggtgtccagtgtgaggtgcagctgttggagtcgtgggggagcttggcacngccgtgggggtccctgagactctcctgtgcagcctctggattccacctttagccaccttatggctatgagcgtgggtcccgccgggctccgagggaagggctgggagtggtctacaacttattgagttaggtagtgacgtacaataaacatagtggtacncgaacgacctccggtaggacggggtccgttaccacctacgtccncgaagacgaactaacgtccaacggaacaccgtctagttaatacctaactaaagtccggaanacgttcaggacggacgccggaacgaaccggacgtaccgtttaatacgttactggttacaacggtaaacgttcggaaactagggtgccgtaggaccgtaacgggtagggtaccggtaa

SEQ ID NO: 130916 - DNA, 685 bp, Homo sapiens
  misc_feature: GYAE6OF02IQ8YH.35.20.B09.1.454.CMB.1.raw
  modified_base (148)..(148): a, c, t, g, unknown or other
  misc_feature (148)..(148): n is a, c, g, or t
  modified_base (160)..(160): a, c, t, g, unknown or other
  misc_feature (160)..(160): n is a, c, g, or t
  modified_base (167)..(167): a, c, t, g, unknown or other
  misc_feature (167)..(167): n is a, c, g, or t
  modified_base (182)..(182): a, c, t, g, unknown or other
  misc_feature (182)..(182): n is a, c, g, or t
  modified_base (215)..(215): a, c, t, g, unknown or other
  misc_feature (215)..(215): n is a, c, g, or t
  modified_base (607)..(607): a, c, t, g, unknown or other
  misc_feature (607)..(607): n is a, c, g, or t
  modified_base (619)..(619): a, c, t, g, unknown or other
  misc_feature (619)..(619): n is a, c, g, or t
  modified_base (629)..(629): a, c, t, g, unknown or other
  misc_feature (629)..(629): n is a, c, g, or t
  modified_base (638)..(638): a, c, t, g, unknown or other
  misc_feature (638)..(638): n is a, c, g, or t
  modified_base (645)..(645): a, c, t, g, unknown or other
  misc_feature (645)..(645): n is a, c, g, or t
  modified_base (654)..(654): a, c, t, g, unknown or other
  misc_feature (654)..(654): n is a, c, g, or t
tcagtacagatcgtcacgaccggtgctcgatttagtgtagtgtgaaggggctggagtgggtctcaactattgatggtagtgctcataacacatggtacgcagactccgtgaggggccggttcaccatctccagagacattccgagacncgctgtatctanaaatgantctgagagcgagacncggtccttatattctgtgacgtaagttcgaacnggtggctggacgacggtagggtacgggtatacgtcgtaacgtacggtcggggaccgaacgggtaccccgtgggtacccacccgtcccgttcctaccgccgtacccctacccgaacccggaaccggtcccctaacggttcccgggtttccccttcccccggtcggtacccctacccccgtacccttacccgaagacccgtaccttacccgtgggtccggggaccaacgaccggtacccgggtccgttcgggtccttaccggtccggtacggttaaccgaacggttaccttacccttaacccgacgttacgtcgttacgtaccggtggaccgggtccgggtacggtcgggaacggtacgggaccgtaccgtaagtgacggtccagtcgactcgngcgtagctagancgcgacgcgngtacgtacngcgcgtnacgtcgccncgtctcctgtacgacgtgacgagtcgactac

SEQ ID NO: 130917 - DNA, 782 bp, Homo sapiens
  misc_feature: GYAE6OF02HAZJB.35.20.B09.1.454.CMB.1.raw
  modified_base (512)..(512): a, c, t, g, unknown or other
  misc_feature (512)..(512): n is a, c, g, or t
tcagtacagatcgtcacgaccggtgctcgatttagtgtagtgtgaaggggagctctgagagaggagcccagccctgggattttcaggtgttttcatttggtgatcaggactgaacagagagaactcaccatggagtttgggctgagctggtctttttctgtggtctaattttaaaggtgtccagtgtgaggtgcagctggttggagtcgtgggggagcgttgggacaacgagtcccggttggggggtcccctaggacgtaccttccttcccgtggttacgaccacggtcccttacggtgggtaaccttttaccgtaacccgtttttaagaccgtaacccttaagtcggtacgattaggacgtccggtccggggttcccggccccggggtccttacccgggaggggtaacggggtcgtagggacggttcggggtaccctacgtaaacgttagttaggacgttacgggtagtacgtcccttagaactttaaaccacgtacgtacggggtaaccnccgtaaggaccttccgggagggtcggggtcccgtacgaccgtactccgtacgaagtacgaactaacttaccgaacggtaactccgtacttacggttaacaccttaaaccgaagttacggaccgttaacgtcgtacggaaggtccggaaccggcggtaaaccgaccggggttacttaagttaccgtttaggtaccggtgtaaaccgggttaaataccggtaaacgttggacggttacgaccgggttaccgacgggttacggggtacgtagg

SEQ ID NO: 130918 - DNA, 781 bp, Homo sapiens
  misc_feature: GYAE6OF02GWXDJ.35.20.B09.1.454.CMB.1.raw
  modified_base (196)..(196): a, c, t, g, unknown or other
  misc_feature (196)..(196): n is a, c, g, or t
  modified_base (201)..(201): a, c, t, g, unknown or other
  misc_feature (201)..(201): n is a, c, g, or t
  modified_base (223)..(223): a, c, t, g, unknown or other
  misc_feature (223)..(223): n is a, c, g, or t
  modified_base (255)..(255): a, c, t, g, unknown or other
  misc_feature (255)..(255): n is a, c, g, or t
tcagtacagatcgtcacgaccggtgctcgatttagtgtagtgtgaaggggagctctgagagaggagcccagccctgggattttcaggtgttttcatttggtgatcaggactgaacagagagaactcaccatggtaggtttgggctgagcgtggtcttttcgtaggtggtcttaagttttaaaggtgtccagtgtgngtgcngctagttggagtcgtagggggngtcttggcaacgcgtccgggtgggggttcccnggacgtacctcctcctgttcgcacgtcctgtgtatccgttaccttagcctaactgtcggctagacgtcgtcggttacggggcccgccgggttcaccgggtagggggacggtcgtggggtagtgggtctacgtaacgtgttcgaaggttcgtagtcgtacgttacgaagtaaaccctacgtaacgttcgggtaaccgagtaaccggttcggttacccggtagggggtaaccggggttccccgttaccgtaaccgtaacgttacccttacccggaacgtaaacggtaaccttacggttaacccggaacgggtaaaccttcggttcccggttaagttttaaaccgaccgtttaaaacgaacggttccgtaaccgtcggttacgtaaaggtaccgggaacgttaccggttacgggtacgtaaccggtttcctaagtttccgttacggtaggtacggtaaaaccgttaccgtaagaaccgggtttgaacgggtcgttaaccgggtcgaaccggggttaggtacgggttaac

SEQ ID NO: 130919 - DNA, 621 bp, Homo sapiens
  misc_feature: GYAE6OF02JIG8H.35.20.B09.1.454.CMB.1.raw
  modified_base (553)..(553): a, c, t, g, unknown or other
  misc_feature (553)..(553): n is a, c, g, or t
  modified_base (557)..(557): a, c, t, g, unknown or other
  misc_feature (557)..(557): n is a, c, g, or t
  modified_base (561)..(561): a, c, t, g, unknown or other
  misc_feature (561)..(561): n is a, c, g, or t
  modified_base (566)..(566): a, c, t, g, unknown or other
  misc_feature (566)..(566): n is a, c, g, or t
  modified_base (570)..(570): a, c, t, g, unknown or other
  misc_feature (570)..(570): n is a, c, g, or t
  modified_base (572)..(572): a, c, t, g, unknown or other
  misc_feature (572)..(572): n is a, c, g, or t
  modified_base (574)..(574): a, c, t, g, unknown or other
  misc_feature (574)..(574): n is a, c, g, or t
  modified_base (581)..(581): a, c, t, g, unknown or other
  misc_feature (581)..(581): n is a, c, g, or t
  modified_base (589)..(589): a, c, t, g, unknown or other
  misc_feature (589)..(589): n is a, c, g, or t
  modified_base (594)..(594): a, c, t, g, unknown or other
  misc_feature (594)..(594): n is a, c, g, or t
  modified_base (603)..(603): a, c, t, g, unknown or other
  misc_feature (603)..(603): n is a, c, g, or t
  modified_base (609)..(609): a, c, t, g, unknown or other
  misc_feature (609)..(609): n is a, c, g, or t
  modified_base (618)..(618): a, c, t, g, unknown or other
  misc_feature (618)..(618): n is a, c, g, or t
tcagtacagatcgtcacgaccggtgctcgatttagtgtagtgtgaaggggctggagtgggtctcaactattgatggtagtgctcataacacatggtacgcagactccgtgaggggccgttcaccatcctccaagagacaattccaggaacacgctgtatctacaaatggacagtctgagacgccgaggacacggtccttattatactggagacgtaaaagttcgaacaggtcggctggaccacggagggtacgggatagtacgacgtacgtcggggccgaacggggaccctcggcctaccgtcctcgtacacgtcctaccgaccgacgggccctcggtaccgttccgttaccccgcggccctaccccgtccgtaccgaaacgaccgtccaccgtcgggtcggggcaaccgaccggccgggtcccgtcggggtcctcggtaccggttacggtaccgtaaacggtccttaaccgttaccgacgttactcgttacgtaccgtacggtaccgggcgggtcgtacgggacgaacgggtctagaacgtagctcgtagcngacnactncgtancgtncncngcgcgcnctacacgncgcgngatactgtnacgcgngcgtcgtcntcg

SEQ ID NO: 130920 - DNA, 516 bp, Homo sapiens
  misc_feature: GYAE6OF01CDKJW.16.83.H06.1.454.CMB.1.raw
  modified_base (494)..(494): a, c, t, g, unknown or other
  misc_feature (494)..(494): n is a, c, g, or t
  modified_base (511)..(511): a, c, t, g, unknown or other
  misc_feature (511)..(511): n is a, c, g, or t
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggccccaggacagacggccagcataacctgtggggaaacggccttggacgtaaaagtgtgcactggtaccagcagaagccaggccaggcccctgtgctggtcgtctatgatgatagcgaccggccctgagggactccctgagcgattctctggctccaactcgtgggaacgcggccaccctgaccatcagcagggtcgaagccgggatgaggccgatatactgtcaggtgtgggatagtagtagtgatcattatgttcttggattcgtgggaccagggtcaccgtctaggtcagcccaaggcccacccntcgtcactctcttcccncctcc

SEQ ID NO: 130921 - DNA, 518 bp, Homo sapiens
  misc_feature: GYAE6OF01EESU0.16.83.H06.1.454.CMB.1.raw
  modified_base (354)..(354): a, c, t, g, unknown or other
  misc_feature (354)..(354): n is a, c, g, or t
  modified_base (493)..(493): a, c, t, g, unknown or other
  misc_feature (493)..(493): n is a, c, g, or t
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggccccaggacagacggccagcataacctgtggggaaacggccttggacgtaaaagtgtgcactggtaccagcagaagccaggccaggcccctgtgctggtcgtctatgatgatagcgaccggccctcagggatccctgagcgattctctggctccaactctgggaacncggccaccctgaccatcagcagggtcgaagccgggatgaggccgatattactgtcaggtgtgggatagtagtagtgatcattatgtcttcggatcgtgggaccagggtcaccgtctaggtcagcccaaggcccaacccntcgtcactctcgttcccgccctccg

SEQ ID NO: 130922 - DNA, 537 bp, Homo sapiens
  misc_feature: GYAE6OF01DDZG7.16.83.H06.1.454.CMB.1.raw
  modified_base (350)..(350): a, c, t, g, unknown or other
  misc_feature (350)..(350): n is a, c, g, or t
  modified_base (438)..(438): a, c, t, g, unknown or other
  misc_feature (438)..(438): n is a, c, g, or t
  modified_base (530)..(530): a, c, t, g, unknown or other
  misc_feature (530)..(530): n is a, c, g, or t
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggccccaggacagacggccagcataacctgtggggaaacgccttggacgtaaagtgtgcactggtaccagcagaagccaggccaggcccctgtgctggtcgtctatgatgatagcgaccggccctcgagggactcccgtgacgcgattctctggctccaactcgnggaacgcggccacctgaccatcagcgagggtcgaaggccgggatggagcgactattactgtcgaggtgtagggatagtagtagtgatntattatgtcttcggattcgtgggactagggtcctaccgtcgtaggtcacgacccaaggccccaaccccatcgtacctattcctcgttccccnccctccg

SEQ ID NO: 130923 - DNA, 655 bp, Homo sapiens
  misc_feature: GYAE6OF01BBIMA.16.83.H06.1.454.CMB.1.raw
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggccccaggacagacggccagcataacctgtggggaaacgccttggacgtaaaagtgtgcactggtaccagcagaagccaggccaggcccctgtgctggtcgtctatgatgatagcgaccgcctcagggactccctgagcgattctctcggctccaactcgtaggaacgcggccaccctcgaccatcacgcgacgggtacgaacggccggggatcggaacgggcccgaacgttacgttactggtacgagggtcggtaggggaattaggtagttaggtgtagttactaagtttagttggttaccgtttacgggacttcggtacggggtaacccgtaggggttaccctacccggttacccgtaacgggttcccgaacggtacccccgaaacgggtccccccaaaaccccccgtacgttccggttaccctaccctttacccgttaccgttcccccctacccccgttaccccgg

SEQ ID NO: 130924 - DNA, 545 bp, Homo sapiens
  misc_feature: GYAE6OF01C1DD8.16.83.H06.1.454.CMB.1.raw
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggcccccaggacagacggccagcataacctgtggggaaacgccttggacgtaaaagtgtgcactggtaccagcagaagccaggccaggcccctgtgctggtcgtctatgatgatagcgacccggccctcgagggatccctgagcgattctctggctccaactcgtgggaacgcggccaccctgaccatcagcagggtcaaggccggggatggacggccgacttattactgtcgagggtgtgggataggtagtagtgatcgatttatgtcttggatcgtagggaccagggtccaccggtcctaggtccagccccaaggccccaaccccatcgtcctactccttcgtttcccgccctacccg

SEQ ID NO: 130925 - DNA, 543 bp, Homo sapiens
  misc_feature: GYAE6OF01BNX3Y.16.83.H06.1.454.CMB.1.raw
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggccccaggacagacggccagcataacctgtggggaaacggccttggacgtaaaagtgtgcactggtaccagcagaagccaggccaggcccctgtgctggtcgtctatgatgatagcgaccggccctcagggactccctgagcgattctctggctccaactcgtgggaacgcggccaccctgaccatcagcgagggtcgaaggccggggatggaggccgatattactgtcagggtgtgggatagtagtagtgatcattatgtcgttcggattcgtgggaccgagggtccaccgtcctaggtcacgcccaacgggtccccaaaccccgtctcgtccactcctcgttccccgccctcccg

SEQ ID NO: 130926 - DNA, 809 bp, Homo sapiens
  misc_feature: GYAE6OF01CLP2Y.16.83.H06.1.454.CMB.1.raw
tcagtgtactactccacgaccggtgctcgatttagatcacgtgcgtcgcggggagtctgggcctaaggaagcagcacgtggtggtcgcctcacgccagtcggccgtcggtaccgttcctcctccgtccggccctcctctctcacgtgcacgaggctctgtcgacctcctatcgtcctgactcacgcccacccgtcggtcgtccggtccggaccccgaggacacggaccggccagactaactaccgtgggtacgggggaaacgtcgttaggaacgtaaagtgtcgactacgtcggtacagacaaggaacgccgacggccgaccggccctggtcgtcgtcggtctctagtgtagtgagtacggaccggacccggtcctacggacgggtacctcccgtagacgtcgtacttcgtcgtcgcctaccgaacgtcggtacgggaaccgccggacccaccgtacgacctacgtacgacggacggtacgggtaccgaaacggggtccgggtatacggggaaccggccgtaactttacgttacgttacggtacggtaggggttggtacgggtaagttaacgggttaaggttaggacgttaacgttacgttaaagttttacgttcggtttaccggttacgggtacttccggggttaacggggaccgttacggggtacccttacccgggttaccggtacgggtacccgaacccggtaacccccgggaaaccggtacccccctaaacccggttacgttacccgttaccgtaccccgtttacggtttccccccgttaacccccgtacccccggtttaaccgg

SEQ ID NO: 130927 - DNA, 508 bp, Homo sapiens
  misc_feature: GYAE6OF01B5SL1.16.83.H06.1.454.CMB.1.raw
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggccccaggacagacggccagcataacctgtggggaaacggccttggacgtaaaagtgtgcactggtaccagcagaagccaggccaggcccctgtgctggtcgtctatgatgatagcgaccggcctcagggatccctgagcgattctctggctccaactctgggaacgcggccactctgaccatcagcgggcccagactatggatgaggctgactattactgtcaggcgtgggacagcaattctgtgattttcggcggagggaccagttgaccgtctaggtcagcccaggctcgcccctcgtcactctgtcccgccctcctcg

SEQ ID NO: 130928 - DNA, 442 bp, Homo sapiens
  misc_feature: GYAE6OF01CBXG5.16.83.H06.1.454.CMB.1.raw
  modified_base (437)..(442): a, c, t, g, unknown or other
  misc_feature (437)..(442): n is a, c, g, or t
tcagtgtactactccacgaccggtgctcgatttagatcacgtgcgtcgcggggtccgtggccccaggacagacggccagcataacctgtgggggaaacggccttggacgtaaaagtgtgcactggtaccagcagaagccaggccaggcccctgtgctggtcgtctatgatgatagcgaccggccctcagggatccctgagcgattctctggctccaactctgggaacgcggccaccctgaccatcagcagggtcgaagccggggatgaggccgactattactgtcaggtgtgggatagtagtagtgatcattatgtcttcggatcgtgggaccagggtcaccgtcctaggtcagcccaaggcccaaccccactgtcactctcgttccccgccctcctcgagtacgtacactgagcgggctgggcaagggcgcatagnnnnnn

SEQ ID NO: 130929 - DNA, 694 bp, Homo sapiens
  misc_feature: GYAE6OF01B406A.16.83.H06.1.454.CMB.1.raw
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggccccaggacagacggccagcataacctgtggggaaacgccttggacgtaaaagtgtgcactggtaccagcagaagccaggccaggcccctgtgctggtcgtctatgatgataccgagccggccctgagggactcccgtgacgcgattccgccggcctaccgaactcgtggtcgaccgaccggcccaccctgaccatacgaacgacggggtacgaagggtcgggagtcggacggaccgtaacttaacgttacgtcggtacgtagggttcggtagggtagttgggttaggtttaggtaggtacggttcgggtacgttaccgggttttaccggggacgggtaaccggggtaccccgtaggtccgtaccggtacccggttaccggtaaccgggtcgaccggaccccggtaaacgggtcccgtaccccggtccccccggttcggtaccccgtaccgttcccgttcccggttacccccctaccccgtttcccgtaccggtacggttaacccgg

SEQ ID NO: 130930 - DNA, 436 bp, Homo sapiens
  misc_feature: GYAE6OF01AZK4Y.16.83.H06.1.454.CMB.1.raw
  modified_base (431)..(436): a, c, t, g, unknown or other
  misc_feature (431)..(436): n is a, c, g, or t
tcagtgtactactccacgaccggtgctcgatttagatcacgtgcgtcgcggggtccgtggccccaggacagacggccagcataacctgtgggggaaacggccttggacgtaaaagtgtgcactggtaccagcagaagccaggccaggcccctgtgctggtcgtctatgatgatagcgaccggccctcagggatccctgagcgattctctggctccaactctgggaacgcggccaccctgaccatcagcagggtcgaagccggggatgaggccgactattactgtcaggtgtgggatagtagtagtgatcattatgtcttcggatctgggaccagggtcacgtctaggtcagcccaaggcccaaccccatgtcactctcgttccccaccctcctcgagtacgtacactgagcgggctggcaaggcgcatagnnnnnn

SEQ ID NO: 130931 - DNA, 560 bp, Homo sapiens
  misc_feature: GYAE6OF01DXU3W.16.83.H06.1.454.CMB.1.raw
  modified_base (552)..(552): a, c, t, g, unknown or other
  misc_feature (552)..(552): n is a, c, g, or t
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagcccaccctcggtgtccgtggccccaggacagacggccagcataacctgtggggaaacggccttggacgtaaaagtgtgcactggtaccagcagaagccaggccaggcccctgtgctggtcgtctatgatgatagcgaccggccctcgagggactccctgagcgattctcgtgctccaactcgtagggaacgcggccaccctgacccatcagcgaagggtcgaaggccggggatcggaggacccgtattaagttactgtcgagggtgtgggataggtagtagtgatcaattatgttcgttcggattcgtgggaccaggggtccaccggtcgtacggtcacgacccaacggccccaaacccgctacgtccacttcctcgttccccncccttccg

SEQ ID NO: 130932 - DNA, 571 bp, Homo sapiens
  misc_feature: GYAE6OF01DXR22.16.83.H06.1.454.CMB.1.raw
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggccccaggacagacggccagcataacctgtgggggaaacgccttggacgtaaaagtgtgcactggtaccagcagaagccaggccaggcccctgtgctggtcgtctatgatgatagccgaccggccctcgagggactccctgagcgattctctggctccaactcgtcgggaacgcggcccacccgtgaccatcagcgacgggtcgaaggccggggatggacggccgactattactgtcgagggtgtgggatagtagtagtgatcaattatgttcgttggatcgtgggaccaggggtccaccggtccgtaggtccacgacccgaacggccccaaacccccgtcttacggtacctaccgttccttccggttcccccgtcccttacccg

SEQ ID NO: 130933 - DNA, 727 bp, Homo sapiens
  misc_feature: GYAE6OF01DUW4Y.16.83.H06.1.454.CMB.1.raw
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggccccaggacagacggccagcataacctggtaggggaaacgccttaggacgtaaaagtgtgcacgtggtaccagcagaacgccaggccacggcccctgtgctggtcgtctagtgatgatagccgaccggccctcgacgggactcccgtgacgtcgtattcctcgtcggcctaccaacgtcgtacgggaaccgccgggacccacccgtcgaaccctagtccgaacggcgtaacggggtacggaacgggcccgggggaagtcgggaacgggcccgtaacttaacgttaccgtggttaccggagggttgggtagggtaagttaagggtaacggttaggttagtacgttacgttaatttaacgttcggttacgtttacgggtaacgttcggtacgggggtaccgtacgggggttaccctacccgggttccgtaacgggttacccgaaccgggtaccccgaaaccggacccccctaaaccccccgtacgttccgtaaccgtaccctttcccgtacccggtttcccccctacccccggttaccccgg

SEQ ID NO: 130934 - DNA, 686 bp, Homo sapiens
  misc_feature: GYAE6OF01ATD6M.16.83.H06.1.454.CMB.1.raw
  modified_base (280)..(280): a, c, t, g, unknown or other
  misc_feature (280)..(280): n is a, c, g, or t
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtcggccccaggacagacggccagcataacctgtggggaaacgccttggacgtaaaagtgtgcactggtaccagcagaagccaggccaggcccctgngctggtcgtctatgatgatagccgacccggccctcgagggactcccgtgacgcgtattctctggcctaccaactcgtacggggaaccgtccggaccccacccgtcggaacccacgtccgacgaccggacgggggttaccggaaacgggcccgggggtaatcgggaaccgggtacccgtaaacgttagtttaaccgtggttaccgagggttggtagggtaattacggtaaggttagtagattactaagtttagttggttacgttacgggactttcggtacggggacccgtacgggtcccgtaccgttccgtaacgggtccgaaccggaccccgaaacgggcccccaaaccccgtacgttcccgtacctaccgttcccttacccggttcccccctaaccccgttcccg

SEQ ID NO: 130935 - DNA, 670 bp, Homo sapiens
  misc_feature: GYAE6OF01EU3WL.16.83.H06.1.454.CMB.1.raw
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggccccaggacagacggccagcataacctggtggggaaacgccttggacgtaaaagtgtgcactggtaccagcagagccaggccaggcccctgtgctggtcgtctatgatgatagcgaccggccctcgagggactcccgtgagcgtattctcgtcggcctaccgaactcgtacggggaaccgccggacccacccgtgacccagtccaaggccgaaggggtaccgaaacgggcccggggatagggacgggtacccggtaacttaacgttaacgtcggttaccgaggggttcggtagggtaagttaggttaaggtaggttagtatcgtaagtttagtggttacgttacgggtagttcgttcggggaacccgtaggggttcccacccgggttccgttacgggtaccgaccggaccccgaacgggtcccccaaacccccgtcgtacgtccctaccttacccgttcccgttacccccaccccgttacccg

SEQ ID NO: 130936 - DNA, 704 bp, Homo sapiens
  misc_feature: GYAE6OF01D1OA0.16.83.H06.1.454.CMB.1.raw
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtcggccccaggacagacggccagcataaccgtggtagggggaaacgccgttaggaacgtaaaagtgtgcacgtcggtaccaggcaagaacgccaggccacggccctgtcgctggtctctatgatgatacgccgaccggcctagacgggactcccgtgacgcgtattcctcgtcggcctaccgaacgttcggtacgggaaccgtccggaccctaccgtggaacccagtcgacggtcgacgggtacgaacgggccgggtatacgggacggcctaactacttacgtggtacgagggttgtagggtaagtaggtaggttacgtagtacttacgtaagtttagtcggttccgttacgggtacttccgggtacggggacccgtacggggttacccgtaccggtttacccggtaagggttacccgaaccgggtaccccgaaaccgggacccccctaaaccccgtcgttacccggtacccttacccgttacccgtttccccggttaacccccctacccgttacccggg

SEQ ID NO: 130937 - DNA, 867 bp, Homo sapiens
  misc_feature: GYAE6OF01ATZ0B.16.83.H06.1.454.CMB.1.raw
tcagtgtactactccacgaccggtgctcgatttagatcacgtgcgtcgcggggagtactgggcctaaggaagcagcactggtggtgcctcagccatggcctggaccgttctcctcctcggcctcctctctcactgcacaggctctgtgacctcctatgtcctgactcagcccacccgtcggtgtccgtggccccaggacagacggccagcataacctggtggggaacgccttggacgtaaaagtgtgcactggtaccagcagaagccaggccaggccctgtgctggtcgtctatgatggataggccggacccggccctacggagggacttccccgtaggagcgtaatttccgtcgtcggcctacccgtaacttcggtacggggaaccgccgggaccctaaccccgtacggaacccaagttacccgaacggacccggaacgggggttacccggaaacgggcccggggggtaaattacggggaaccgggtaccccggtaaacgtttaaaccgttttaaccggtacgggttacccggttaacggggggtttcgggttaacggggggtaaacggtttaaacgggtttaagggttaaacgggtttaccggtaaacgtttacccggttaaagtttttaaggtttcccgggtttaccgttttaaccggggtagtttacccgggttaacgggggtaacccggttaaccggggttacccgtaaccccgggtttacccgttaaaggggttaccccgtaaccgggtaacccccggtaaacgggtaccccccccgtaaaacccccgtcttacccgggttaaccctacccggtttaccccgttaccccggtttccccccgtaacccccggtttacccggg

SEQ ID NO: 130938 - DNA, 439 bp, Homo sapiens
  misc_feature: GYAE6OF01AE9Z4.16.83.H06.1.454.CMB.1.raw
  modified_base (398)..(398): a, c, t, g, unknown or other
  misc_feature (398)..(398): n is a, c, g, or t
  modified_base (432)..(432): a, c, t, g, unknown or other
  misc_feature (432)..(432): n is a, c, g, or t
  modified_base (436)..(439): a, c, t, g, unknown or other
  misc_feature (436)..(439): n is a, c, g, or t
tcagtgtactactccacgaccggtgctcgatttagatcacgtgcgtcgcggggtccgtggccccaggacagacggccagcataacctgtgggggaaacggccttggacgtaaaagtgtgcactggtaccagcagaagccaggccaggcccctgtgctggtcgtctatgatgatagcgaccggccctcagggatccctgagcgattctctggctcaactctgggaacgcggccaccctgaccatcagcagggtcgaagccggggatgaggccgactattactgtcaggtgtgggatagtagtagtgatcattatgtcttcggatctgggaccagggtcaccgtcctaggtccacgcccaaggcccaaccccactcgtcactctcgttccccaccctccncgagtacgtacactgagcgggctggacaagggcnatgnnnn

SEQ ID NO: 130939 - DNA, 637 bp, Homo sapiens
  misc_feature: GYAE6OF01B3QG0.16.83.H06.1.454.CMB.1.raw
  modified_base (622)..(622): a, c, t, g, unknown or other
  misc_feature (622)..(622): n is a, c, g, or t
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagcccaccctcggtgtccgtcggccccaggacagacggccagcataacctggtggggaaacgtccttggacgtaaaagtgtgcactggtaccagcaagaacgccaggccacggcccctggtcgctggtcgtctatgatgatcgccgaccggcctgagggactcccgtgacgcgtattctctcggcctaccaactcgtacgggaaccgccggacccaccccggacacgtccgaggcgacggggtcgaacgggccggggatcggacggccgtacttacgttactggtcgagggttggtagggtagttaggtagttaggtagattactatttagtcggttacgttcgggtattccggtacggggaccgtacgggtccacccggttcgtagggtcccgacgaccccgaacggaccccctaaccccgacgttcgtacctacccttcttacccgttcccccncccgttcccgtacgg

SEQ ID NO: 130940 - DNA, 576 bp, Homo sapiens
  misc_feature: GYAE6OF01AKCJ3.16.83.H06.1.454.CMB.1.raw
  modified_base (332)..(332): a, c, t, g, unknown or other
  misc_feature (332)..(332): n is a, c, g, or t
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggccccaggacagacggccagcataacctgtggggaaacgcttggaacgtaaagtgtgcactggtaccagcagaagccaggccaggcccctgtgctggtcgtctatgatgatagcgaccggccctgagggactccctgagcgattcnctggctccaactcgtgggaacgcggcccacctgacccatcagcgagggtcgaaggccgggatggacggtcccgattacttacgtgtacagggttgtgggatagtagtagtgatctaattatgttcgttcggattcgtagggaccgtacgggtccgaccgttccgtaggtccgacggacccgaacggcccctaaaccccgacgttcgtaccaccgttcccgtcgtttcccccaccccgttacccg

SEQ ID NO: 130941 - DNA, 450 bp, Homo sapiens
  misc_feature: GYAE6OF01CAQ6B.16.83.H06.1.454.CMB.1.raw
  modified_base (409)..(409): a, c, t, g, unknown or other
  misc_feature (409)..(409): n is a, c, g, or t
  modified_base (434)..(450): a, c, t, g, unknown or other
  misc_feature (434)..(450): n is a, c, g, or t
tcagtgtactactccacgaccggtgctcgatttagatcacgtgcgtcgcggggtccgtggccccaggacagacggccagcataacctgtgggggaaacggccttggacgtaaaagtgtgcactggtaccagcagaagccaggccaggcccctgtgctggtcgtctatgatgatagcgaccggccctcagggatcccctgagcgattctctggctccaactctgggaacgcggccaccctgaccatcagcagggtcgaagccggggatgaggccgactattacctgtcaggtgtgggatagtagtagtgatctattatgtcttcggatcgtggaccagggtcaccgtctaggtcagacccaaggcccaacccactgtccactctcgtccccgccctcctcgagtactacnctgagcggctggcaaggcgcatagnnnnnnnnnnnnnnnnn

SEQ ID NO: 130942 - DNA, 703 bp, Homo sapiens
  misc_feature: GYAE6OF01A94JO.16.83.H06.1.454.CMB.1.raw
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggccccaggacagacggccagcaataacctggtggggaaacgcttggaacgtaaaagtgtgcactggtaccagcagaagccaggccaggcccctgtgctggtcgtctatgatgatagccgaccggcctgagggactcccgtgacgctatttcgctcggctaccgaacgtcgtagggaaccgcggcccacctgaccgtatcgagccgagggtaccgaaggccggggatacgggacggaccgtaacgttacgttacgtcgttaccgagggttggttagggacttaaggttacggtacggtagtaacttacgtaagtttttagtacggtttacgtttaccgggtagttttacgggtaccggggtaccgtaacgggggttacccaacccgggttccgttaaaccgggttccgaacccgggtaccccgaaacccgggtacccccctaaaccccggtacgttaccgttacctaaaccccgtttccgtttaccccgtttacccccgtacccccgtttaaccccgg

SEQ ID NO: 130943 - DNA, 575 bp, Homo sapiens
  misc_feature: GYAE6OF01BC822.16.83.H06.1.454.CMB.1.raw
  modified_base (482)..(482): a, c, t, g, unknown or other
  misc_feature (482)..(482): n is a, c, g, or t
  modified_base (549)..(549): a, c, t, g, unknown or other
  misc_feature (549)..(549): n is a, c, g, or t
  modified_base (569)..(569): a, c, t, g, unknown or other
  misc_feature (569)..(569): n is a, c, g, or t
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggccccaggacagacggccagcataaccgtggtagggggaaacgccgttggacgtaaaagtgtgcactggtaccagcagaagccaggccaggcccctgtcgcgtggtcgtctatgatgatagcgaccggccctcgagggactccctgacgcgtattctctggctccaactcgtgggaaccgccggcccacccgtcgacccatcgacgcgacgggtacgacggcccggggagtcggacgggccgtaacgtattacgtgtacgtagggtggtagggtagtagtagtagtgatctagttntgtcgttacggattcgtagggaccgtagggtccaccgtccgtaggtcacgcccgaacgcccaacccnctcgtccactcctctccccncctccg

SEQ ID NO: 130944 - DNA, 804 bp, Homo sapiens
  misc_feature: GYAE6OF01BD9GJ.16.83.H06.1.454.CMB.1.raw
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtcggccccaggacagacggccagcataaccgtggtacggggaaacgccgttaggaacgtaaaagtgtgcacgtggtaccagcagaacgccgaggccacggcccctgtcgcgtggtcgtctatgatgatacgccgaccggcctcgacgggactcccgtagacgcgtacttctcgtcggacctacctaacgtcggtacggggaaccgcccggacccacccgtacgaaccctacgtaccgaacggaccggtaacggggtaccggaacggggcccggggggtaacgttacggggaaccgggtacccggttaaacgtttaacggtttaaccgttacgggttacccggtaagggggtttcgggttaaggggtaaagtttaacggggtttaaggtttaaggttagttaacgttaacgttaagttttaacgttaccggtttccgggtttacggtacggtttccgggttaccggggtaacccggtacggggtaccccgtaacccgggtttcccgtaacgggtacccgaccgggtaacccccgaaacccgggccccctaaacccccgtcgttaccggttacccaacccgtttcccgtttacccggttccccccgtcccgtttaaccccgg

SEQ ID NO: 130945 - DNA, 451 bp, Homo sapiens
  misc_feature: GYAE6OF01DFJQW.16.83.H06.1.454.CMB.1.raw
  modified_base (438)..(451): a, c, t, g, unknown or other
  misc_feature (438)..(451): n is a, c, g, or t
tcagtgtactactccacgaccggtgctcgatttagatcacgtgcgtcgcggggtccgtggccccaggacagacggccagcataacctgtgggggaaacggccttggacgtaaaagtgtgcactggtaccagcagaagccaggccaggcccctgtgctggtcgtctatgatgatagcgaccggccctcagggatccctgagcgattctctggctccaactctgggaacgcggccacctgaccatcagcagggtcgaagccggggatgaggccgactattactgtcaggtgtgggatagtagtagtgaatcattatgtcttcggatctgggaccagggtcaccgtcctaggtcacgccaaaggcccaacccatcgtcactctcgttccccacctcctgaagtacgtacactggacgtcgggctggacaaggctacatagnnnnnnnnnnnnnn

SEQ ID NO: 130946 - DNA, 820 bp, Homo sapiens
  misc_feature: GYAE6OF01AHRZS.16.83.H06.1.454.CMB.1.raw
  modified_base (296)..(296): a, c, t, g, unknown or other
  misc_feature (296)..(296): n is a, c, g, or t
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtcgtccgtcggcccccaggacagacggccagcatacctggtggggaacgcgttggacgtaaagtgtgcactggtaccagcagagccaggcccaggcccctggtgctggtcgtctatgngtagatacgccggacccggtccctacggacgggtacttccccgtagacggacgtaactttccgtcgtcggtacccgtaccgtaaaccgtcgggtacggggaacccggacccgggacccccgtaccccggtacggaacccctacgtaccggaacggaccggtaaccgggggtaccgggtaaacgggggccccgggggtaagtaccgggaacgggtaccccggtaaacgtttaaccgtttacccggtaggttacccggaggggttcggttaaggggtaacgtttaagggtacgtagggttagtaactaccgttaagtttacgttggtttaacccgtttacgggtacttccgggttaacgggtaccgtacggggtaccctacccggggttaccttaacggggtaccgaacccggtaccccgggaaaacccggtcccccgaaacccccgtttacctccgggttaacccctttacccgtttaacccccggttcccggttttcccccccggacccccgttttaccccggg

SEQ ID NO: 130947 - DNA, 670 bp, Homo sapiens
  misc_feature: GYAE6OF01CK5T2.16.83.H06.1.454.CMB.1.raw
  modified_base (345)..(345): a, c, t, g, unknown or other
  misc_feature (345)..(345): n is a, c, g, or t
  modified_base (491)..(491): a, c, t, g, unknown or other
  misc_feature (491)..(491): n is a, c, g, or t
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagcccacccgtcggtgtccgtcggccccaggacagacggccagcataacctggtagggggaaacgccttaggaacgtaaaagtgtgcactggtaccagcaagaacgccaggccacggcccctgtgcgtggtcgtctatgatgatacgccgaccgcctcgaggactcctgagcgtattcnctcggcctaccaactcggtacgggaaccgccggacccaccgtcgaccatcgagcgagggtacgaacgggccgggatcggacggtaccgtaattacgttacgtgtacgagggttggtagggtaagtaggttaggtagtagtaacttntaagtttagttcgttacgttacgggtactttcgggacgggtaaccgtacgggtacctaaccccggttccgtaggtacccgaaccggacccccgtaaaccggacccccctaaacccccgttagttcccggtaccctacccgtttcccgttccccgtttcccccccgtccccttacccggg

SEQ ID NO: 130948 - DNA, 641 bp, Homo sapiens
  misc_feature: GYAE6OF01CKEUO.16.83.H06.1.454.CMB.1.raw
  modified_base (433)..(433): a, c, t, g, unknown or other
  misc_feature (433)..(433): n is a, c, g, or t
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagcccaccctcggtgtccgtcggccccaggacagacggccagcataacctggtggggaaacgcgttggacgtaaaagtgtgcactggtacagacagaagccaggccacggccctgtgctggtcgtctatgatgatacgcgacccggccctcgagggactcccgtgacgcgtattcctcgtggcctccaaacgtcgtacgggaaccgcgacccaccctcgaccatcagcgagggtcgaacggcgggatcggacggccgatagttacgngtcgtagggtgtagggaattggtaagtaggtatatcgtaatttagtgttccgtttacggacgttcgtcggggaccacgggtccaacccggttcgtaacgggtccaacccggtacccgaaaccgggtccccaaaaccccccgttcgttaccgggttaccctaccggttacccctttcccgggtttccccccgcccccgtttacccccgg

SEQ ID NO: 130949 - DNA, 518 bp, Homo sapiens
  misc_feature: GYAE6OF01DK3XK.16.83.H06.1.454.CMB.1.raw
  modified_base (287)..(287): a, c, t, g, unknown or other
  misc_feature (287)..(287): n is a, c, g, or t
  modified_base (296)..(296): a, c, t, g, unknown or other
  misc_feature (296)..(296): n is a, c, g, or t
  modified_base (489)..(518): a, c, t, g, unknown or other
  misc_feature (489)..(518): n is a, c, g, or t
tcagtgtactactccacgaccggtgctcgatttagatcacgtgcgtcgcggggtccgtggccccaggacagacggccagcataacctgtgggggaaacggccttggacgtaaaagtgtgcactggtaccagcagaagccaggccaggcccctgtgctggtcgtctatgatgatagcgaccggccctcagggatcccctgagcgattctctggccttccaactcgtgggaaccgcggccaccctgacccatcagcagggtcgaaggccgggatgagccgactattacngtcaggtgnggatagtagtagtgatcattagtgtcttcggatcgtgggaccagggtccaccgttctaggtcacgacccgaacggacccaaccccactcgtccacgttcctccgttcccccgtccccttccgtacggtaacgttaacgtaacgtactcgggaacggccggggtacgtcgggaccgaaagggccgacagtacgnnnnnnnnnnnnnnnnnnnnnnnnnnnnnn

SEQ ID NO: 130950 - DNA, 557 bp, Homo sapiens
  misc_feature: GYAE6OF01CG6BH.16.83.H06.1.454.CMB.1.raw
  modified_base (158)..(158): a, c, t, g, unknown or other
  misc_feature (158)..(158): n is a, c, g, or t
  modified_base (249)..(249): a, c, t, g, unknown or other
  misc_feature (249)..(249): n is a, c, g, or t
  modified_base (526)..(557): a, c, t, g, unknown or other
  misc_feature (526)..(557): n is a, c, g, or t
tcagtgtactactccacgaccggtgctcgatttagatcacgtgcgtcgcggggtccgtggccccaggacagacggccagcataacctggtggggggaaacggccttggacgtaaaaagtgtgcactggtaccagcagaagccaggccaggcccctgtnctggtcgtctatgatgatagcgaccggccctcgagggactccctgagcgattctctggctccaactgtgggaaccgcgccaccctgaccancagcagggtcaaggccgggatggagccgactattactgtcaggggtgtaggggaataggtagtagtcgatctatttatgtcgttcggatcgtgggacctagggtccaaccgtcctagggtccacgacccgaaacggccccaaacccctatcgtacctaccttccgttacccgttacccccctacccgttcgtaaccgggtaagttacgtaaaccgtaccgtgggaaccggtccggggtccgtaggggacctaaacgggccgaccgaagttaaggcannnnnnnnnnnnnnnnnnnnnnnnnnnnnnnn

SEQ ID NO: 130951 - DNA, 607 bp, Homo sapiens
  misc_feature: GYAE6OF01DG6P4.16.83.H06.1.454.CMB.1.raw
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggccccaggacagacggccagcataacctggtagggggaaacgtccgttaggaacgtaaaagtgtgcactggtaccagcagaagccgaggccacggcccctgtgcgtggtcgtctatgagtgatacgcgacccggcctcgagggactcccgtgagcgtattctcgtcggtcctaccaactcgtacgggaaccgccggcccacctcgaccatcgagcgacgggtacgaacgggccgggatacggacggaccgaacgttagttacgtgtcgtagggtggtagggattaggtagtagtagtatctaattgtcgttcgtaggtacttcggtagggaccgacgggtcctaccgtccgtaggccgaaccgaccaaaccgaccccaacccgtcgtcgtacctacgtccttaccgtccccacccgttacg

SEQ ID NO: 130952 - DNA, 673 bp, Homo sapiens
  misc_feature: GYAE6OF01BWQF1.16.83.H06.1.454.CMB.1.raw
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagcccaccctcggtcgtccgtggcccccaggacagacggccagcataacctggtaggggaaacggccttaggacgtaaaagtgtgcacgtggacagcagaagccaggccacggcccctgtcgcgtggtcgttctatgatgatacggaccggacccggcctcgagggactcccgtgacgcgtattctcgtcggtcctaccaacgtcgacgggaccgccggacccacccgtcgaaccactcgacgcggtacggggtacgaacgggccggggagtacgggaacggtccgtacttaagttacgtgtacggtagggttgtagggtagtaggtagtagtgtatctaagttagttgttcgttacggacgttcggtacgggtaccgtagggtacccgtacccgttccggtaacgggtccgaacccggacccggaacccggtaacccccaaccccgtacgttacccgtcccgtaccctttcccgttacccgttccccccctaccccgttaccccgg

SEQ ID NO: 130953 - DNA, 509 bp, Homo sapiens
  misc_feature: GYAE6OF01DM2D1.16.83.H06.1.454.CMB.1.raw
  modified_base (293)..(293): a, c, t, g, unknown or other
  misc_feature (293)..(293): n is a, c, g, or t
  modified_base (388)..(388): a, c, t, g, unknown or other
  misc_feature (388)..(388): n is a, c, g, or t
  modified_base (467)..(467): a, c, t, g, unknown or other
  misc_feature (467)..(467): n is a, c, g, or t
  modified_base (470)..(470): a, c, t, g, unknown or other
  misc_feature (470)..(470): n is a, c, g, or t
  modified_base (472)..(472): a, c, t, g, unknown or other
  misc_feature (472)..(472): n is a, c, g, or t
  modified_base (476)..(477): a, c, t, g, unknown or other
  misc_feature (476)..(477): n is a, c, g, or t
  modified_base (482)..(509): a, c, t, g, unknown or other
  misc_feature (482)..(509): n is a, c, g, or t
tcagtgtactactccacgaccggtgctcgatttagatcacgtgcgtcgcgggggtccgtggccccaggacagacggccagcataacctgtgggggaaacggccttggacgtaaaagtgtgcactggtaccagcagaagccaggccaggcccctgtgctggtcgtctatgatgatagcgaccggccctcagggatccctgagcgattctctggcctccaactcgtagggaaccgccggccacccctgacccatcagcgagggtcgaaggccggggatggaggccgactattacngtcaggtgtgggataggtagtagtgactctattatgtcttcggattcgtgggaccagggtccaccgtctaggtcacgcccaaggcccaacccctntcgtaccacttctcgtccccacctctacgagttgtaccacgtggacgtcgggactgggaccaaagggtccactagtagnagntnacgnngatgnnnnnnnnnnnnnnnnnnnnnnnnnnnn

SEQ ID NO: 130954 - DNA, 761 bp, Homo sapiens
  misc_feature: GYAE6OF01DO31W.16.83.H06.1.454.CMB.1.raw
  modified_base (704)..(704): a, c, t, g, unknown or other
  misc_feature (704)..(704): n is a, c, g, or t
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtcgacctcctatcgtcctgacctcacgcccacccgtcggtcgtcccgtcggccccgaggacacggacggccagcaataccgtgggtacgggggaaacgccgttagggaacgttaaaggtgtcgactacgtacgggtaccaggacaaggaacgccgacggccacggtccctggtcgcgttacggtcgtctagtgagttagacgtacgccggtacccggtcccgtaggaccgggtactcccgtaggacgcgttacttccgtcgtccggaccttaccgaacgttcggacgggaaccgccggaccctaccgtacgacacgtcgacgtcgggacgggtacgaagggccgggtagtacggaccgggtaccttaacgttacgtacgtggtacggtgggttacgggtagggttaatacggttaaggtgttagacgttacgttagtttagacggtttaccgttgggtaacctccgggtaacgggacccgggttacgggttccctaacccggttacggtaacgggtcccgaaccggtaccccgaaccccgggtaccccccttaaacccncggttaccgttaccctccgttaccccgtccccggtttccccgtcccccggttaacgg

SEQ ID NO: 130955 - DNA, 649 bp, Homo sapiens
  misc_feature: GYAE6OF01EMIUR.16.83.H06.1.454.CMB.1.raw
  modified_base (284)..(284): a, c, t, g, unknown or other
  misc_feature (284)..(284): n is a, c, g, or t
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggcccccaggacagacggccagcataacctggtgggggaaacggccttggacgtaaaagtgtgcactggtaccagcagaacgccaggccaggcccctgngctggtcgtctatgatgataggccgaccggccctcgaggggatccccgtgacgcgtatttccgtctggtctcctaaactcgtcggggaaaccgccggcccaccctcggacccagtcaaggccgaacggggtccggaaggtcccgggggatacgggacgggcccgtacgttaactttacgtgggtcctaggggttggtagggaagttaaggtaggtaggttgaagttctagtttataggttcgtttacgggattcgtaggggaccctaggggtcacccggttccgttaaggtccgacgtaccccgaaacgggcccccaaaccccgtatcgttccacctccgttaccgttccccgcccgttaccccg

SEQ ID NO: 130956 - DNA, 737 bp, Homo sapiens
  misc_feature: GYAE6OF01BO0GC.16.83.H06.1.454.CMB.1.raw
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagcccaccctcggtgtccgtggccccaggacagacggccagcataaccgtggtgggggaaacgtccgttggaacgtaaaagtgtgcactggtaccagcagaacgccaggccacggcccctggtcgcgttggtcgtctatgatgatggccgaccggcctacgacgggtactcccgtagacgtcgtacttcgtcgtggcctaccgaacgtcgtagggaaccgccggccctacccgtcgacccatcgacgcggaacgggtccgaacgggccgggtaagtggaaccgggtccctaacgtttaacgttaccgtacggtcgtacggggttagggttagggtacttaagggttaagttacgttggaacttacggttaatttaggttcgttaccggtttacgggtacgttccgggtaggggaaccccgttagggggtaccctaacccgggtttccggtaacgggttacccggaacccggtaccccggtaaacgggtacccccctaaaccccgtagttacccgttacctaaccccggtttcccttacccccggtttcccccaaccccggttttaacccgg

SEQ ID NO: 130957 - DNA, 708 bp, Homo sapiens
  misc_feature: GYAE6OF01C6JJV.16.83.H06.1.454.CMB.1.raw
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtcgacctcctatcgtcctgactcacgcccaccctcggtgtccgtcggcccccaggacagaccggccagcataaccgtggtacgggggaacgccgttaggaacgtaaaagtgtgctacgtgtaccagcaagacgccgaggccacggcccctgtcgcgtggtcgtctagtgtacgtgaagtacgccggaacccggtccctacggaacgggtcctaccccgtggaacggtcgactttccgtcgtcggtacctacccgtaactccggtacggggaaccgcccggacccctacccgtacggacccacgtaccgacggacggtacggggtaacggaaccggggtccggggagtacgggaacgggacccgtaacgtttacgttaacgttcgtacggtagggtgggtacgggtaagttagggtagtttaggagtatacgttaattattcgttacggttgaggttccggtaagggacccgtagggttaccctacccggtcgtacggcccaacgggccccgaacggaccccacccgtgtcctactccgtcccttccgtccccgtcctacccgg

SEQ ID NO: 130958 - DNA, 766 bp, Homo sapiens
  misc_feature: GYAE6OF01B2157.16.83.H06.1.454.CMB.1.raw
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagcccaccctcggtgtccgtggcccccaggacagacggccagcataacctgtgggggaacgccttggacgtaaaagtgtgcactggtaccagcagaagccaggcccaggcccctgtgctggtcgtctatgatgataggcgacccggcctcagggactccccgtgacgcgattctctcggcctaccaactcgtggtagaccgaccggcccaccccgtgacccataccgaaacggaggggttacgtaacgggtcggggaatacgggacgggacccgtaacttaacgttaacttcgggtacgaggggttcgggtgggtagtttcgggttaggtttaggtggtacggttacccggggtccgtttaaccgggtttttccggggaccggggtaaccggggtaacccccgtagggtacccgttaccgggaaccccggtttcccggttaacggggttcccggaaccggtacccccggtaaacggggtcccccgttacccccgggtcccccccccgttacccggggttcccctaccccggttttaccccgttcccggttttaccccccccgtaccccccgtttccccgtaacccgggtttaaacccggg

SEQ ID NO: 130959 - DNA, 618 bp, Homo sapiens
  misc_feature: GYAE6OF01AWUDW.16.83.H06.1.454.CMB.1.raw
  modified_base (540)..(540): a, c, t, g, unknown or other
  misc_feature (540)..(540): n is a, c, g, or t
  modified_base (584)..(584): a, c, t, g, unknown or other
  misc_feature (584)..(584): n is a, c, g, or t
tcagtgtactactccacgaccggtgctcgatttagatcacgtgcgtcgcgggggagtctgggcctaaggaagcagcactggtggtgcctcagccatggcctggaccgttctcctcctcggcctcctctctcactgcacaggctctgtgacctcctatgtcctgactcagccaccctcggtgtccgtggccccaggaccagacggccagcataaccgtggtagggggaaacggccttaggacgtaaaagtgtgcacgtggtaccagcagaagccaggccacggcccctgtgcttggtcgtctatgatgatacggccgacccggccctcgaacgggactccccgtggacgcgtattctcgtcggccttacccaaacgtcgtacggggaacgcccggcccaccctcgacccatcgagcgagggtacggacgggccggggatcgggacgggtcccgtattaacgttacgtcggtcgagggtggtagggtattaaggtagtagtgatacgtatttatgttcttacgggtatcggtacgggaccgngggttccaccgtcgtaggtccacggcccgaacgccccaaccccnttcgacctcgtcctccgttccccgtccctcccgg

SEQ ID NO: 130960 - DNA, 730 bp, Homo sapiens
  misc_feature: GYAE6OF01CN81A.16.83.H06.1.454.CMB.1.raw
  modified_base (390)..(390): a, c, t, g, unknown or other
  misc_feature (390)..(390): n is a, c, g, or t
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtcgacctcctatcgtcctgactcacgcccacccgtcggtcgtccgtccggcccgaggaccagacggccagcagtaaccgtgggtacggggaaacgtccgttaggaacgttaaaagtgtcgactacgtacggtaccagacgaagaacgaccgacggccgacggccctggtcgtcgtggtcgtctatcgtagtgagtacggccggacccgtaccgtacggacgggtactccgtaggagcgtacttcncgtcgtacctaccgaacgtcggtaccgggaaccgccgtacccgacctacggacctacgtcgacggtaccggaagggtaccgggaacgggaccgggtagtaccgggacgggacccttaagtttacgtacggttaggacggtaaggggttgggtaaggttacgttaaggttaaggtacgtattattacgtttaacgtgttacggtaccgttaggacggttaccggcgggtacgtaccgggttaccgtacccggttacgacggaaccgtacccggaacccacccggtaccccaaccgtccgtacgtaccctacgttcccttacccgtaccccgtccctaccgg

SEQ ID NO: 130961 - DNA, 469 bp, Homo sapiens
  misc_feature: GYAE6OF01A171I.16.83.H06.1.454.CMB.1.raw
  modified_base (231)..(231): a, c, t, g, unknown or other
  misc_feature (231)..(231): n is a, c, g, or t
  modified_base (328)..(328): a, c, t, g, unknown or other
  misc_feature (328)..(328): n is a, c, g, or t
  modified_base (411)..(411): a, c, t, g, unknown or other
  misc_feature (411)..(411): n is a, c, g, or t
  modified_base (424)..(424): a, c, t, g, unknown or other
  misc_feature (424)..(424): n is a, c, g, or t
  modified_base (436)..(436): a, c, t, g, unknown or other
  misc_feature (436)..(436): n is a, c, g, or t
  modified_base (444)..(469): a, c, t, g, unknown or other
  misc_feature (444)..(469): n is a, c, g, or t
tcagtgtactactccacgaccggtgctcgatttagatcacgtgcgtcgcgggggtccgtggccccaggacagacggccagcataacctgtgggggaaacggccttggacgtaaaagtgtgcactggtaccagcagaagccaggccaggcccctgtgctggtcgtctatgatgatagcgaccggccctcgagggatccctgagcgattctctggctccaactcgtgggaacncggccaccctgaccatcagcagggtcgaagccggggatgagccgactattactgtcaggtgtggatagtagtagtgatctattatgtcgtcgatcgngggaccagggtccaccgtctagtcacgcccgaacgcccaacccgatcgtactactccgtcgtccccgcctctcgagtactacncgtgaggcggtcncggacgacgcgntacgtagnnnnnnnnnnnnnnnnnnnnnnnnnn

SEQ ID NO: 130962 - DNA, 770 bp, Homo sapiens
  misc_feature: GYAE6OF01EXU2T.16.83.H06.1.454.CMB.1.raw
tcagtgtactactccacgaccggtgctcgatttagatcacgtgcgtcgcggggagtctgggcctaaggaagcagcactggtggtgcctcagccatggcctggaccgttctcctcctccggcctcctctctcactgcacaggctctgtcgacctcctatgtcctgactcacgcccacccgtcggtcgtccgtcggccccaggacaggacggccagcataacctggtaggggaacgcttggacgtaaagtgtagcactggtaccagcagagccaggccacggcccctgtgctggtcgtctatgatgatacgccggacccggcccgtcgacgggtactccccgtagacgtcgtagttcctacgtcggcctaccgaacgtcgtacggggaacgccgggacccctaccccgtacgtacccgaacgtccgaaacgggtccgaacggggggttacccgggaaacggggtacccgggggtaacgttacggggacggtaccccggtaaacgtttaacgttaaccggttggtaccgggtagggttagggttggggtaagttaagggttaggttaggttagtacgttaacgttaagtttaagttcggttacgtttaccgggtattccgggtacgggaacccgttaacggggttacctaccccggttaccggtaacggttacccgaaccgggtaccccggaaccggaccccgtaaacccccgtacttaccgtacccgtacctttacccggtccccgtttacccccgtaccccgttaccccgg

SEQ ID NO: 130963 - DNA, 761 bp, Homo sapiens
  misc_feature: GYAE6OF01A769Q.16.83.H06.1.454.CMB.1.raw
tcagtgtactactccacgaccggtgctcgatttagatcacgtgcgtcgcggggagtctgggcctaaggaagcagcactggtggtgcctcagccagtggcctggaccgttctcctcctcggcctcctctctcactgcacaggctctgtcgacctcctatcgtcctgactcgacgccctacccgtcggtcgtaccggtcggccccaggacacggaccggccagcactaaccgtggtacgggggaaccgtccgttaggaacgtaaagtgtagctacgtacggtaccagcgacgaacgacgacggccgaggccccccccccccgtgtcgtcgtggtcgtctagtgacgtgtatacggaccggacccggtccgtacggtacgggtacgttcccgtacggtacggtaccgtacgtttccgtcgttacggtaccgtaccgtaaccgtcggtaccgggtaaccggcccggacccacccgtaccgaccgtacgaccgtacggaccggtaacgggtaccgggaacgggtaccgggtacgacggtaccggtaccgttacgtaacgttacgtaggtcggtaggtggtacggtagtagttagtagtacgtattacgttacgtagttcgttacggtacggtacgtacggtacggtacggtacgggtaccgtaccgttaccggtaccggtaccgacccgtacccgacccggtaccccgaacccgtaccgtacgtaccgtaccgttacccgttcccgttccccgtccccgttacccg

SEQ ID NO: 130964 - DNA, 449 bp, Homo sapiens
  misc_feature: GYAE6OF01BUCKH.16.83.H06.1.454.CMB.1.raw
  modified_base (229)..(229): a, c, t, g, unknown or other
  misc_feature (229)..(229): n is a, c, g, or t
  modified_base (307)..(307): a, c, t, g, unknown or other
  misc_feature (307)..(307): n is a, c, g, or t
  modified_base (373)..(373): a, c, t, g, unknown or other
  misc_feature (373)..(373): n is a, c, g, or t
  modified_base (429)..(429): a, c, t, g, unknown or other
  misc_feature (429)..(429): n is a, c, g, or t
  modified_base (435)..(449): a, c, t, g, unknown or other
  misc_feature (435)..(449): n is a, c, g, or t
tcagtgtactactccacgaccggtgctcgatttagatcacgtgcgtcgcggggtccgtggccccaggacagacggccagcataacctgtgggggaaacggccttggacgtaaaagtgtgcactggtaccagcagaagccaggccaggccccctgtgctggtcgtctatgatgatagcgaccggccctcagggatccctgagcgattctctggctccaactctgggaacnccggccaccctgaccatcagcagggtcgaagccggggatgaggccgactatactgtcaggtgtggatagtagtagtgnttcattatgttcttcggatcgtgggacctagggtcaccgttccaggtcacgcccaagcccaacccntctcactctcgtccccgctcctcgagtacgtacactgcggcggcgtggcaacggcntactgnnnnnnnnnnnnnnn

SEQ ID NO: 130965 - DNA, 743 bp, Homo sapiens
  misc_feature: GYAE6OF01B2WG9.16.83.H06.1.454.CMB.1.raw
  modified_base (609)..(609): a, c, t, g, unknown or other
  misc_feature (609)..(609): n is a, c, g, or t
  modified_base (703)..(703): a, c, t, g, unknown or other
  misc_feature (703)..(703): n is a, c, g, or t
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtcgacctcctatgtcctgacctcgacgcccacccgtcgggtcgtccggtccggcccgaggaccgacgaccggccagacaactaaccgtggtacgggggaacgtccgttagggaacgtaaaagtcgtagctacgtacggtaccaggacaaggaacgcccgacgggacccgacgggtcccctggtcgtccggttcgggtcgtactagttacggagtacggtaacgtaccggacccggtaccccgtacccgttaggaccgggtaccttacccgtaggacgtacgtactttccgtcgtccggtacctaccgtaaacgtcggtacgggaaccgcccggaccctaccgagtacctaccgacgacggacgggtaacgggaacggaacggggcggggtaatcgggaaccgggtccctaagtttaacggttacgtcggtaggtacgggtgggtaggaagttagtaggtagtanacgttcgtagttagttcggtacgttacgacgttccggacggtcggacggtcctaccgggtctacgggcaaccggacccgtaacacccccgaccngttccgtactccgttccggtcccgtccccgtccttaccgg

SEQ ID NO: 130966 - DNA, 831 bp, Homo sapiens
  misc_feature: GYAE6OF01CKI86.16.83.H06.1.454.CMB.1.raw
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtcgacctcctatgtcctgactcagccaccgtcggtgtccgtcggccccaggacaggacggcagcataaccgtggacggggaacgtcgttaggaacgtaaagtgtgcacgtaggtaccagacagaacgcacggccacggcccctgtcgctggtctctatgagtgacgtacgccgtacccggccctcggacggtacctcccgtaggacgaccgtatttaccgtcgtccggaccttaccccgtaaccgttacccgggtaaccggggtaacccgggacccggtaccccgaaccccgtacggtaaccccctagtacccggaacgggtacccgtaacgggggggtacccgggaaacccggggtaccggggtaacgtaaccggggaaccgggtaacccgtaaacgtttaaccgtttaaccggttcgtaccgggtacgggttgggtaagggtaacggttaaggttaaggttaggtacgtaacgtttagtaacgttttaacggttggttacccgtttacgggtacggttccgggttaacggggaccccggttaacgggtcccgttacccgggttaccgttaccgggaaccgtacccggtaaccccggaaccgggtacccccgaaacccccgtacgttcccgttaacccgtcccgttacccgtttcccggttcccccccgtcccgtttaccccggg

SEQ ID NO: 130967 - DNA, 709 bp, Homo sapiens
  misc_feature: GYAE6OF01ELW9N.16.83.H06.1.454.CMB.1.raw
  modified_base (425)..(425): a, c, t, g, unknown or other
  misc_feature (425)..(425): n is a, c, g, or t
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcacgcccaccctcggtcgtccggtcggccccaggacagacggccagcatacctggtggggaaacgccgttggaacgtaaagtgtagcacgtggtaccaggcaagacgccgacggaccacgggccccctggtcgccgttgggtcctactatgatgactacggccggacccggcccgtacgaacgggtcttcccgtaggacgtctaacttctcgttcgcctaccacgttcgtacgggaccgtcccggcccacccgtgacccnctacgagacggacggggtacgggaacgggccgggtagacgggacgtacccgtacttagttaccgtggtcggtagggtgggttaggtacgttaagggtagttagtagtacctagttagtttaattcggtttcgttacggacggtttacggaccggggaccgttccgggaccctacccggttaccgttaccggtaccgaccggtaacccccgaacggccccctaaccccgtacgtaccgtaccttacccgttccgtttaccccggtcccccgtccccgttaaccgg

SEQ ID NO: 130968 - DNA, 744 bp, Homo sapiens
  misc_feature: GYAE6OF01C2V8Y.16.83.H06.1.454.CMB.1.raw
  modified_base (342)..(342): a, c, t, g, unknown or other
  misc_feature (342)..(342): n is a, c, g, or t
  modified_base (358)..(358): a, c, t, g, unknown or other
  misc_feature (358)..(358): n is a, c, g, or t
  modified_base (557)..(557): a, c, t, g, unknown or other
  misc_feature (557)..(557): n is a, c, g, or t
  modified_base (578)..(578): a, c, t, g, unknown or other
  misc_feature (578)..(578): n is a, c, g, or t
tcagtgtactactccacgaccggtgctcgatttagatcacgtgcgtcgcgggggagtctgggcctaaggaagcagcactggtggtgcctcagccatggcctggaccgttctcctcctcggcctcctctctcactgcacaggctcctgtcgacctcctatcgtcctgactcacgcccacccgtcggtcgtccggtcggccccaggacacggacggccagcaactaaccgtgggtacgggggaaaccggtccgttaggaacgtaaagtgtagacacgtggaccagacacgaacgccgacggccgacggccccgtggtcgcgttcgggtcgttctagtgagtganacgccgacccggtccncggacggtacctccctggacgtacgtatttccgactttcggaccctacctaacgttccgggaaggaacccggccggaccctacccgtgaacctacgcgaacggcgacggggtacggaacgggccggggtagacgggaccgggactaactttaggttccgtaaggtcggtaggtagggtaggtagttaagttcggttagngtaacgttctaggttttaacncggtttacccgtggtaccgttaccgggtaccgggtacccgaacgggttttccgacccggtttaccgggtagtaccccgacggtaacccccgaacggaaccccctaaacccccgtgtttaccccaccttaccttaccgggttccccttccccccgtacgttacccgg

SEQ ID NO: 130969 - DNA, 812 bp, Homo sapiens
  misc_feature: GYAE6OF01CZAGM.16.83.H06.1.454.CMB.1.raw
  modified_base (154)..(154): a, c, t, g, unknown or other
  misc_feature (154)..(154): n is a, c, g, or t
  modified_base (737)..(737): a, c, t, g, unknown or other
  misc_feature (737)..(737): n is a, c, g, or t
  modified_base (750)..(750): a, c, t, g, unknown or other
  misc_feature (750)..(750): n is a, c, g, or t
  modified_base (760)..(760): a, c, t, g, unknown or other
  misc_feature (760)..(760): n is a, c, g, or t
  modified_base (772)..(772): a, c, t, g, unknown or other
  misc_feature (772)..(772): n is a, c, g, or t
  modified_base (781)..(781): a, c, t, g, unknown or other
  misc_feature (781)..(781): n is a, c, g, or t
  modified_base (787)..(787): a, c, t, g, unknown or other
  misc_feature (787)..(787): n is a, c, g, or t
  modified_base (792)..(793): a, c, t, g, unknown or other
  misc_feature (792)..(793): n is a, c, g, or t
  modified_base (802)..(802): a, c, t, g, unknown or other
  misc_feature (802)..(802): n is a, c, g, or t
tcagtgtactactccacgaccggtgctcgatttagatcacgtgcgtcgcgggtccgtggccccaggacagacggccagcataacctgtgggggaaacgccttggacgtaaaaagtgtgcactggtaccagcagaagccaggccaggcccctgtnctggtcgtctatgatgatacgccgacccggcccttacgagggtactcccgtggacgtcgtactttccgtcgtcggccctaccgtaacgtcggtacggggaaccgcccggaccctaacccttcgaccctaacgtccgagaccgggacggggtaccggaacggggcccgggggtatcgggaccggaccgttacctttaagttacccgttcggtacggtaaggggttcgggtagggtaacgttaaggttaaggtttaagggtcggtaaatttacccgttaagttttacgtttccggttacccggtttacgggtactttacccggggttaccggggtaacccggtaaccgggggttaccccttaacccggttcccggttaaacggccctaaaccgggtaccccccgaaacgggaacccccctaaacccccgtacgtttccgtaaacctcccgttccccgtttccccgggttaccccccgtccccgttacccgttaccggtacggttaaccgtacgtacccggggtcgtaacgggtcccgggtacggtaacggtacgggaccggtacgacgtaagttcggatcgtacntacgcagtcgacngggtaccatnggtaaattggancccttgacncgtgancctanntctgctgcngcgcgtcgtg

SEQ ID NO: 130970 - DNA, 665 bp, Homo sapiens
  misc_feature: GYAE6OF01EYCUP.16.83.H06.1.454.CMB.1.raw
  modified_base (520)..(520): a, c, t, g, unknown or other
  misc_feature (520)..(520): n is a, c, g, or t
  modified_base (618)..(618): a, c, t, g, unknown or other
  misc_feature (618)..(618): n is a, c, g, or t
tcagtgtactactccacgaccggtgctcgatttagatcacgtgcgtcgcggggagtctgggcctaaggaagcagcactggtggtgcctcagccatggcctggaccgttctcctcctccggcctcctctctcactgcacaggctctgtgacctcctatgtcctgactcagccctaccctcggtcgtccgtcggcccccaggaccagaccggccagacaataaccgtggtacgggggaaccggtccgttagggaacgtaaaagtgtacgcacgtcggtaccagcagacgccagccacggccctgcgctggtctctagtgatgagtacggccggacccggcccgtacggacggtactcccgtaggacgtcgttacttccgtcgtcggtccctaccgtaactcggtacgggacgcccggcccaaccgtcgaccagtcgacggacgtagggtaccgacgggtccgggatcggacggtacccgtattaacgtactggtacgtaggtgtaggtagtaggtagtagtntatagttatagttcgtacgttgacgttcggaggacccggttaggacccgtaccggttacggtacgccgtacccgaaccggtaacccgccctaaacccncgttacctacccgtaccgttccgttacccctaccctcccgtacccgg

SEQ ID NO: 130971 - DNA, 906 bp, Homo sapiens
  misc_feature: GYAE6OF01DJPR2.16.83.H06.1.454.CMB.1.raw
tcagtgtactactccacgaccggtgctcgatttagatcacgtgcgtcgcgggagtctgggcctaaggaagcagcactggtggtgcctcagccatggcctggaccgttctcctcctcggcctcctctctcactgcacgaggctctgtcgacctcctatgtccttgactcacgccctacccgtcggttcgtaccggtcggccccgaagggaccacggaccggccaggctaacgtaaccgtgggtacgggggaaaccggtccgttaggaacggtaaaagtgtcgacgtacgtcggtaaccaggacgaaggaacgaccggaacggtacccgaccggtcccccgttaggtcgtcggtcggttccgtactagttagtaacgtgtagaccggtaccggacccggtcccgtaggagggtacccttaccggagtacgacgtacttccgtcgtccgtccgttacccaacgttccggtaaccggggaccggcccggtaccctacccgtaccgaacgtacctacggacggtacggtaacggggaccgggtaacgggcccggggtaataccggggtaacggacccggtttaaacgtttaacgtttaccgggttacgttacgggtacgggtttgggtaagggttaaacggttagggtttaacggttaggttacgtaatttaccgttaaggttttacgtttaccgggtttacgttaccggtaggttacccgggttaccgggtaaccggtttacggggttacccctaaccccgggttaaccggtaccgggtaaccccggtaaaccggtacccccggtaaacccggtaacccccccgttaaaaccccgtcgggtttaaccccgtaccgtttacccccggtttacccgttttccccggccccccccgttaccctttaacccggg

SEQ ID NO: 130972 - DNA, 806 bp, Homo sapiens
  misc_feature: GYAE6OF01DVAIM.16.83.H06.1.454.CMB.1.raw
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgaccctcctatcgtcctgactcacgcccacccgttcggtcgtcccggtcggccccaggacacggaccggccagcaacgtaaccgtgggtacgggggaaaccgtcgttaggaaacgtaaagtcgtagctacgtcgaccagacaaggacgccgacggccacggtccctgcgtcgtcggttacgtctagcgtagtgacgtcggaccggaccccggtccctacggacgggtccttcccgtagacgtacgttacgtttctccggtacggacccttaccgaacgttccggtacggggacccgtcccggacccacccgtacgaacctacgtacgacgtacgggtacgggggtacggaccgggaccgggtagtacgggaccggtaccgttacgtttacgttacgtcgggtacgggtacggggttagggaacgggttagttaagggttacggttaggtagttaacctttagtagttttagtcgggtttaccggtaggttaccgggttacggttacggggtaaccgtaccgggtacccgttaacccggttcggtaaccggtaaccggaccccggtaaccccgtaaccggtacccccctaaacccggttgttccccgtaacgttcccccgttaacccgttccccccgttaaccccgtcccgttaacccggg

SEQ ID NO: 130973 - DNA, 764 bp, Homo sapiens
  misc_feature: GYAE6OF01BCH68.16.83.H06.1.454.CMB.1.raw
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctctatgtcctgactcacgcccaccctcggtcgtccgtcggcccaggacagacggccagcataaccgtggtaggggaaacgtccttaggaacgtaaaagtgtgcacgtggtacagcagaacgccgacggccacggccctgtgcgtggtcgtctagtgatagatacggccgacccggcctacgacgggtactcccgtgacgcgtactttactcgtcggtcctaaccgaacgtcggtacgggaaccgtccgggaccctaacccgtcgaaaccctacgtccggtaacgccgggtaacggggtaaccgtaaacggggcccggggtaaatacggggaaccggtaccgtaacgttaacgtttaaccgtggtacggtaggggtttcggtaacgggtaagttaggttaacgtagggttaagacgtttagttaacgttagtttcggttaccgttaagggtaccttacgggtacggggaacccttacggggtaaccttaaccccggttcgtaaacggggttaccacccgggtaacccgtaaacccggtacccctaaacccccgtagttccggtaccctacgtttaccccgttacccggttacccccgtacccggtttaaccccgg

SEQ ID NO: 130974 - DNA, 771 bp, Homo sapiens
  misc_feature: GYAE6OF01ERT9V.16.83.H06.1.454.CMB.1.raw
  modified_base (306)..(306): a, c, t, g, unknown or other
  misc_feature (306)..(306): n is a, c, g, or t
  modified_base (360)..(360): a, c, t, g, unknown or other
  misc_feature (360)..(360): n is a, c, g, or t
  modified_base (419)..(419): a, c, t, g, unknown or other
  misc_feature (419)..(419): n is a, c, g, or t
  modified_base (435)..(435): a, c, t, g, unknown or other
  misc_feature (435)..(435): n is a, c, g, or t
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacgacggctctggtctacctcctatcgtcctgacctacgacgccctaccggtcggtcggtccgtccggccccgaggaccacggaccggccagctaacgttaaccgtggggtacggggtaaaccgtcgtaggtaaacgtaaagtggtcactacggttacgaccgagacgaanacggaccgacggccgccgtaccctggtcgtcggttacggttcgtactagtacgntacggagtacgaccccggcctccgtagcgggtaccttcgagtacgcttacttcgtccgngtaccgtacctaacgngggtaccggaccgccccgtaccgtaccgaactaccgacgtacgacgggccgggtacggacgggaccgggacgggaccgtacgggtacggtaacccgttacgttaacgttaccggtacggttaggtacggggtagggttacggtaggttaggttaacggttaacggttgtaacgttacgtagtttacgttcggttaccggttagttccgttacgggtaccggacgttccgggtacgtaccggttaccgtacgaccgtaccgacccgaaccgtccccgtaaacccgtcgttacccgtacccgtacgttaccccgttcccgtcccgttcccgtaacccg

SEQ ID NO: 130975 - DNA, 835 bp, Homo sapiens
  misc_feature: GYAE6OF01DKHNR.16.83.H06.1.454.CMB.1.raw
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcacgccacccgtcggtcgtaccgtcggccccaggaccagaacggccaggccaataaccctggtacgggggaaacggtccgttaggaacgtaaaaagtgtagactacgttaggaccagcaaggaacgccgacgggccaacgggcccccttggtcgcgttcggtcgtctatgattagagtagccgaaccggccctacgagggactccccgtagacgcgtacttcgtctcggcctaccaacgttacgtcggggaaaccgccggaccctacccgtacgaacccacgtaccgaagaccggaacggggttaccggaaacgggtccccggggggtaataccggggtaaaccggaccccgttaaagtttaaccgtttaacggttacgggtacccgtaagggggtttcggtacggggttaataaacgggtttacggttaaggtacggtaacgtttaccgttaaagttaacgtttcgtttacggtttacggtacgtttaccggtaacggggaccccgttaggggttaacccctaacccggtttacccggtaaggggtacccctaaaccggggaaccccccaaaacgggtccccccctaaaaccccccggtcgttacccgttacccgaaacccgttttccccgtacccgggttttccccccccgcccgttttaacccccgg

SEQ ID NO: 130976 - DNA, 461 bp, Homo sapiens
  misc_feature: GYAE6OF01A1DUG.16.83.H06.1.454.CMB.1.raw
  modified_base (320)..(320): a, c, t, g, unknown or other
  misc_feature (320)..(320): n is a, c, g, or t
  modified_base (378)..(378): a, c, t, g, unknown or other
  misc_feature (378)..(378): n is a, c, g, or t
  modified_base (408)..(408): a, c, t, g, unknown or other
  misc_feature (408)..(408): n is a, c, g, or t
  modified_base (419)..(419): a, c, t, g, unknown or other
  misc_feature (419)..(419): n is a, c, g, or t
  modified_base (450)..(461): a, c, t, g, unknown or other
  misc_feature (450)..(461): n is a, c, g, or t
tcagtgtactactccacgaccggtgctcgatttagatcacgtgcgtcgcggggtccgtggccccaggacagacggccagcataacctgtgggggaaacggccttggacgtaaaagtgtgcactggtaccagcagaagccaggccaggcccctgtgctggtcgtctatgatgatagcgaccggccctcagggatccctgagcgattctctggctccaactctgggaaccgcggcccaccctgaccatcagcgagggtcgaaggccggggatgaggccgacttattactgtcaggtgtgggatagtagtagtgatcatttangtcttcgatcgtgggacagggtcaccgtcctaggtcacgcccgaaggcccaaaccccntcgtaccactctacgttccccgcccttccncgtatacgacnctgacggcgggctggacgaaggcacatacgnnnnnnnnnnnn

SEQ ID NO: 130977 - DNA, 842 bp, Homo sapiens
  misc_feature: GYAE6OF01A6KZB.16.83.H06.1.454.CMB.1.raw
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggtctctgtcgtacctcctatcgtcctgactcacgcccacccgtcgtcgtccgtcggcccgagacaggccggcacgctaactaccgtgggtacgggggtaaccggtccgttacgggtaaacgttaaaaggtcgtacgaccgtacgtacggtaccagacgaagaaccgaccgacggcccgaccggtccctggtcgtccggttcggttccgttactagtagaagtcggacgtccggcccgtacccggacccgacgacgggtacctcccgtaggtacgtaccgttacgttccgtacggtccgtacctaaccgtaccgtcgggacggacccgcccggaccctaccgacgacctacacgacggtacggaacggggtacggacgggaccgggtagtaccgggaccgtaccgtaacgtttacgttacgttaggtaacggtacgggtagggtaagggtaaccgttaggttaaccggttaggtactaacgtttagtttaacgtttacggttccggtttcgtttcggggtacgttaccgggggtacggtacccgggttacccggttacccggtacccggttacggtacccgggttacccggtaaccccgaacccggtaaccccggacccccgtaaaccccggttccgttaacccgttacccgtaccgtttaccccccgttccccgttaacccccggtttaccccgtaaaccggg

SEQ ID NO: 130978 - DNA, 785 bp, Homo sapiens
  misc_feature: GYAE6OF01C0913.16.83.H06.1.454.CMB.1.raw
  modified_base (763)..(763): a, c, t, g, unknown or other
  misc_feature (763)..(763): n is a, c, g, or t
tcagtgtactactccacgaccggtgctcgatttagatcacgtgcgtcgcggggatctgggcctaaggaagcagcactggtggtgcctcagccatggcctggaccgttctcctcctcggcctcctctctcactgcacaggctctgtcgacctcctatcgtcctgactcacgcccacccgtcggtcgtccggtcggccccaggacacggaccggccagctactaaccgtgggtacggggaacgtccgttaggaacgtaaagtgtcgctacgtggtaccagacgaagaacggccgacggccgaccggtcccgtgtcgtcgtggttctactagtacgagtacgtagacggcccggacccggtccgtacggacggtcctccggtagacgtcgtacttccgtcgtacgtcctaaccgtacgtcggtaccgggaaccgcccggtacccaccgtccgaaccgtcgtacgacggacggtacggggtacggaaccgggcgggactacgggaccgtaccgttaatttacgtacgtacggtacgggttgggtacgggttaggaacgttaagggtacggttagtaacgtctttaacgtttaacggtttcgttacggttttccggtaacggtacggttacgggttaacccggggaccggttaacgggtacccctaccgggttaccggtaacggtaccccgaacccggtaccccgtaaacccgtaacccctaacccggttctacccggtaccctttacccgtttacccgttacccccncccccgtttaacccgtaacggg

SEQ ID NO: 130979 - DNA, 546 bp, Homo sapiens
  misc_feature: GYAE6OF02I29BY.16.83.H06.1.454.CMB.1.raw
  modified_base (356)..(356): a, c, t, g, unknown or other
  misc_feature (356)..(356): n is a, c, g, or t
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggccccaggacagacggccagcataacctgtgggggaaacggccttggacgtaaaagtgtgcactggtaccagcagaagccaggccaggcccctgtgctggtcgtctatgatgatagcgaccggccctcagggactccctgagcgattctctggctccaactctgggaacncggccaccctgaccatcagcagggtcgaagccgggatggaggccgatattactgtcaggtgtgggataggtagtagtgatcattatgtcttcggattcgtgggacctagggtcaccggttcctaggtccaaggccccgaaagggccccaaccccgactcggtccaccttcttcgttccccacccttcccg

SEQ ID NO: 130980 - DNA, 519 bp, Homo sapiens
  misc_feature: GYAE6OF02HPAT1.16.83.H06.1.454.CMB.1.raw
  modified_base (355)..(355): a, c, t, g, unknown or other
  misc_feature (355)..(355): n is a, c, g, or t
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggccccaggacagacggccagcataacctgtgggggaaacggccttggacgtaaaagtgtgcactggtaccagcagaagccaggccaggcccctgtgctggtcgtctatgatgatagcgaccggccctcagggatccctgagcgattctctggctccaactctgggaacncggccaccctgaccatcagcagggtcgaagccggggatgaggccgactattactgtcaggtgttggatagtagtagtgatcattatgtcttcggatctgggaccagggtcacgtctaggtcagcccaagaccaaccccatcgtcacctctcgttcccacctccc

SEQ ID NO: 130981 - DNA, 433 bp, Homo sapiens
  misc_feature: GYAE6OF02IJ4IX.16.83.H06.1.454.CMB.1.raw
  modified_base (429)..(433): a, c, t, g, unknown or other
  misc_feature (429)..(433): n is a, c, g, or t
tcagtgtactactccacgaccggtgctcgatttagatcacgtgcgtcgcggggtccgtggccccaggacagacggccagcataacctgtgggggaaacggccttggacgtaaaagtgtgcactggtaccagcagaagccaggccaggcccctgtgctggtcgtctatgatgatagcgaccggccctcagggatccctgagcgattctctggctccaactctgggaacgcggccaccctgaccatcagcagggtcgaagccggggatgaggccgactattactgtcaggtgtgggatagtagtagtgatcattatgtcttcggatctgggaccagggtcaccgtcctaggtcagcccaaggccaaccccatgtcactctgttcccgccctcctcgagtagtacactgagcgggctggcaaggcgcatagnnnnn

SEQ ID NO: 130982 - DNA, 638 bp, Homo sapiens
  misc_feature: GYAE6OF02I9EP7.16.83.H06.1.454.CMB.1.raw
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtcggccccaggacagacggccagcataacctggtagggggaaacgccgttaggaacgtaaaagtgtgcactcggtaccagcaagaacgccaggccacggcccctgtgcgtggtcgtctatgatgagtacgccggacccggccctcgagggactcccgtgacgcgtattctcgtcggcctaccaactcgtaggggaaccgccggacccaccgtcgacccatccgagcgacggggtcgaacgggccggggatcggacggccgtacttagttacgtgtacgagggttggtagggtattaggtagtagtgatcgtatttatggttccgttcggtattcgtacgggaccgtacgggttaccgtacccgtccgttaggtccgaccggaacccgaacgggacccctaaaccccgtcgttacgtacctaccgttcgttacccgtttcccccggcccttaccg

SEQ ID NO: 130983 - DNA, 524 bp, Homo sapiens
  misc_feature: GYAE6OF02HTE9V.16.83.H06.1.454.CMB.1.raw
  modified_base (433)..(433): a, c, t, g, unknown or other
  misc_feature (433)..(433): n is a, c, g, or t
  modified_base (496)..(496): a, c, t, g, unknown or other
  misc_feature (496)..(496): n is a, c, g, or t
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggccccaggacagacggccagcataacctgtggggaaacgccttggacgtaaaagtgtgcactggtaccagcagaagccaggccaggccccctgtgctggtcgtctatgatgatagcgaccggccctcagggatccctgagcgattctctggctccaactcgtgggaacgcggccaccctgaccatcagcagggtcgaaggccggggatggaggccgatattactgtcaggtgtggatagtagtagtnatcatttatgtcttcggatcgtgggacagggtcaccgtctaggtcagcccaaggcccaacccngtcgtcacttctcgttccccgccttccg

SEQ ID NO: 130984 - DNA, 549 bp, Homo sapiens
  misc_feature: GYAE6OF02G5MAO.16.83.H06.1.454.CMB.1.raw
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggccccaggacagacggccagcataacctgtgggggaaacggccttggacgtaaaagtgtgcactggtaccagcagaagccaggccaggcccctgtgctggtcgtctatgatgatagcgaccggcctcgagggactccctgacgcgtattctcgtggcctccaactcgtgggaacgcggaccaccctgaccatcagcagggtcgaaggccgggatgatggccgactattactgtcaggttgtgggatagtagtagtgatctattatgttcttcggattcggtggacctagggtccaccgtccgtagggtccaacggcccaaggccccaaccccacgttcgtccacctctccgttccccgccccg

SEQ ID NO: 130985 - DNA, 542 bp, Homo sapiens
  misc_feature: GYAE6OF02I1CA1.16.83.H06.1.454.CMB.1.raw
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggccccaggacagacggccagcataacctgtgggggaaacggccttggacgtaaaagtgtgcactggtaccagcagaagccaggccaggcccctgtgctggtcgtctatgatgatagcgaccggccctcagggatccctgagcgattctctggctccaactctggaacgcggccacctgaccatcagcagggtcgaaggccggggatggaggccgactattactgtcaggtgtgggataggtagtagtgatcattagtgtcttcggattcgtgggacctagggtccacccgttctaggtccacggacccaaggcccaaccccactacgtccaccgttctccgttccccaccctcccg

SEQ ID NO: 130986 - DNA, 545 bp, Homo sapiens
  misc_feature: GYAE6OF02FO1MJ.16.83.H06.1.454.CMB.1.raw
  modified_base (411)..(411): a, c, t, g, unknown or other
  misc_feature (411)..(411): n is a, c, g, or t
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggccccaggaccagacggccagcataacctgtgggggaaacgccttggacgtaaaagtgtgcactggtaccagcagaagccaggccaggcccctgtgctggtcgtctatgatgatagcgaccggccctcagggatcccctgagcgattctctggctccaactctggggaacgcggccaccctgaccatcagcagggtcgaagccggggatggaggccgatattacngtcaggtgtgggattaggtagtagtgatcattatgtcttcggattcgtgggaccagggttccaccgtcctaggtccaggaccccaagggcccaaaccccgatcgtaccaccttctacgttccccacccttcccg

SEQ ID NO: 130987 - DNA, 597 bp, Homo sapiens
  misc_feature: GYAE6OF02H2VQH.16.83.H06.1.454.CMB.1.raw
  modified_base (449)..(449): a, c, t, g, unknown or other
  misc_feature (449)..(449): n is a, c, g, or t
  modified_base (557)..(557): a, c, t, g, unknown or other
  misc_feature (557)..(557): n is a, c, g, or t
tcagtgtactactccacgaccggtgctcgatttagatcacgtgcgtcggcggggagtctgggcctaaggaagcagcactggtggtgcctcagccatggcctggaccgttctcctcctcggcctcctctctcactgcacaggctctgtgacctcctatgtcctgactcacgccaccctcggtgtccgtggccccaggacagacggccagcataaccgtggtagggggaaacgccttggacgtaaaagtgtgcacgtggtaccagcagaagccaggccgaggcccctgtgctggtcgtctatgatgatagccgaccggccctcgagggactcccgtgacgcgtattcctcgtggcctacccaacgtcgtacgggaaccgtccggacccacccgtcgaccacgtccgagcgagggtcgaaggccggggatcggacggccgaacttattacgngtcgaggtgtaggtatagtagtagtgatctagttagtcgtcgttcggattcgtcgggactagggtccaccgtcgtacggtcgaacgtcccgaacggcccctaacccgngtccgtaccaccttccgttccgtaccccctaccgttcccg

SEQ ID NO: 130988 - DNA, 434 bp, Homo sapiens
  misc_feature: GYAE6OF02INM9P.16.83.H06.1.454.CMB.1.raw
  modified_base (430)..(434): a, c, t, g, unknown or other
  misc_feature (430)..(434): n is a, c, g, or t
tcagtgtactactccacgaccggtgctcgatttagatcacgtgcgtcgcggggtccgtggccccaggacagacggccagcataacctgtgggggaaacggccttggacgtaaaagtgtgcactggtaccagcagaagccaggccaggcccctgtgctggtcgtctatgatgatagcgaccggccctcagggatccctgagcgattctctggctccaactctgggaacgcggccaccctgaccatcagcagggtcgaagccggggatgaggccgactattactgtcaggtgtgggatagtagtagtgatcattatgtcttcggatctgggaccagggtcaccgtcctaggtcagcccaaggccaaccccactgtcactctgttcccaccctcctcgagtagtacactgagcgggctggcaaggcgcatagnnnnn

SEQ ID NO: 130989 - DNA, 529 bp, Homo sapiens
  misc_feature: GYAE6OF02G8CWP.16.83.H06.1.454.CMB.1.raw
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggccccaggacagacggccagcataacctgtgggggaaacggccttggacgtaaaagtgtgcactggtaccagcagaagccaggccaggcccctgtgctggtcgtctatgatgatagcgaccggccctcagggactccctgagcgattctctggctccaactctgggaacgcggccacctgaccatcagcagggtcgaaggccggggatggaggccgactattactgtcagggtgtgggatagtagtagtgatcatttatgtcttcggatcgtgggaccagggtcaccgtctaggtcacgcccaaggcccaacccactcgtcactcctcgttccccaccctccg

SEQ ID NO: 130990 - DNA, 535 bp, Homo sapiens
  misc_feature: GYAE6OF02I10LD.16.83.H06.1.454.CMB.1.raw
  modified_base (359)..(359): a, c, t, g, unknown or other
  misc_feature (359)..(359): n is a, c, g, or t
  modified_base (436)..(436): a, c, t, g, unknown or other
  misc_feature (436)..(436): n is a, c, g, or t
  modified_base (508)..(508): a, c, t, g, unknown or other
  misc_feature (508)..(508): n is a, c, g, or t
  modified_base (527)..(527): a, c, t, g, unknown or other
  misc_feature (527)..(527): n is a, c, g, or t
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggcccccaggacagacggccagcataacctgtgggggaaacggccttggacgtaaaagtgtgcactggtaccagcagaagccaggccaggcccctgtgctggtcgtctatgatgatagcgaccggccctcgagggactccctggagcgattctctggctccaactctgggaacncggccaccctgaccatcagcgagggtcgaaggccgggatggaggccatatactgtacaggtggtggatgtagtagtnatcattagtgttcgttcggattcgtgggaccagggtccaccgtcgtaggtcacgcccaaggccccaacccgntcgctactctacgttcccncccttccg

SEQ ID NO: 130991 - DNA, 548 bp, Homo sapiens
  misc_feature: GYAE6OF02GOBV2.16.83.H06.1.454.CMB.1.raw
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggccccaggacagacggccagcataacctgtgggggaaacggccttggacgtaaaagtgtgcactggtaccagcagaagccaggccaggcccctgtgctggtcgtctatgatgatagcgaccggccctcagggactccctgagcgattctctggctccaactcgtgggaacgcggccaccctgaccatcagcagggtcgaaggccggggatggaggccgactattactgtcaggtggtgggatagtagtagtgatcattatgtcttcggattcgtgggacctagggtccaccgttcgtacggtcgacgacccgaacggcccaaccccactcgtccaccgtcctacggttccccaccttacccg

SEQ ID NO: 130992 - DNA, 446 bp, Homo sapiens
  misc_feature: GYAE6OF02INP3F.16.83.H06.1.454.CMB.1.raw
  modified_base (369)..(369): a, c, t, g, unknown or other
  misc_feature (369)..(369): n is a, c, g, or t
  modified_base (426)..(426): a, c, t, g, unknown or other
  misc_feature (426)..(426): n is a, c, g, or t
  modified_base (432)..(446): a, c, t, g, unknown or other
  misc_feature (432)..(446): n is a, c, g, or t
tcagtgtactactccacgaccggtgctcgatttagatcacgtgcgtcgcgggggtccgtggccccaggacagacggccagcataacctgtgggggaaacggccttggacgtaaaagtgtgcactggtaccagcagaagccaggccaggcccctgtgctggtcgtctatgatgatagcgaccggccctcagggatccctgagcgattctctggctccaactctgggaacgcggccaccctgaccatcagcagggtcgaagccggggatgaggccgactattactgtcaggtgtgggatagtagtagtgatcattatgtcttcggatctgggaccagggtcaccgtctaggtcagcccaaggccaaccccntgtcactctcgttcccaccctcctcgagtacgtacactgagcgggctgggcaaggcncatagnnnnnnnnnnnnnnn

SEQ ID NO: 130993 - DNA, 559 bp, Homo sapiens
  misc_feature: GYAE6OF02GQRVM.16.83.H06.1.454.CMB.1.raw
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggccccaggacagacggccagcataacctgtgggggaaacgccttggacgtaaaagtgtgcactggtaccagcagaagccaggccaggcccctgtgctggtcgtctatgatgatagccgaccggccctcgagggactccctgagcgattctctggcctccaactcgtgggaacgcggccacccgtgaccatcagcgagggtcgaaggccggggatggacggccgaactacttacgtgtcgaggtggtgggataggtagtagtgatcattatgttcttcggattcgtgggaccgtagggtcaccgttcgtaggtcgacgacccaacggaccccaacccgtacgtcgtaccaccttccgtcgttccccaccctccg

SEQ ID NO: 130994 - DNA, 557 bp, Homo sapiens
  misc_feature: GYAE6OF02IZ2OG.16.83.H06.1.454.CMB.1.raw
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggccccaggacagacggccagcataacctgtggggaaacgccttggacgtaaaagtgtgcactggtaccagcagaagccaggccaggcccctgtgctggtcgtctatgatgatagcgaccggccctcgagggactcccgtgagcgattcctctcggcctccaactcgtagggaaccgcggccacccgtgaccatcagcagggtcgaaggccggggatggaggccgactattactgtcgaggtgtagggataggtagtagtgatctattagtgtcttggattcgtgggacctagggtccaccggttcctaggtccacggtcccgaaggccccaacccgatcggtccaccgtccttcgttcccccgcccttccg

SEQ ID NO: 130995 - DNA, 457 bp, Homo sapiens
  misc_feature: GYAE6OF02JX7E1.16.83.H06.1.454.CMB.1.raw
  modified_base (440)..(457): a, c, t, g, unknown or other
  misc_feature (440)..(457): n is a, c, g, or t
tcagtgtactactccacgaccggtgctcgatttagatcacgtgcgtcgcggggtccgtggccccaggacagacggccagcataacctgtgggggaaacggccttggacgtaaaagtgtgcactggtaccagcagaagccaggccaggcccctgtgctggtcgtctatgatgatagcgaccggccctcagggatccctgagcgattctctggctccaactctgggaacgcggccaccctgaccatcagcagggtcgaagccggggatggaggccgactattactgtcaggtgtgggatagtagtagtgatcattatgtcttggatcgtggaccagggtccaccgtcctaggtcacgcccaaggcccaacccacgtgtcactctcgttccccgccctctcgagtacgtacacgtggagcgggctgggacaaggcacagtagnnnnnnnnnnnnnnnnnn

SEQ ID NO: 130996 - DNA, 688 bp, Homo sapiens
  misc_feature: GYAE6OF02H5ZKR.16.83.H06.1.454.CMB.1.raw
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggccccaggacagacggccagcataacctgtagggggaaacgccttggacgtaaaagtgtgcacgtggtaccagcagaagccaggccacggcccctgtgctggtctctatgatgataggccgacccggccctcgacgggactcccgtaggacgcgtattcctcgtcggtcctacccaacgtcgtacggggaaccgccggacccaccctgaccatcagcgacgggtacgaaggccggggatcgggacggaccgtaacttagttacgtggtcgtagggttggtagggtattaaggtaggttagtaggtatacgtaagtttagttcgtttaccgttcgggacttcgggtacggggaaccgttaacggggttccctaacccgggtttaccgtaacgggtcccgaaccggaacccccgaaacggggtacccccaaacccccgtacgttaccggtaccctaacccgtttccccgtttaccggtttcccccccggacccctttaccccgg

SEQ ID NO: 130997 - DNA, 795 bp, Homo sapiens
  misc_feature: GYAE6OF02GRDUK.16.83.H06.1.454.CMB.1.raw
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagcccaccctcggtcgtccgtcggccccaggacagacggccagcataacctggtaggggaacgccgttggaacgtaaaagtgtgcacgtggtaccagcagaagccaggccacggcccctgtcgctggtcgtctatgatgatcgcgaccggcctcgagggactccctaggacgcgtattctcgtcggcctaccaacgtcgtacggggaaccgccggacccacccgtacgaacccacgtaccgacggaccggtaacggggtaccggaaacggggacccgggggtaatacggggaacgggtacccggtaacttaacgtttacccgtaggttaccgaaggggttacgggttaaggggtaacttaagggttaaacgggttaggttacgtaacgttaaccgttaatttaacggtttacggtttaccggtttacgggtaacgtttaccggggttaccggggtaaacccggttaccggggttaccctaaccccggggtttcccgttaacggggtacccgtaacccgggaaccccggtaaacccgggaccccccgtaaaacccccgttcgttacccggttacccgtacccgttttcccggttaccccggttttacccccctaaccccgtttacccggg

SEQ ID NO: 130998 - DNA, 552 bp, Homo sapiens
  misc_feature: GYAE6OF02G8O3I.16.83.H06.1.454.CMB.1.raw
  modified_base (520)..(520): a, c, t, g, unknown or other
  misc_feature (520)..(520): n is a, c, g, or t
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggccccaggacagacggccagcataacctgtgggggaaacggccttggacgtaaaagtgtgcactggtaccagcagaagccaggccaggcccctgtgctggtcgtctatgatgatagcgaccggccctcgagggactccctgagcgattctctggctccaactcgtgggaacgcggcccacctgaccatcagcgagggtcgaaggccggggatggacggcccgaacttagttactgtcgaggttggtgggataggtagtagtgatcatttagtgttcgttggatcgtgggaccagggtccaccgtcgtaggtcacggacccaaggcccaacccgntcgtaccacttcctcgttccccacccttcccg

SEQ ID NO: 130999 - DNA, 538 bp, Homo sapiens
  misc_feature: GYAE6OF02FGCXC.16.83.H06.1.454.CMB.1.raw
  modified_base (313)..(313): a, c, t, g, unknown or other
  misc_feature (313)..(313): n is a, c, g, or t
  modified_base (473)..(473): a, c, t, g, unknown or other
  misc_feature (473)..(473): n is a, c, g, or t
  modified_base (510)..(510): a, c, t, g, unknown or other
  misc_feature (510)..(510): n is a, c, g, or t
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggccccaggacagacggccagcataacctgtgggggaacggccttggacgtaaaagtgtgcactggtaccagcagaagccaggccaggcccctgtgctggtcgtctatgatgatagcgaccggccctnagggatccctgagcgattctctggctccaactctggggaacgcggccaccctgacccatcgagcaggggtcgaaggccggggatggacggccgtactattactggtcagggtgtgggattaggtagtagtgatctaattatgtcttggattcgtggaccngggtccaccgtcaggtcacgccaacggcccaaccccntcgtcaccgttctcgttccccgcctccg

SEQ ID NO: 131000 - DNA, 712 bp, Homo sapiens
  misc_feature: GYAE6OF02HNG5Q.16.83.H06.1.454.CMB.1.raw
  modified_base (330)..(330): a, c, t, g, unknown or other
  misc_feature (330)..(330): n is a, c, g, or t
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggccccaggacagacggccagcataacctggtagggggaaacgccttggacgtaaaagtgtgcactggtaccagcagaagccaggccacggcccctgtgctggtcgtctatgatgatagccgacccggcctcgagggactcccgngacgcgtacttctcgtcggtcctaccaactcgtggggaaccgccggccctacccgtacgaccctacgtccgacgacgtacggggtaccgaacgggcccgggggatcgggaacggacccgtaacgttacgttaccgtggtaccgtagggttcggtaggggtaacttagggttaaggttagtagtaagttacgtaagttttagttcggtttaccgtttacgggtactttccggtacgggggtaacccgtaacggggttcccgtacccggttaccggtaacgggttacccgaacccggaccccgaaacgggaccccctaaaccccgtacgttccggtacctacccgtttccggttacccggtttccccccgacccgtttacccgg

SEQ ID NO: 131001 - DNA, 526 bp, Homo sapiens
  misc_feature: GYAE6OF02FFP45.16.83.H06.1.454.CMB.1.raw
  modified_base (410)..(410): a, c, t, g, unknown or other
  misc_feature (410)..(410): n is a, c, g, or t
  modified_base (451)..(451): a, c, t, g, unknown or other
  misc_feature (451)..(451): n is a, c, g, or t
  modified_base (492)..(492): a, c, t, g, unknown or other
  misc_feature (492)..(492): n is a, c, g, or t
  modified_base (516)..(516): a, c, t, g, unknown or other
  misc_feature (516)..(516): n is a, c, g, or t
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggccccaggacagacggccagcataacctgtgggggaaacgccttggacgtaaaagtgtgcactggtaccagcagaagccaggccaggcccctgtgctggtcgtctatgatgatagcgaccgccctcagggatccctgagcgattctctggctccaactctggaacgcggccacctgaccatcagcagggtcgagcggggatgaggccatattactgtcaggtgnggatagtagtagtgatctatatgtcttaggattcgtggacngggtcaccgttcgaggtcaacgccctaaaggcccaacccgnttacgtcaccttgtccgttacccnccccttaccg

SEQ ID NO: 131002 - DNA, 643 bp, Homo sapiens
  misc_feature: GYAE6OF02HH27G.16.83.H06.1.454.CMB.1.raw
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggcccaggacagacggccagcataacctgtggggaaacggccttggacgtaaaagtgtgcactggtaccagcagaagccaggccaggcccctgtcgctggtcgtctatgatgatagcgaccggccctcgagggactcccgtgacgcgtattctcgtggcctccaactcgtacgggaacgccgccacccgtgacccatcacgcgagggtacgaaggcccggggatacggacggaccgtaacgttagttacgtggtacgtagggttcgggtagggtagttgggttaggttagtggtacgtcggggtccttaacggttttcggggacgggtaccgggacccgtacgtccgtacgacccgttcgtacgggtcacggacccgaaggtcccgtccgggcccccttccgggtacctacccgttccgttcccgttcccccggtccccgttccgtaccggtaaccgg

SEQ ID NO: 131003 - DNA, 461 bp, Homo sapiens
  misc_feature: GYAE6OF02HU00G.16.83.H06.1.454.CMB.1.raw
  modified_base (438)..(461): a, c, t, g, unknown or other
  misc_feature (438)..(461): n is a, c, g, or t
tcagtgtactactccacgaccggtgctcgatttagatcacgtgcgtcgcggggtccgtggccccaggacagacggccagcataacctgtgggggaaacggccttggacgtaaaagtgtgcactggtaccagcagaagccaggccaggcccctgtgctggtcgtctatgatgatagcgaccggccctcagggatccctgagcgattctctggctccaactctgggaacgcggccaccctgaccatcagcagggtcgaagccggggatgaggccgactatactgtcaggtgtgggatagtagtagtgatcattatgtcttcggatcgtgggaccagggtcaccgtcctaggtcagcccaaggcccaaccccactgtcactctcgttccccaccctcctcgagtagtaccactgagcgggctgggcaaaggcgcatacggnnnnnnnnnnnnnnnnnnnnnnnn

SEQ ID NO: 131004 - DNA, 619 bp, Homo sapiens
  misc_feature: GYAE6OF02HELX7.16.83.H06.1.454.CMB.1.raw
  modified_base (525)..(525): a, c, t, g, unknown or other
  misc_feature (525)..(525): n is a, c, g, or t
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagcccaccctcggtcgtccgtggccccaggacagacggccagcataacctggtaggggaacgccttaggacgtaaaagtgtgcacgtggtaccagcagaagccaggccaggcccctgtgctggtcgtctatgatgatagccgacccggccctcgagggactcccgtgacgcgtattctctggcctaccaactcgtcgggaacgcggacccacccgtcgaccacgtcacgcgtagggtacgaacgggtccggggatggacggaccgtaactagtttacgtcgtacgagggtggttggggattaggttaggtagtgtattactaattagtcgttcgttacggtacttcgtacgggtaccgngggttaccgtacccggtccgtaggtaccacgaccccgaacggaccctaccccgacgttcgtactaccttccgtccgttccccgtcccttacccg

SEQ ID NO: 131005 - DNA, 532 bp, Homo sapiens
  misc_feature: GYAE6OF02FTFRH.16.83.H06.1.454.CMB.1.raw
  modified_base (435)..(435): a, c, t, g, unknown or other
  misc_feature (435)..(435): n is a, c, g, or t
  modified_base (453)..(453): a, c, t, g, unknown or other
  misc_feature (453)..(453): n is a, c, g, or t
  modified_base (461)..(461): a, c, t, g, unknown or other
  misc_feature (461)..(461): n is a, c, g, or t
  modified_base (506)..(506): a, c, t, g, unknown or other
  misc_feature (506)..(506): n is a, c, g, or t
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggccccaggacagacggccagcataacctgtgggggaacgccttggacgtaaaagtgtgcactggtaccagcagaagccaggccaggcccctgtgctggtcgtctatgatgatagcgaccggccctcgagggatccctgagcgattctctggctccaactctagggacgcggccaccctgaccatcagcagggtcgagccggggatggaggccgactattactgtcaggtgtgggatagtagtagtgatnattatgtcttcgattcgngggaccgngggtaccaccgtccgtaggtcgcgacccgaacggcccaaccccgntcgtccactctcgttccccgcctccg

SEQ ID NO: 131006 - DNA, 439 bp, Homo sapiens
  misc_feature: GYAE6OF02F563F.16.83.H06.1.454.CMB.1.raw
  modified_base (283)..(283): a, c, t, g, unknown or other
  misc_feature (283)..(283): n is a, c, g, or t
  modified_base (427)..(427): a, c, t, g, unknown or other
  misc_feature (427)..(427): n is a, c, g, or t
  modified_base (431)..(439): a, c, t, g, unknown or other
  misc_feature (431)..(439): n is a, c, g, or t
tcagtgtactactccacgaccggtgctcgatttagatcacgtgcgtcgcggggtccgtggccccaggacagacggccagcataacctgtgggggaaacggccttggacgtaaaagtgtgcactggtaccagcagaagccaggccaggcccctgtgctggtcgtctatgatgatagcgaccggccctcagggatccctgagcgattctctggctccaactctgggaacgcggccaccctgacccatcagcagggtcgaagccggggatgaggccgactattacngtcaggtgtgggatagtagtagtgatcattatgtcttcggatctgggaccagggtcaccgtctaggtcacgcccaaggcccaaccccatcgtcactctcgttccccaccctctcgatagtacactgagcgggctggcaaggcgnatgnnnnnnnnn

SEQ ID NO: 131007 - DNA, 771 bp, Homo sapiens
  misc_feature: GYAE6OF02JPYSZ.16.83.H06.1.454.CMB.1.raw
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagcccaccctcggtgtcccgtcggcccccaggacaggacggccagcaactaaccgtggtacggggaaacgccgttaggaacgtaaaagtgtgcactaggtaccagcagacgccaggccacggcccctgcgcgtggtcgtactagtgatgactagccgacccggcctacgacggactcccgtagacgcgtacttccgtcgtcggtacctaccctaaccgttcggtacgggaacccgccgggacccctaacccgtacgaaccctacgtaccggaccggtaccgggtaacggggtaccggaaccggggtacccggggtagtaacgggacccgggtacccggtaacgtttaacgttaccggttacggttaaccggtacgggggttaggttaccggggtaaagttaacggttaagggttaagggttcgaagtttacgttagtttaccggttggtttaccgttcgggttacgttcgggttaccgggaccggtaccggtccgtacccggttacggtacggtaccgacccggtaacccgaaccggtaccccgtaacccctagttcccggttaacctacccgttcccgtttacccgttacccctaccccgtacg

SEQ ID NO: 131008 - DNA, 577 bp, Homo sapiens
  misc_feature: GYAE6OF02GHOP1.16.83.H06.1.454.CMB.1.raw
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggccccaggacagacggccagcataacctggtgggggaaacggccttggacgtaaaagtgtgcactggtaccagcagagccaggccaggcccctgtgctggtcgtctatgatgatagcgaccggccctcgagggtactccctgagcgattctctggcctccaactcgtagggaacgcggcccacccgtgaccatcagcgagggtcgaaggccgggatggacggccgactacgttactgtcgagggttggtagggtattaggtagtagtgatcattatggtcttcggattcgtacgggaccgtagggtcccacgttccgtaggtccgaacggcccgaacgggtacccctaaccccgacgtcgtccaccttccgtccgttccccacccttcccg

SEQ ID NO: 131009 - DNA, 705 bp, Homo sapiens
  misc_feature: GYAE6OF02H2D1L.16.83.H06.1.454.CMB.1.raw
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatcgtcctgactcagcccaccctcggtcgtcccgtcggcccccaggaccagaccgggccagaccattaaacccgtggtacgggggaaaccggtccgttggaacgtaaaagtgtcgctacgtggtaccagcagaacgccgaggccacggcccctgtgcgtggtccgtctagtgatgagtacggcgaccccggtccctacgacgggactccccgtggacggtcgtacttcctccgtggtcctacccaacgttccggtacggggtaaccgcccggaccctacccgtcgaacccagtccgaaggaccgacggggtacccggaagggcccggggtaatcgggacggacccgtacttaacgtcgtaggtaccgtagggtcggtagggattaggtaagtacgtgacttcaatttgtacgtacgtttacggagttccggacgggaacccggttaggtaccgtcccgttacggtcggtaccgtaacggccccggtaaacggacccccaaccctcgttcgtacctacccttccgttcccgttacccccgtacccgtaccgg

SEQ ID NO: 131010 - DNA, 701 bp, Homo sapiens
  misc_feature: GYAE6OF02FHM5V.16.83.H06.1.454.CMB.1.raw
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtcggccccaggacagacggcagcataacctggtggggaacgccgttggacgtaaaagtgtgcacgtggtaccagcagaagccaggccaggcccctgtgctggtcgtctatgatgataggcgaccggccctgagggactcccgtaggacgcgtattctcgtggcctacctaactcgtacgggaaccggcccggacccaccctcgaacccataccgacgtaccggaggggtacgaaccggggtaccggggagtacgggacggtacccggtaacttaacgtttacctcggtaccgaggggttgggttaggggaattaacgggtaggttaaggtgaacttacgtagtttagttacggttccgtttacgggtacttaccgggtcgggtaacccgtacggggttcccacccggtttaccggtacggtacccgaacggtacccccgaaacggtccccctaaaaccccgtccgttacgtaccttaaccccgtcgtttacccgttacccccctaccccgttacccg

SEQ ID NO: 131011 - DNA, 675 bp, Homo sapiens
  misc_feature: GYAE6OF02GYPDL.16.83.H06.1.454.CMB.1.raw
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcacgccaccctcggtcgtccgtcggccccaggacaggacggccagcataaccgtggtacgggggaaacggccttaggaacgtaaaagtgtcgcacgtggtaccaggcaagaacgaccgacggaccgacggccccgtgtcgcgtcggtcgtctagtgtagtgacgtacggccggacccggtcccgtacggacgggtacctccgtcggacgacgtacttcgtcgtcggtcctacctaacgttcggtacgggaaccgccggtacccaccgtcgaacctactacgaacgacgggtacggaacgggccggggagtcggacggaccgtaacgttagttacgtcggtacggtagggtgggtagggtaagttaggttagtagtagtactagtattagtacgttcgttcgtacgttcggtacggacgtacggtccgtaccgtcgtacgtcgaccggaccgaaccgacccgaaccctacgtctaccgtccttccgttaccctccccgtaccttccgtacg

SEQ ID NO: 131012 - DNA, 727 bp, Homo sapiens
  misc_feature: GYAE6OF02HJPAL.16.83.H06.1.454.CMB.1.raw
  modified_base (307)..(307): a, c, t, g, unknown or other
  misc_feature (307)..(307): n is a, c, g, or t
tcagtgtactactccacgaccggtgctcgatttagatcacgtgcgtcgcggggagtctgggcctaaggaagcagcactggtggtgcctcagccatggcctggaccgttctcctcctcggccctcctctctcactgcacaggctctgtgacctcctatgtcctgactcagcccaccctcggtgtccgtggccccaggacagacggccagcaataacctggtagggggaaacgtccgttggaacgtaaaagtgtgacacgtgtaccagcagaagccaggccacggcccctgtcgcgtggcgtctatgangatagccgacccggccctcgaggactccctgacgcgtatcgtctggcctacaacgtcgtacgggaaccgccggaccctacccgtagaccctactcacggacgtacggggtacggaaacggccggggtatagggaaccgggaccgtaacttaagttacgtggtacgtacgggtggttagggtaagttaagtaggttaggtactaagttccgtaagtttacgttcgtttaccgttacgggtacgtttaccggtacgggggtaaaccgacgggttacccgtacccggttccgttaacgggttaccaacccgggaaccccggtaaaaccgggacccccctaaaccccccgtaacgtttccggtaaccctacccgttttacccggttcccccggttttaccccccgtccccccgtttaacccggg

SEQ ID NO: 131013 - DNA, 634 bp, Homo sapiens
  misc_feature: GYAE6OF02FW1EJ.16.83.H06.1.454.CMB.1.raw
  modified_base (262)..(262): a, c, t, g, unknown or other
  misc_feature (262)..(262): n is a, c, g, or t
  modified_base (340)..(340): a, c, t, g, unknown or other
  misc_feature (340)..(340): n is a, c, g, or t
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggccccaggacagacggccagcataacctggtgggggaacgccttggacgtaaagtgtgcactggtaccagcagaanccaggccagccccctgtcgcgtggtctctagtgatgatagccgaccggccctgacgggctccctgagccgattctcgnggcctccaactcgtgggaaccgcggtacccacccgtgaccctatcgagcacgggtcgaaggcccgggatggacggaccgacttatacgtgtacaggtgtgggataggtacgtgtagactcgtattagtcgtttacgttcggtatccggtacgggaccgtacggggtaccctaaccgggtttcctaacggggtacctaccgggaacccctaaccggggtaacccccaaccccccgtaacgttcggtttaccacccgttcctttcccccgggttacccccgtccccgttaccccgg

SEQ ID NO: 131014 - DNA, 690 bp, Homo sapiens
  misc_feature: GYAE6OF02GB9DI.16.83.H06.1.454.CMB.1.raw
  modified_base (281)..(281): a, c, t, g, unknown or other
  misc_feature (281)..(281): n is a, c, g, or t
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggccccaggacagacggcagcataacctggtaggggaaacggccttggacgtaaaagtgtgcactggtaccagcagaagccaggccaggcccctgngctggtcgtctatgatgatagccgaccggccctcgagggactcccgtgacgcgtattcctctggcctaccaactcgtacggggaaccgccggacccacccgtgaacccatacgaagccgaagggggtaccgaagggacccggggatagggtacgggacccgtaattaactttaccgtgtacgaggggttggttagggacttaggttagtagtaggtaacttacgtaagtttacgtggttaccgttcggtaagttccggtacggggacccgtaaggggttaccctacccgggttacccgtaacgggttaccgaaccggtaacccccgaaacggtaaccccccgtaaacccccgtacgttaccgtaccgtaacccttccgtttcccgttaccccccgtccccttaacccgg

SEQ ID NO: 131015 - DNA, 474 bp, Homo sapiens
  misc_feature: GYAE6OF02GVIHP.16.83.H06.1.454.CMB.1.raw
  modified_base (229)..(229): a, c, t, g, unknown or other
  misc_feature (229)..(229): n is a, c, g, or t
  modified_base (336)..(336): a, c, t, g, unknown or other
  misc_feature (336)..(336): n is a, c, g, or t
  modified_base (419)..(419): a, c, t, g, unknown or other
  misc_feature (419)..(419): n is a, c, g, or t
  modified_base (440)..(440): a, c, t, g, unknown or other
  misc_feature (440)..(440): n is a, c, g, or t
  modified_base (445)..(474): a, c, t, g, unknown or other
  misc_feature (445)..(474): n is a, c, g, or t
tcagtgtactactccacgaccggtgctcgatttagatcacgtgcgtcgcggggtccgtggccccaggacagacggccagcataacctgtgggggaaacggccttggcgtaaaagtgtgcactggtaccagcagaagccaggccaggcccctgtgctggtcgtctatgatgatagcgaccggccctcagggatccccgtgagcgattctctggctccaactctgggaacncggccaccctgacctatcagcgagggtcgaagccggggatggaggccgactattactgtcaggtgtgggatagtagtagtgatcattatgtctcggatcgtcggacngggtccaccgtctaggtcagcccaaggccaaccccatgcactctcgttcccgcctccgtgagtacgtacactggacgtcggtntcgggcaaagggcaccatagntacgnnnnnnnnnnnnnnnnnnnnnnnnnnnnnn

SEQ ID NO: 131016 - DNA, 717 bp, Homo sapiens
  misc_feature: GYAE6OF02G1GN3.16.83.H06.1.454.CMB.1.raw
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgacctcagcccacccgtcggtgtccgtcggccccaggacagacggccagcatacctggaggggaacgccttaggaacgtaaagtgtgacacgtggtaccagcagaagccgaggccacggcccctggtcgcgtggtcgtctatgatgatcgccgacccggccctcgacggactccgtgagcgtattcctcgtcggctacccaacgttcggtacggaaccggccggaccctaccgacgacccgtataccgacggacgggtaacggggtaccggaacgggacccgggggtaactcgggaaccgggtacccgtaacgttaacgtttaccggtcggttacggtaggggttacgggttagggtacgttaagggttaacgttaggttagtaacgttacgttaagttttagtcggtttcgttacggtacgttccggtacgggtaccgtacgggtccctacccggttcggtacgtaccgaacccggacccgtaaccggtaaccccaaccccgtacgtaccttaccgtaccgtttcccgtacccgtttccccgtcccgttacccgg

SEQ ID NO: 131017 - DNA, 588 bp, Homo sapiens
  misc_feature: GYAE6OF02G73VG.16.83.H06.1.454.CMB.1.raw
  modified_base (355)..(355): a, c, t, g, unknown or other
  misc_feature (355)..(355): n is a, c, g, or t
  modified_base (542)..(542): a, c, t, g, unknown or other
  misc_feature (542)..(542): n is a, c, g, or t
  modified_base (544)..(544): a, c, t, g, unknown or other
  misc_feature (544)..(544): n is a, c, g, or t
  modified_base (546)..(546): a, c, t, g, unknown or other
  misc_feature (546)..(546): n is a, c, g, or t
  modified_base (555)..(555): a, c, t, g, unknown or other
  misc_feature (555)..(555): n is a, c, g, or t
  modified_base (557)..(557): a, c, t, g, unknown or other
  misc_feature (557)..(557): n is a, c, g, or t
  modified_base (559)..(560): a, c, t, g, unknown or other
  misc_feature (559)..(560): n is a, c, g, or t
  modified_base (563)..(568): a, c, t, g, unknown or other
  misc_feature (563)..(568): n is a, c, g, or t
  modified_base (570)..(571): a, c, t, g, unknown or other
  misc_feature (570)..(571): n is a, c, g, or t
  modified_base (573)..(573): a, c, t, g, unknown or other
  misc_feature (573)..(573): n is a, c, g, or t
  modified_base (575)..(576): a, c, t, g, unknown or other
  misc_feature (575)..(576): n is a, c, g, or t
  modified_base (578)..(588): a, c, t, g, unknown or other
  misc_feature (578)..(588): n is a, c, g, or t
tcagtgtactactccacgaccggtgctcgatttagatcacgtgcgtcgcggggtccgtggccccaggacagacggccagcataacctgtggggggaaacggccttggacgtaaaagtgtgcactggtaccagcagaagccaggccaggcccctgtgctggtcgtctatgatgatagcgaccggccctcagggatcccctgagcgattctctggctaccaactcgtgggaaccgccggccacccgtgaccatccgagcgagggtcgaaggccggggatggacggccgtactattactgtcgagggtggtaggatagtaggtaggtgtatcgtaatttagtacgttcgtttacgggntaccggttagggaacccgtgggttaccacccggttccgtaaggtccaacggacccgaaaccggaccccaacccctacgtcgttaccaccttccgttccgttcccccgtcccgttacctcctaaggttacgtaacccgacgtcggtacggtccgggcgttacgggacgtacgggacgtactaagagangnanagtgcgtcnancnncgnnnnnncnngngnncnnnnnnnnnnn

SEQ ID NO: 131018 - DNA, 729 bp, Homo sapiens
  misc_feature: GYAE6OF02G1URZ.16.83.H06.1.454.CMB.1.raw
  modified_base (343)..(343): a, c, t, g, unknown or other
  misc_feature (343)..(343): n is a, c, g, or t
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggccccaggacaggaccggcagcataaccgtggtagggggaaacggtccgttaggaacgtaaaagtgtgcacgtggtaccagcaagagccaggccacggcccctgtcgcgtggtcgtctagtgatgatcgccgaccggccctagacgggactccgagngcgtacttctcgtcggtcctaccaacgtcgtacggggaaccgccggacccacccgtcgaccctataccgaggaccggtaaggggtaccgaacggggccggggtaagtacgggaccgggacccgtacgttacgtttacgtacgtacggtacgggttcggtaagggtagttacggttaggtaagttcgtattaaccgttagtttacgtttcgttaccgtttacgggtactttaccgggtacggggtaacccggttacggggttacccgtaacccgggttaccgtacgggtaccggtacccgaaccccggtaaaccggaaccccctaaccccggtacgttcggtacccttacccgttcccgttcccggttacccccgtcccttacccgg

SEQ ID NO: 131019 - DNA, 719 bp, Homo sapiens
  misc_feature: GYAE6OF02F5JZV.16.83.H06.1.454.CMB.1.raw
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagcccaccctcggtcgtccgtcggccccaggacagacggccagcataacctggtagggggaaacgccttaggaacgtaaaagtgtgcacgtggtaccagcagaacgccgaggccacggcccctgtgctggtctctagtgatgagtacggccgacccggcctacggacgggactcccgtgacgacggtattcgtctcggtcctacccgacgttccggtacggggaaccgtcccggacccacccgtcgaaccctagtaccgacgaccggtaagggtaccggaaccgggccggggtacgtacgggacggtacccgtaattaacgtttaccgtcggtacggagggttgggtaaggtacgttaaggttaaggtacggtgtacgttagttagtttaacgttcggtttaccgttcggttaacgttcgggtacgggtacccgtaacggggtccctaaccggttccgtaggtacccgaaccggtacccgaacccggtaaccccctacccgtaccgttcgtccctaccgtttccggtaccccgttccccgtaccctacccggg

SEQ ID NO: 131020 - DNA, 823 bp, Homo sapiens
  misc_feature: GYAE6OF02JCBO0.16.83.H06.1.454.CMB.1.raw
tcagtgtactactccacgaccggtgctcgatttagatcacgtgcgtcgcggggagtctgggcctaaaggaagcagcactggtcggtgcctcagccatggcctggaccgttctcctcctcggcctcctctctcactgcacaggctctgtgacctcctatgtcctgactcagccaccctcggtgtccgtggcccccaggacagaccggccagcataacctggtgggggaaacgcttggacgtaaagtgtgcactggtaccagtcagaagtccgaggtccgaacggcccccttgtgccgtagggttcgtcctaacgtggagtggtattaggccggtacccggtcccgtcaacggggtacctccccgtaggtacggaccggtaatttccgtacgttcggccttacccgaaaccgtttcggtacggggtaacccggccgggacccctaacccggttcggaacccctaagttcccgaacggtaccggaacgggggttaccggaaacggggccccgggggtaaagtcgggaaccgggtaccccgggaattacgttaccgtcggttaccgtaagggtggttagggaacttaaggttagggtacgttcgaaacgttcctagttttaacgtcggtttaccgttaccgggtacttaccgggtttacggggaccccgtaaagggggttccctaacccgggttacccgtttaaccggggaccgtttaacccgggaaccccggttaaaccggaacccccggtaacccccggtaacgttttcccgaacccgtttaacccgtttccccgtcggtttcccccccctaacccttccccggg

SEQ ID NO: 131021 - DNA, 798 bp, Homo sapiens
  misc_feature: GYAE6OF02HRT9A.16.83.H06.1.454.CMB.1.raw
  modified_base (262)..(262): a, c, t, g, unknown or other
  misc_feature (262)..(262): n is a, c, g, or t
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgaccttcctatgtcctgactcacgcccaccctcggtcgtccgtcggccccaggacagaccggcagcatacctggtagggggaacgccgtaggaacgtaaagtgtgcactggtaccngcagagcaggccacggcccctgcgcgtggtcgtctatgatgagtagccggacccggccctcgacggtactcccgtgagcgtacttctcgtgcctcctaacgtcgtacggggaaccgccggtaccccacccgtacgacccgtaactccgacggacgggtaacgggggttacccgggaaacggggtaccccgggggtaaggtacgggaaccgggtacccggtaaaccgtttaacgttttaaccggtcggttaccgggtaaggggttcggggttaacggggtaacgttaagggttacggttaagttaacggtaacgtttaaccgttaagtttttacggtttcgtttaccgggttttacggtacgttttaccggggtacggggttaacccggtaacgggttcccgggttaccgttacccggttaacgggtaccccgtaaacgaccccgggtaaacccgaaccccgtaaaccccggtaccgttacccgtacccgttacctttccccggttacccgtttaccccccgtaccccgttacccgg

SEQ ID NO: 131022 - DNA, 731 bp, Homo sapiens
  misc_feature: GYAE6OF02H5UD6.16.83.H06.1.454.CMB.1.raw
  modified_base (297)..(297): a, c, t, g, unknown or other
  misc_feature (297)..(297): n is a, c, g, or t
tcagtgtactactccacgaccggtgctcgatttagatcacgtgcgtcgcggggagtctgggcctaaggaagcagcactggtggtgcctcagccatggcctggaccgttctcctcctcggcctcctctctcactgaacaggctctgtgacctcctatgtcctgactcagccaccctcggtcgtccgtggccccaggacagaccggccagcataacctggtagggggaaacgccttaggacgtaaaagtgtagcacgtggtaccagcagagccaggccacggcccctgtgctggtcgtntatgatgatacggcggacccggccctcgagggactccctggacgcgtacttctcgttggcctacctaacgtcgtacgggaaccgccggacccacccgtagaccctatcgacggcggaacggggtacggaacggggtcccggggatacgggacgggtcccgtaacgttacgtttaccgtcggttacgagggtttcgggtaagggtaacgttaaggttacggttagttacgtacttaccgttaagtttagttcggttaccgtttagggacgttaccgggtacggggaacccgtaggggtaccccgtaccgggttacccgttacgggtaccgaaccggtaacccgaacccgggaccccctaaaccccgttacgttaccgttacctaacctttcccggttaccccggtttcccccgttcccccgttcccgtaaccggg

SEQ ID NO: 131023 - DNA, 859 bp, Homo sapiens
  misc_feature: GYAE6OF02HWY1Z.16.83.H06.1.454.CMB.1.raw
  modified_base (302)..(302): a, c, t, g, unknown or other
  misc_feature (302)..(302): n is a, c, g, or t
  modified_base (789)..(789): a, c, t, g, unknown or other
  misc_feature (789)..(789): n is a, c, g, or t
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgaccctcctatcgtcctgactcacgcccaccctcggtgtccgtcggccccaggacaggacggccagcaataaccgtggcgggggaaacgccgttagggaacgtaaaagtgtcgcacgtcggtaccagcgaagaacgccgaggccacggcccctggngcgtggtcgtctatgatgacgtacgccgaccggcctacgacgggtactcccgtggacgcgtacttccgtcgtcggtcctacccgtaacgttcggtacggggaaccgcccggtaccctaacccgtcgaaccctactaccgacggtaccgggtacggggtaacggaaccgggggtccggggaacttacgggggaacgggtaccccggttaaacgtttaaacgtttaacccggttcggttacgggtaacggggtttacgggttaacgggggttaaagttaacggggtttaaagggtttaacgggtacggttaaaccgtttacgttaaagttttacggttacggttttaccggttttaccggggtaacctttacggggttaaccgggggtaaacccggttacgggggttccctacccccgggtttaacggttccgggtaaccgaccccggttaaacccgggtaaacccgggccccccttaaaacccccggngttaacccggttcccggtaacccttttaccccggttacccggtttcccccgttaccccgtttaacccggg

SEQ ID NO: 131024 - DNA, 843 bp, Homo sapiens
  misc_feature: GYAE6OF02HEIJR.16.83.H06.1.454.CMB.1.raw
  modified_base (125)..(125): a, c, t, g, unknown or other
  misc_feature (125)..(125): n is a, c, g, or t
tcagtgtactactccacgaccggtgctcgatttagatcacgtgcgtcgcgggagtctgggcctaaggaagcagcactggtggtgcctcagccatggcctggaccgttctcctcctcggcctcctntctcactgcacaggctctgtgacctcctatgtcctgactcagccacctcggtgtccggtcggccccaggtacacggacggccagcaactaaccgtgggttacgggggaaacggtccgttaggaacggttaaaaggtcgttagaccgtacgttacggtaacctaggtccaaggtaaccggaccgacggaccgacggggtcccccttagggtcgaccgttggttccgtacttagtacggtaagtacgacgtacggtacccggaacccggtcccgtacggacgggtaccttacccggtggacggtccgtaacgtttccgttccggtcggtacccgttaacccgtaaacgttccggttaacggggaaacccggtcccggtaaccccgtaacccgttccgaaacccgttaacgtacggaacggtccgggtaacggggtaacccggtaagggaccccgggggtataccggggtaaccgggtacccgtaaactttaacgttaccggttaaccggtggtacggggttacgggttagggttaagttaacgggttaagtacgttacgaacgttaaccgttagtttaaccgttcgttacggttaccgtagtccggttacgggaccgtacggggtcctaccggtccgttagacccgtacggacccgttacgaacccgtaccgtaccgtacgtacctaccgtcccggtttaccgtcccgtacccgttacgg

SEQ ID NO: 131025 - DNA, 653 bp, Homo sapiens
  misc_feature: GYAE6OF02F8DTR.16.83.H06.1.454.CMB.1.raw
  modified_base (326)..(326): a, c, t, g, unknown or other
  misc_feature (326)..(326): n is a, c, g, or t
  modified_base (330)..(330): a, c, t, g, unknown or other
  misc_feature (330)..(330): n is a, c, g, or t
  modified_base (391)..(391): a, c, t, g, unknown or other
  misc_feature (391)..(391): n is a, c, g, or t
tcagtgtactactccacgaccggtgctcgatttagatcacgtgcgtcgcggggagtctgggcctaaggaagcagcactggtggtgcctcagccatggcctggaccgttctcctcctcgacctcctctctcactgcacaggctctgtgacctcctatgtcctgactcagccaccctcggtgtccggtcgccccaggacacgacggccagcataaccgtgtaggggaaacgccttaggacgtaaaagtgtgacactggtaccagacaagaagccaggccaggcccctgcgcgtggtcgtctatgatgatagccgaccgtcctgaggancccngacgcgtattcctacgtggaccctaccgaaactcgttacgggaaccgcggacccacccgtnaacgactgaacgcgagggtacgaacggccgggagtcgacgggtaccgactaattacgtggtaacctagggtggttaaggtagttacggtagtaagggtacagttcaagtttagtcggttcgttaccgggtattaccgggtacgggaacccgtaagggtaccctaccgttacccgttacgtaccggacggtaaccccgaaccggtacccaaccccgtaattcgtacccgaccttcgttacccgttaccccgacccgttccccg

SEQ ID NO: 131026 - DNA, 724 bp, Homo sapiens
  misc_feature: GYAE6OF02HF9B0.16.83.H06.1.454.CMB.1.raw
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagcccaccctcggtgtccgtggccccaggacagacggcagcataacctggtggggaaacgccttggacgtaaaagtgtgtactggtaccagcagaacgccaggccaggcccctgcgctggtctctatgatgatagcgacccggccctcgacgggtactcccgtagcgacgtacttccttagtcgggtcctaccgaacgttccggtaacggggtaaccggcccggtcccgtaaccccgtaggaacccgtattccgaacggaccggtacgggggtaccggaaacggggtccgggggtaagtacgggaacggggtaccccgtaacggtttaactttaccgtggttaccggagggttgggttaacgggggtatttaaacggttagggttaaggttagtacgttaccttaagtttacgttacggttccgttagggtacgttccggtacggggtaaccgtacgggttcccgtacccggtacgtcggttaccgaccggacccgaaccgtacccaaccccgacgttcggacctaccgttctaccgttccctacgttcccgtacccg

SEQ ID NO: 131027 - DNA, 735 bp, Homo sapiens
  misc_feature: GYAE6OF02JHG5D.16.83.H06.1.454.CMB.1.raw
  modified_base (224)..(224): a, c, t, g, unknown or other
  misc_feature (224)..(224): n is a, c, g, or t
  modified_base (284)..(284): a, c, t, g, unknown or other
  misc_feature (284)..(284): n is a, c, g, or t
tcagtgtactactccacgaccggtgctcgatttagatcacgtgcgtcgcggggagtctgggcctaaggaagcaggcactgggtggtgcctcagccatggcctggaccgttctcctccgtcggcctcctctctcactgcacaggctctgcgacctcctatcgtcctagcctcgacgccctaccgtcggtcgtccgtcgccccgaggacacgcgccagcataccgngggacgggaacgtccgtaggacgtaaagtgtcgacacgtcggtaccagcaagaacgccgnggacccaccggtcccctgtcggcgttccggggtcttctagtcgtagttaggtgtaacggtcccggaacccggtcctacggaacgggtaccctaccgttggaacgtccgttacgtttccgtcgttaacggccctaccgacgttccggtacggggaccgtacccggaccctaccgtaccgaccttacaccgacggtaccgggagggtaaacccggacggggtacccggggtaacggggtaccccacgttaaccgttacgttacggttcgtaggtacgggttacggtaggtaacgtttaacggtagtacgtagtactagtttacgtacgtttcgtaacggttcgtccgttaggtccgggtaacgtacggttcccgaaccgttcttaaggccgtaacccggaccgaacgtccccaacgcgtcgtacctaccgtacctcccggtaccctctaccgg

SEQ ID NO: 131028 - DNA, 750 bp, Homo sapiens
  misc_feature: GYAE6OF02I3BP8.16.83.H06.1.454.CMB.1.raw
tcagtgtactactccacgaccggtgctcgatttagatcacgtgcgtcgcgggggagtctgggcctaaggaagcagcactggtggtgcctcagccatggcctggaccgttctcctcctcggcctcctctctcactgcacagctctgacgacctcctatcgtcctgactcacgcccaccgtcggtcgtccgtcggcccgaggacacgacggccagcaactaccgtagggtacgggaacgtcgtaggaacgtaaagtgtacgacacgtaggtacagacaggaacgccgacgaccgtacggcctgacggcgttggtcgtactgtacgtagtcgtacgtacggaccggtacccggtcccgtacggaacgggtacccttccggagaccgtacgtcttcgtacgtcgtacctaccgacgtcggtaccggacggtcgaccctaccgtacgaaccgtctacggtacgcggtaacgggacgggaacgggcggtaacgtcgggaactaccggtacttacgtaacgtcgtacgggtaggtggtaaacggttacgtaagttacggtacgttacgagttaccgtagttacggttacgttacggttaacggtcgttcgggtaaacccgggtacggtaaccggtacccgttaccccggttacgtaccggttaccgaacccggaacccgtaaccccggtaaccccctaaccggccttacggtaccctaaccgttccctttaacccggttacccctccccggtaacgg

SEQ ID NO: 131029 - DNA, 710 bp, Homo sapiens
  misc_feature: GYAE6OF02GVMX0.16.83.H06.1.454.CMB.1.raw
  modified_base (109)..(109): a, c, t, g, unknown or other
  misc_feature (109)..(109): n is a, c, g, or t
tcagtgtactactccacgaccggtgctcgatttagatcacgtgcgtcgcggggagtctgggcctaaggaagcagcactggtggtgcctcagccatggcctggaccgttntcctcctcggcctcctctctcactcgcacaggactctgtgacctcctatcgtcctgactcacgccacctggtcgtccgtcggcccaggacagacggctagccataacctggaggggaaccgtcttggaacgtaaagtgacgccacgtagtaccagctaagagcacggaccacggccccttgtcgacgttggtccgtcttagtacagttagacgtacggaccgtcccggcccgttacgacgggtacctcccgtagcgtacgtacttccgtactcggtaccgtaccgaacgtcgtacggaccggaccgaccctaacccgtacggaacctacgaccgtacgacggtaacggtacggaacgggacccgggtagtacggacggtaccgtaacgttacgttacgtacggtaccggttacgggtaggtacgggttaacgtaaggtacgttaagtacgtaacgttactaacgtttacgttcgttacggttaccgtagtccggtacggtacggtacgtccgtactaccgtcggtacgaaccgtacccgtaaccgaacccgtaccctaacgtcttaacccgtcttaccggtccctcccgtaccgttacccg

SEQ ID NO: 131030 - DNA, 711 bp, Homo sapiens
  misc_feature: GYAE6OF02FLAJ0.16.83.H06.1.454.CMB.1.raw
tcagtgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggcccaggacagacggccagcataacctggtgggggaaacgccttggaacgtaaaagtgtgcactcggtaccagcagaagccaggccgaggcccctgtcgctggtcgtctatcgatgatagccgaccggcctcgagggactcccgtgaacgcgtacttctctcggcctaccaacgttcgtagggaaccgccggaccctacccgtagaaccctacgtcgacgcgaacggggtacggaacgggaccgggggtatacgggacgggacccgaagttactttacgtcggtaccgagggttcggtagggtaacttagggttacgtagttacgagtactagtttacgtgtttaccgttacggtacttaccggtacgggaacccgtaggggttcctaaccccggttccgttaaggggaccgtaaaccggtacccccgaaaccggggtccccctaaaaacccccggttcgttaccggttaccccttaaccccggtttacccggtacccttttccccccgtaaccccttccccggg

SEQ ID NO: 131031 - DNA, 699 bp, Homo sapiens
  misc_feature: GYAE6OF02IT215.16.83.H06.1.454.CMB.1.raw
  modified_base (597)..(597): a, c, t, g, unknown or other
  misc_feature (597)..(597): n is a, c, g, or t
  modified_base (615)..(615): a, c, t, g, unknown or other
  misc_feature (615)..(615): n is a, c, g, or t
tcagtgtactactccacgaccggtgctcgatttagatcacgtgcgtcgcggggtccgtggccccaggacagacggccagcataacctggtgggggaaacggccttggacgtaaaagtgtgcactggtaccagcagaagccaggccaggcccctgtgctggtcgtctatgatgatagcgaccggccctcagggactcccgtagagcgattctctggctccaactcgtggacgcggccacccgtgaccatcgaagcgtacgggtacgaacggccggggatcggacggtccgtaacgttacgttacgttcggtacgagggttggttacggggagttaggtaaggttagttggtactcgttattagtacgttcgtacggtattcggtacgggaaccgttgggtacctaccggtccgttaggtccacggtaccccgaacggaccccaaaccccgtgtaccgtacctaaccgttcgtacccgttttacccccacccgttccctaacggtaacgttaccggttacgtaaacccgtgggaaacccgggtcgggtacccgttacgggaacggtaaacgggtcccgaccggtaaagttcgcgtacgntcgactgcgtagtagtcncgcgtacacgtcgtcgtacgtacgtcgtcgtcgcgacgtcgtcgtcgtactacgtcgcgtaccgtaccgtacgacgtacgatcg

SEQ ID NO: 131032 - DNA, 295 bp, Homo sapiens
  misc_feature: GYAE6OF01EO7NB.13.12.B01.1.454.CMB.1.raw
  modified_base (293)..(295): a, c, t, g, unknown or other
  misc_feature (293)..(295): n is a, c, g, or t
tcagtcacgtactacacgaccggtgctcgatttagtagtgtagattccgcgggactctggggtcccagacagattcagcggcagtgggtcaggcactgatttcacattgaaaatcagcagggtggaggctgaggatgttattgggctctattattgcatgcaagcaacacactggccgtacacttttggccagggaccaagctggagatcaatcgaactgtggctgcaccatctgtcttcatcttcccgccatctgatagtacgtgactgagcgggctggcaaggcgcatagnnn

SEQ ID NO: 131033 - DNA, 291 bp, Homo sapiens
  misc_feature: GYAE6OF01DH005.13.12.B01.1.454.CMB.1.raw
  modified_base (283)..(283): a, c, t, g, unknown or other
  misc_feature (283)..(283): n is a, c, g, or t
  modified_base (289)..(291): a, c, t, g, unknown or other
  misc_feature (289)..(291): n is a, c, g, or t
tcagtcacgtactacacgaccggtgctcgatttagtagtgtagattccgcgggactctggggtcccagacagattcagcggcagtgggtcaggcactgatttcacattgaaaatcaccagggtggaggctgaggatgttgggatttattactgcatgcaagctacattctggcctttcactttcggccctgggaccaaagtggataccaatcgaactgtgctgcaccatctgtcttcatcttcccgcatctgatagtacgtgactgagcgggctggcaaggcncatagnnn

SEQ ID NO: 131034 - DNA, 294 bp, Homo sapiens
  misc_feature: GYAE6OF01AEMLA.13.12.B01.1.454.CMB.1.raw
  modified_base (291)..(294): a, c, t, g, unknown or other
  misc_feature (291)..(294): n is a, c, g, or t
tcagtcacgtactacacgaccggtgctcgatttagtagtgtagattccgcgggactctggggtcccagacagattcagcggcagtgggtcaggcactgatttcacattgaaaatcaccagggtggaggctgaggatgttgggatttattactgcatgcaagctacattctggcctttcactttcggccctgggaccaaagtggataccaatcgaactgtggctgcaccatctgtcttcatcttcccgccatctgatagtacgtgactgagcgggctggcaaggcgcatagnnnn

SEQ ID NO: 131035 - DNA, 293 bp, Homo sapiens
  misc_feature: GYAE6OF01CS2IF.13.12.B01.1.454.CMB.1.raw
  modified_base (289)..(293): a, c, t, g, unknown or other
  misc_feature (289)..(293): n is a, c, g, or t
tcagtcacgtactacacgaccggtgctcgatttagtagtgtagattccgcgggactctggggtcccagacagattcagcggcagtgggtcaggcactgatttcacattgaaaatcaccagggtggaggctgaggatgttggatttattactgcatgcaagctacattctggcctttcactttcggccctgggaccaaagtggataccaatcgaactgtggctgcaccatctgtcttcatcttcccgcatctgatagtacgtgactgagcgggctggcaaggcgcatagnnnnn

SEQ ID NO: 131036 - DNA, 303 bp, Homo sapiens
  misc_feature: GYAE6OF01ARIMO.13.12.B01.1.454.CMB.1.raw
  modified_base (269)..(269): a, c, t, g, unknown or other
  misc_feature (269)..(269): n is a, c, g, or t
  modified_base (289)..(289): a, c, t, g, unknown or other
  misc_feature (289)..(289): n is a, c, g, or t
  modified_base (293)..(303): a, c, t, g, unknown or other
  misc_feature (293)..(303): n is a, c, g, or t
tcagtcacgtactacacgaccggtgctcgatttagtagtgtagattccgcgggactctggggtcccagacagattcagcggtcagtgggtcaggcactgatttcacattgaaaatcaccagggtggaggctgaggatgttgggattttattactgcattgcaagctacattcgtggcctttcactttcggccctgggaccaaagtgataccaatcgaacgtgtggctgccaccatctgtcttcatcttcccgctatctgatagtacgtnactgagcgggctggcaggcnatgnnnnnnnnnnn

SEQ ID NO: 131037 - DNA, 225 bp, Homo sapiens
  misc_feature: GYAE6OF01BVQOP.13.12.B01.1.454.CMB.1.raw
  modified_base (223)..(225): a, c, t, g, unknown or other
  misc_feature (223)..(225): n is a, c, g, or t
tcagtcacgtactacacgaccggtgctcgatttagtagtgtagattccgcgggacgcaaaccatagatgaggctgcctattattgtcaggcgtggtacaatgacgcggttttcggcggagggacgacgctgaccgtcctaagtcagcccaaggctgccccctcggtcactctgttcccgccctcctctagtacgtgactgagcgggctggcaaggcgcatagnnn

SEQ ID NO: 131038 - DNA, 470 bp, Homo sapiens
  misc_feature: GYAE6OF01C6KAT.13.12.B01.1.454.CMB.1.raw
  modified_base (454)..(470): a, c, t, g, unknown or other
  misc_feature (454)..(470): n is a, c, g, or t
tcagtcacgtactacacgaccggtgctcgatttagtagtgtagattccgcgggagctggatccggcagcccgccgggaagggactggagtggattgggcttatcaatgccagtgggggcaccagctacaacccctccctcaagagccgcgtcaccatttcagtagacacgtccaagaaccagctctccctgaagctgagtttctgtgaccgccgcagaccacggccgtgtattactgtgcgcgacaggtggacgtctgggggccaagggaccacggtcaccgtctcctcagcctccaccaaggcccatccggtcctttccccctggccgccctgcctccgaggacgccacccgtccgagacgcacacgccggccctgggctcgcctggtacaaggtacctacttcctaagtacgtgactggacggcgggtcgtgggcgaacgggcgacagtagnnnnnnnnnnnnnnnnn

SEQ ID NO: 131039 - DNA, 295 bp, Homo sapiens
  misc_feature: GYAE6OF01C4BTT.13.12.B01.1.454.CMB.1.raw
  modified_base (291)..(295): a, c, t, g, unknown or other
  misc_feature (291)..(295): n is a, c, g, or t
tcagtcacgtactacacgaccggtgctcgatttagtagtgtagattccgcgggactctggggtcccagacagattcagcggcagtgggtcaggcactgatttcacattgaaaatcaccagggtggaggctgaggatgttgggatttattactgcatgcaagctacattctggcctttcactttccggccctgggaccaaagtggataccaatcgaactgtggctgcaccatctgtcttcatctcccgcatctgatagtacgtgaactgagcgggctggcaaggcgcatagnnnnn

SEQ ID NO: 131040 - DNA, 297 bp, Homo sapiens
  misc_feature: GYAE6OF01CIHMG.13.12.B01.1.454.CMB.1.raw
  modified_base (263)..(263): a, c, t, g, unknown or other
  misc_feature (263)..(263): n is a, c, g, or t
  modified_base (290)..(297): a, c, t, g, unknown or other
  misc_feature (290)..(297): n is a, c, g, or t
tcagtcacgtactacacgaccggtgctcgatttagtagtgtagattccgcgggactctggggtcccagacagattcagcggcagtgggtcaggcactgatttcacattgaaaatcaccagggtggaggctgaggatggttgggatttattactgcatgcaagctacattctggcctttcactttcggccctgggaccaaagtgataccaatcgaactgtgctgcaccatctgtcttcatcctccgcctatctgatagtacgtnactgagcggctggcaaggcgacatagnnnnnnnn

SEQ ID NO: 131041 - DNA, 560 bp, Homo sapiens
  misc_feature: GYAE6OF01ADWIX.13.12.B01.1.454.CMB.1.raw
  modified_base (134)..(134): a, c, t, g, unknown or other
  misc_feature (134)..(134): n is a, c, g, or t
  modified_base (151)..(151): a, c, t, g, unknown or other
  misc_feature (151)..(151): n is a, c, g, or t
  modified_base (171)..(171): a, c, t, g, unknown or other
  misc_feature (171)..(171): n is a, c, g, or t
  modified_base (289)..(289): a, c, t, g, unknown or other
  misc_feature (289)..(289): n is a, c, g, or t
  modified_base (321)..(321): a, c, t, g, unknown or other
  misc_feature (321)..(321): n is a, c, g, or t
  modified_base (354)..(354): a, c, t, g, unknown or other
  misc_feature (354)..(354): n is a, c, g, or t
  modified_base (368)..(368): a, c, t, g, unknown or other
  misc_feature (368)..(368): n is a, c, g, or t
  modified_base (375)..(375): a, c, t, g, unknown or other
  misc_feature (375)..(375): n is a, c, g, or t
  modified_base (388)..(388): a, c, t, g, unknown or other
  misc_feature (388)..(388): n is a, c, g, or t
  modified_base (405)..(405): a, c, t, g, unknown or other
  misc_feature (405)..(405): n is a, c, g, or t
  modified_base (410)..(410): a, c, t, g, unknown or other
  misc_feature (410)..(410): n is a, c, g, or t
  modified_base (415)..(415): a, c, t, g, unknown or other
  misc_feature (415)..(415): n is a, c, g, or t
  modified_base (419)..(419): a, c, t, g, unknown or other
  misc_feature (419)..(419): n is a, c, g, or t
  modified_base (423)..(423): a, c, t, g, unknown or other
  misc_feature (423)..(423): n is a, c, g, or t
  modified_base (430)..(431): a, c, t, g, unknown or other
  misc_feature (430)..(431): n is a, c, g, or t
  modified_base (435)..(435): a, c, t, g, unknown or other
  misc_feature (435)..(435): n is a, c, g, or t
  modified_base (448)..(448): a, c, t, g, unknown or other
  misc_feature (448)..(448): n is a, c, g, or t
tcagtcacgtactacacgaccggtgctcgatttagtagtgtagattccgcgggactcgtggggtcccagacagattcagcggcagtgggtcaggcactgatttcacattgaaaatcaccagggtgagctgaggntggttggatttattacngcatgacaagctacattcgnggtcctttcactttcggccctggaccaaagtggactaccgaatcggaactggtacggctacgcaaccatcctgtcttcgacttcgtttccccgctaattcctagtaatacggttacgngaactgaggtccgggctagggactaacgggcncaaagttcgccgtaatcgactagcacgtgtctnacgtctagacctanccggttntacggatgacccngtttcgatcggctaagncgtanctagntacntcancgttagnngaangacttgacagtcngtacacgtactacgtcgtacagtacgtacgatacgtaccgtcgtaacgtcgaactcgtagagtacgtacgacgtccgagtaacgtactacggtacgaaagtctcgtacgaag

SEQ ID NO: 131042 - DNA, 396 bp, Homo sapiens
  misc_feature: GYAE6OF01DD8PH.13.12.B01.1.454.CMB.1.raw
  modified_base (277)..(277): a, c, t, g, unknown or other
  misc_feature (277)..(277): n is a, c, g, or t
  modified_base (295)..(295): a, c, t, g, unknown or other
  misc_feature (295)..(295): n is a, c, g, or t
  modified_base (332)..(332): a, c, t, g, unknown or other
  misc_feature (332)..(332): n is a, c, g, or t
  modified_base (335)..(396): a, c, t, g, unknown or other
  misc_feature (335)..(396): n is a, c, g, or t
tcagtcacgtactacacgaccggtgctcgatttagtagtgtagattccgcgggactcgtggggtcccagacagattcagcggcagtgggtcaggcactgatttcacattgaaaatcaccagggtgaggctgaggatgttggatttatactgcatgcaagctacatttcgtgtcctttctacttttccgggccccttaggggaaccaaaggtcggaacttacccaagtcgaaacctggtggcctgcctaccagtctagttcttcacttcctaccccgntacgtctgactagtccgntactggacgcgggctagggaccaagggcacagtacgnctnnnnnnnnnnnnnnnnnnnnnnnnnnnnnnnnnnnnnnnnnnnnnnnnnnnnnnnnnnnnnn

SEQ ID NO: 131043 - DNA, 299 bp, Homo sapiens
  misc_feature: GYAE6OF01EMUY5.13.12.B01.1.454.CMB.1.raw
  modified_base (293)..(299): a, c, t, g, unknown or other
  misc_feature (293)..(299): n is a, c, g, or t
tcagtcacgtactacacgaccggtgctcgatttagtagtgtagattccgcgggactctggggtcccagacagattcagcggcagtgggtcaggcactgatttcacattgaaaatcaccagggtggaggctgaggatgttgggatttattactgcatgcaagctacattctggtccctttcactttccggccctgggaccaaagtggataccaatcgaactgtggctgcacatctgtcttcatccttccgccatctgatagtacgtgacctgagcggctggacaggcgcatagnnnnnnn

SEQ ID NO: 131044 - DNA, 335 bp, Homo sapiens
  misc_feature: GYAE6OF01A6GC0.13.12.B01.1.454.CMB.1.raw
  modified_base (295)..(295): a, c, t, g, unknown or other
  misc_feature (295)..(295): n is a, c, g, or t
  modified_base (306)..(335): a, c, t, g, unknown or other
  misc_feature (306)..(335): n is a, c, g, or t
tcagtcacgtactacacgaccggtgctcgatttagtagtgtagattccgcgggactctggggtcccagacagattcagcggcagtgggtcaggcactgatttcacattgaaaatcaccagggtggaggctgaggatggttgggattttattactgcatgcaagctacattctgtcctttcactttccggccctgggaaccaagtgataccatcgaactgtgctgcaccatctgtcttcactccttcccgcctatctgtatagtacgtgactggacggcggctggcgaagggtccnctaagtacggnnnnnnnnnnnnnnnnnnnnnnnnnnnnnn

SEQ ID NO: 131045 - DNA, 674 bp, Homo sapiens
  misc_feature: GYAE6OF01DXJTU.13.12.B01.1.454.CMB.1.raw
  modified_base (225)..(225): a, c, t, g, unknown or other
  misc_feature (225)..(225): n is a, c, g, or t
  modified_base (344)..(344): a, c, t, g, unknown or other
  misc_feature (344)..(344): n is a, c, g, or t
  modified_base (360)..(360): a, c, t, g, unknown or other
  misc_feature (360)..(360): n is a, c, g, or t
  modified_base (417)..(417): a, c, t, g, unknown or other
  misc_feature (417)..(417): n is a, c, g, or t
  modified_base (432)..(432): a, c, t, g, unknown or other
  misc_feature (432)..(432): n is a, c, g, or t
  modified_base (480)..(480): a, c, t, g, unknown or other
  misc_feature (480)..(480): n is a, c, g, or t
  modified_base (650)..(650): a, c, t, g, unknown or other
  misc_feature (650)..(650): n is a, c, g, or t
tcagtcacgtactacacgaccggtgctcgatttagtagtgtagattcggcggggggggtctcgaggagcagcgctctcgggacgtctccaccatcggcctgggctctgctattcctcaccctctcactcaggactagtcgggtccgtcgggcccagtctcgaccctgacctcacgcctggccttccgtgtcgtcgggtcctcgtaggacctaggtcactccaccncgttcctccgtgacacgtggaccagcgtagtcgttcggttcgaggtaccaagtctattccgtacctccgtaacgtaacccaacgaaccaccggacggaaccgaacccgttaccccaaanctaatttatttacggnttactttacggaaacttcgacccggtcttaggagttctactacttggtcctccttancgtcgtacctaacgnggtcacgaactccgccctcctccggtaccttacgtccggtcggtaacnccgtacgcggacgaggacggagttacgcgttaaacttgttctacggtccgtaacgccgttagtacccggtaattcgtacctcttacgttcgtcgtaacgtccgtatccggaagccgtaacgccgtaccgttacgcgtccacggaccctcgaaccccgttcacgtctaccncccgtcgtaaaccctccctaaccg

SEQ ID NO: 131046 - DNA, 316 bp, Homo sapiens
  misc_feature: GYAE6OF01AVBGA.13.12.B01.1.454.CMB.1.raw
  modified_base (295)..(295): a, c, t, g, unknown or other
  misc_feature (295)..(295): n is a, c, g, or t
  modified_base (301)..(316): a, c, t, g, unknown or other
  misc_feature (301)..(316): n is a, c, g, or t
tcagtcacgtactacacgaccggtgctcgatttagtagtgtagattccgcgggactctggggtcccagacagattcagcggcagtgggtcaggcactgatttcacattgaaaatcaccagggtggaggctgaggatgttgggatttattactgcatgcaagctacattctggtcctttcacgtttccggccctgggaccaaagtggactaccaatcgaactgtggctgcactatctgtcttcatccttcccgctatctgatagtacgtgactggacgcgggctggacgaaggcgnagtagnnnnnnnnnnnnnnnn

SEQ ID NO: 131047 - DNA, 784 bp, Homo sapiens
  misc_feature: GYAE6OF01B5G5D.13.12.B01.1.454.CMB.1.raw
  modified_base (242)..(242): a, c, t, g, unknown or other
  misc_feature (242)..(242): n is a, c, g, or t
tcagtcacgtactacacgaccggtgctcgatttagtagtgtagattcggcgggggggggtctcagggaggcagcgctctcgggacgtctccaccatggcctgggctctgctattcctcaccctcctcactcagggcagtagggtcctgggcccagtctcgccctgactcagcctcgcctcgtgtcgtgggtctccgtggacaggtcgactccacctattcctcctgaccaacgtaggaaacnggctaacgtgtacttcggtttacgggtactttaagtacgttacgtttcgttccgttaccgtaccggtaacccaaaccacccgaacccgtaggacccgaacccggacccccgaggtactctaactcgttaagtttcgggcggggaacctaaggtaccgggccgggtaccggtacggtaacgggttacctttacccgaccgttccgtcctttccgtacggtccggtaccttacgtaagttccgtaacgggaacctaacccggacccggttcccttacccgtacggaaccttaacgttccgttacggtacgtacccgtaccggaacggaccggtaacgggacgtacggttcttacggtttattttaccgtaggttacttacagtgaccggtaaggaagggtacggagtttagtaacgttaggttcggttaggttaaggacggttacggacgtacggtcccgtacgttcggtcgaccggacgtaaccccggaacgtcccctaccgtacgttcctactacccgttcgtcccctacccgtcccttacg

SEQ ID NO: 131048 - DNA, 834 bp, Homo sapiens
  misc_feature: GYAE6OF01C6V1D.13.12.B01.1.454.CMB.1.raw
  modified_base (252)..(252): a, c, t, g, unknown or other
  misc_feature (252)..(252): n is a, c, g, or t
tcagtcacgtactacacgaccggtgctcgatttagtagtgtagattcggcggggggggtctcaggaggcagcgctctcgggacgtctccaccatggcctgggctctgctattcctcaccctcctcactcgagggcagtacggtcctcgggcccagtctgccctgactcagcctgcctcgtgtcgtcggtctccgtggactagtcgatccactatctctgctacggtcggaccagcgtagtcgtacgtttcgnggtacaagtactgtcgttcctcgtacggtaaccaaccgaaccgaacccgaggaaccgaaccggtaacccccctaaaattcctaagtttaatttaagtacgttaactttaccgaacttaacggtcccggtacccgtagtagggtttacgttacttaacgttaacgtccgttaccgttacgtacgttcggtaccttaccgtaaacggttccgtacggtaacctaaacccgtcccggttaccccgtacccgtacgaaccccttacgttcccgtacggtcggtcctaccggtacgaccgaggaacgggtacgtacggtacgttaacgttaacttacggttaaccgtcgggttacccgtaccggttaccggtttaacggaccgtttaacgtttaaccgtacccgtttacccgttttaagtcccggggtttaacgttaccggggtaacctttcgggacccggtaaccgttaccgggttaccctacccggttaaccggccggtaacccgtaccgaacccggaacccctaaccccgttaaacctccgttacgtacccttcccgtaacccgtttccccgtaccccgttccc

SEQ ID NO: 131049 - DNA, 292 bp, Homo sapiens
  misc_feature: GYAE6OF02F453W.13.12.B01.1.454.CMB.1.raw
  modified_base (289)..(292): a, c, t, g, unknown or other
  misc_feature (289)..(292): n is a, c, g, or t
tcagtcacgtactacacgaccggtgctcgatttagtagtgtagattccgcgggactctgggtcccagacagattcagcggcagtgggtcaggcactgatttcacattgaaaatcaccagggtggaggctgaggatgttgggatttattactgcatgcaagctacattctggcctttcactttcggccctgggaccaaagtggataccaatcgaactgtggctgcaccatctgtcttcatcttcccgcatctgatagtacgtgactgagcgggctggcaaggcgcatagnnnn

SEQ ID NO: 131050 - DNA, 296 bp, Homo sapiens
  misc_feature: GYAE6OF02HVI53.13.12.B01.1.454.CMB.1.raw
  modified_base (294)..(296): a, c, t, g, unknown or other
  misc_feature (294)..(296): n is a, c, g, or t
tcagtcacgtactacacgaccggtgctcgatttagtagtgtagattccgcgggactctggggtcccagacagattcagcggcagtgggtcaggcactgatttcacattgaaaatcaccagggtggaggctgaggatgttattgggctctattattgcatgcaagcaacacactggccgtacacttttggccaggggaccaagctggagatcaatcgaactgtggctgcaccatctgtcttcatcttcccgccatctgatagtacgtgactgagcgggctggcaaggcgcatagnnn

SEQ ID NO: 131051 - DNA, 294 bp, Homo sapiens
  misc_feature: GYAE6OF02GT87O.13.12.B01.1.454.CMB.1.raw
  modified_base (290)..(294): a, c, t, g, unknown or other
  misc_feature (290)..(294): n is a, c, g, or t
tcagtcacgtactacacgaccggtgctcgatttagtagtgtagattccgcgggactctgggtcccagacagattcagcggcagtgggtcaggcactgatttcacattgaaaatcaccagggtggaggctgaggatgttgggatttattactgcatgcaagctacattctggcctttcactttcggccctgggaccaaagtggataccaatcgaactgtggctgcaccatctgtcttcatcttcccgccatctgatagtacgtgactgagcgggctggcaaggcgcatagnnnnn

SEQ ID NO: 131052 - DNA, 296 bp, Homo sapiens
  misc_feature: GYAE6OF02GSNH8.13.12.B01.1.454.CMB.1.raw
  modified_base (294)..(296): a, c, t, g, unknown or other
  misc_feature (294)..(296): n is a, c, g, or t
tcagtcacgtactacacgaccggtgctcgatttagtagtgtagattccgcgggactctggggtcccagacagattcagcggcagtgggtcaggcactgatttcacattgaaaatcagcagggtggaggctgaggatgttattgggctctattattgcatgcaagcaacacactggccgtacacttttggccaggggaccaagctggagatcaatcgaactgtggctgcaccatctgtcttcatcttcccgccatctgatagtacgtgactgagcgggctggcaaggcgcatagnnn

SEQ ID NO: 131053 - DNA, 296 bp, Homo sapiens
  misc_feature: GYAE6OF02H2B7C.13.12.B01.1.454.CMB.1.raw
  modified_base (291)..(296): a, c, t, g, unknown or other
  misc_feature (291)..(296): n is a, c, g, or t
tcagtcacgtactacacgaccggtgctcgatttagtagtgtagattccgcgggactctggggtcccagacagattcagcggcagtgggtcaggcactgatttcacattgaaaatcaccagggtggaggctgaggatgttgggatttattactgcatgcaagctacattctggcctttcactttcggccctgggaccaaagtggataccaatcgaactgtggctgcaccatctgtcttcatcttcccgccatctgatagtacgtgactgagcgggctggcaaggcgcatagnnnnnn

SEQ ID NO: 131054 - DNA, 295 bp, Homo sapiens
  misc_feature: GYAE6OF02HPH8U.13.12.B01.1.454.CMB.1.raw
  modified_base (291)..(295): a, c, t, g, unknown or other
  misc_feature (291)..(295): n is a, c, g, or t
tcagtcacgtactacacgaccggtgctcgatttagtagtgtagattccgcgggactctggggtcccagacagattcagcggcagtgggtcaggcactgatttcacattgaaaatcaccagggtggaggctgaggatgttgggatttattactgcatgcaagctacattctggcctttcactttcggccctgggaccaaagtggataccaatcgaactgtggctgcaccatctgtcttcatcttcccgccatctgatagtacgtgactgagcgggctggcaaggcgcatagnnnnn

SEQ ID NO: 131055 - DNA, 296 bp, Homo sapiens; identical to SEQ ID NO: 131053
  misc_feature: GYAE6OF02IV9LP.13.12.B01.1.454.CMB.1.raw
  modified_base (291)..(296): a, c, t, g, unknown or other
  misc_feature (291)..(296): n is a, c, g, or t

SEQ ID NO: 131056 - DNA, 223 bp, Homo sapiens
  misc_feature: GYAE6OF02F6SKH.13.12.B01.1.454.CMB.1.raw
  modified_base (223)..(223): a, c, t, g, unknown or other
  misc_feature (223)..(223): n is a, c, g, or t
tcagtcacgtactacacgaccggtgctcgatttagtagtgtagattccgcgggacgcaaaccatagatgaggctgcctattattgtcaggagtggtacaatgacgcggttttcggcggagggacgacgctgaccgtcctaagtcagcccaaggctgccccctcggtcactctgttcccgccctcctctagtacgtgactgagcgggctggcaaggcgcatagn

SEQ ID NO: 131057 - DNA, 227 bp, Homo sapiens
  misc_feature: GYAE6OF02I7HWY.13.12.B01.1.454.CMB.1.raw
  modified_base (223)..(227): a, c, t, g, unknown or other
  misc_feature (223)..(227): n is a, c, g, or t
tcagtcacgtactacacgaccggtgctcgatttagtagtgtagattccgcgggacgcaaaccatagatgaggctgcctattattgtcaggcgtggtacaatgacgcggttttcggcggagggacgacgctgaccgtccttcgtcagcccaaggctgccccctcggtcactctgttcccaccctcctctagtacgtgactgagcgggctggcaaggcgcatagnnnnn

SEQ ID NO: 131058 - DNA, 303 bp, Homo sapiens
  misc_feature: GYAE6OF02FR4J3.13.12.B01.1.454.CMB.1.raw
  modified_base (294)..(303): a, c, t, g, unknown or other
  misc_feature (294)..(303): n is a, c, g, or t
tcagtcacgtactacacgaccggtgctcgatttagtagtgtagattccgcgggacgtctggggtcccagacagattcagcggcagtgggtcaggcactgattcacattgaaaatcaccagggtggaggctgaggatgttattgggctctattattgcatgcaagcaacacactggccgtacacttttggccaggggaccaagctggagatcaatcgaactgtggctgcaccatctgtcttcatcttcccgccatctgatagtacgtgactgagcgggctggcaaggcgcatagnnnnnnnnnn

SEQ ID NO: 131059 - DNA, 310 bp, Homo sapiens
  misc_feature: GYAE6OF02FJ1FF.13.12.B01.1.454.CMB.1.raw
  modified_base (290)..(310): a, c, t, g, unknown or other
  misc_feature (290)..(310): n is a, c, g, or t
tcagtcacgtactacacgaccggtgctcgatttagtagtgtagattccgcgggactctggggtcccagacagattcagcggcagtgggtcaggcactgatttcacattgaaaatcaccagggtggaggctgaggatgttgggatttattactgcatgcaagctacatttctggtcctttcactttcggccctggaccaaagtggataccaatcgaactgtgctgcaccatctgtcttcatcttcccgcatctgatagtacgtgactgagcgggctggcaggcgcatacgnnnnnnnnnnnnnnnnnnnnn

SEQ ID NO: 131060 - DNA, 320 bp, Homo sapiens
  misc_feature: GYAE6OF02H6HCH.13.12.B01.1.454.CMB.1.raw
  modified_base (298)..(320): a, c, t, g, unknown or other
  misc_feature (298)..(320): n is a, c, g, or t
tcagtcacgtactacacgaccggtgctcgatttagtagtgtagattccgcgggactctgggtcccagacagattcagcggcagtgggtcaggcactgatttcacattgaaaatcaccagggtggaggctgaggatgttgggatttattactgcattgcaagctactattctggtcctttcactttcggccctgggaccaaagtggataccaatcgaactgtggctgcaccatctgtcttcatccttcccgccatctgactagtacgtgaactgacgcgggctggcaaggcgacatagnnnnnnnnnnnnnnnnnnnnnnn

SEQ ID NO: 131061 - DNA, 437 bp, Homo sapiens
  misc_feature: GYAE6OF02HH8UL.13.12.B01.1.454.CMB.1.raw
  modified_base (427)..(437): a, c, t, g, unknown or other
  misc_feature (427)..(437): n is a, c, g, or t
tcagtcacgtactacacgaccggtgctcgatttagtagtgtagattccgcgggagctggatccggcagcccgccgggaagggactggagtggattgggcttatcaatgccagtgggggcaccagctacaacccctccctcaagagccgcgtcaccatttcagtagacacgtccaagaaccagctctccctgaagctgagttctgtgaccgccgcagacacggccgtgtattactgtgcgcgacaggtggacgtctggggccaagggaccacggtcaccgtctcctcagcctccaccaagggcccatcggtcttcccctggccgccctgcctccaggacgcacctccgagacgcacagccggccctgggctgcctggtcaaggactacttcctagtacgtgactgagcgggctggcaaggcgcatagnnnnnnnnnnn

SEQ ID NO: 131062 - DNA, 296 bp, Homo sapiens; identical to SEQ ID NO: 131053
  misc_feature: GYAE6OF02FHRMG.13.12.B01.1.454.CMB.1.raw
  modified_base (291)..(296): a, c, t, g, unknown or other
  misc_feature (291)..(296): n is a, c, g, or t

SEQ ID NO: 131063 - DNA, 300 bp, Homo sapiens
  misc_feature: GYAE6OF02HS5NA.13.12.B01.1.454.CMB.1.raw
  modified_base (293)..(300): a, c, t, g, unknown or other
  misc_feature (293)..(300): n is a, c, g, or t
tcagtcacgtactacacgaccggtgctcgatttagtagtgtagattccgcgggactctggggtcccagacagattcagcggcagtgggtcaggcactgatttcacactgaaaatcagcagggtggaggctgaggatgttattgggctctattattgcatgcaagcaacacactggccgtacacttttggccaggggaccaagctggagatcaatcgaactgtgctgcaccatctgtcttcatcttcccgccatctgaatagtacgtgactgagcggctggcaaggcgcatagnnnnnnnn

SEQ ID NO: 131064 - DNA, 294 bp, Homo sapiens
  misc_feature: GYAE6OF02FT2WS.13.12.B01.1.454.CMB.1.raw
  modified_base (284)..(284): a, c, t, g, unknown or other
  misc_feature (284)..(284): n is a, c, g, or t
  modified_base (290)..(294): a, c, t, g, unknown or other
  misc_feature (290)..(294): n is a, c, g, or t
tcagtcacgtactacacgaccggtgctcgatttagtagtgtagattccgcgggactctggggtcccagacagattcagcggcagtgggtcaggcactgatttcacattgaaaatcaccagggtggaggctgaggatgttgggatttattactgcatgcaagctacattctggcctttcactttcggccctgggaccaaagtggataccaatcgaactgtggctgcaccatctgtcttcatcttcccgccatctgatagtacgtgactgagcgggctggcaggcncatagnnnnn

SEQ ID NO: 131065 - DNA, 225 bp, Homo sapiens
  misc_feature: GYAE6OF02I53NJ.13.12.B01.1.454.CMB.1.raw
  modified_base (223)..(225): a, c, t, g, unknown or other
  misc_feature (223)..(225): n is a, c, g, or t
tcagtcacgtactacacgaccggtgctcgatttagtagtgtagattccgcgggacgcaaaccatagatgaggctgcctattattgtcaggcgtggtacaatgacgcggttttcggcggagggacgacgctgaccgtcctaagtcagcccaaggctgccccctcggtcactctgttcccaccctcctctagtacgtgactgagcgggctggcaaggcgcatagnnn

SEQ ID NO: 131066 - DNA, 295 bp, Homo sapiens
  misc_feature: GYAE6OF02ILTIJ.13.12.B01.1.454.CMB.1.raw
  modified_base (290)..(295): a, c, t, g, unknown or other
  misc_feature (290)..(295): n is a, c, g, or t
tcagtcacgtactacacgaccggtgctcgatttagtagtgtagattccgcgggactctggggtcccagacagattcagcggcagtgggtcaggcactgatttcacattgaaaatcaccagggtggaggctgaggatgttgggatttattactgcatgcaagctacattctggcctttcactttcggccctgggaccaaagtgataccaatcgaactgtggctgcaccatctgtcttcatcttcccgccatctgatagtacgtgactgagcgggctggcaaggcgcatagnnnnnn

SEQ ID NO: 131067 - DNA, 291 bp, Homo sapiens
  misc_feature: GYAE6OF02GFD4N.13.12.B01.1.454.CMB.1.raw
  modified_base (278)..(278): a, c, t, g, unknown or other
  misc_feature (278)..(278): n is a, c, g, or t
  modified_base (284)..(291): a, c, t, g, unknown or other
  misc_feature (284)..(291): n is a, c, g, or t
tcagtcacgtactacacgaccggtgctcgatttagtagtgtagattccgcgggactctggggtcccagacagattcagcggcagtgggtcaggcactgatttcacattgaaatcaccagggtggaggctgaggatgttgggatttattactgcatgcaagctacattctggcctttcactttcggccctggaccaaagtgatacaatcgaactgtggctgcaccatctgtctcatctcccgcatctgatagtacgtgactgagcgggctggcaaggcncatagnnnnnnnn

SEQ ID NO: 131068 - DNA, 299 bp, Homo sapiens
  misc_feature: GYAE6OF02H97VV.13.12.B01.1.454.CMB.1.raw
  modified_base (255)..(255): a, c, t, g, unknown or other
  misc_feature (255)..(255): n is a, c, g, or t
  modified_base (265)..(265): a, c, t, g, unknown or other
  misc_feature (265)..(265): n is a, c, g, or t
  modified_base (287)..(287): a, c, t, g, unknown or other
  misc_feature (287)..(287): n is a, c, g, or t
  modified_base (294)..(299): a, c, t, g, unknown or other
  misc_feature (294)..(299): n is a, c, g, or t
tcagtcacgtactacacgaccggtgctcgatttagtagtgtagattccgcgggactctggggtcccagacagattcagcggcagtgggtcaggcactgatttcacattgaaaatcaccagggtggaggctgaggatgttgggatttattactgcatgcaaagctacattctggcctttcactttcggccctgggaccaaagtggataccaatcgaactgtggctgcaccatctgtcttcatcttcccgccatctnatagtacgtnactgagcgggctggcaagggcncaatagnnnnnn

SEQ ID NO: 131069 - DNA, 330 bp, Homo sapiens
  misc_feature: GYAE6OF02IAT3J.13.12.B01.1.454.CMB.1.raw
  modified_base (176)..(176): a, c, t, g, unknown or other
  misc_feature (176)..(176): n is a, c, g, or t
  modified_base (225)..(225): a, c, t, g, unknown or other
  misc_feature (225)..(225): n is a, c, g, or t
  modified_base (297)..(299): a, c, t, g, unknown or other
  misc_feature (297)..(299): n is a, c, g, or t
  modified_base (301)..(302): a, c, t, g, unknown or other
  misc_feature (301)..(302): n is a, c, g, or t
  modified_base (304)..(330): a, c, t, g, unknown or other
  misc_feature (304)..(330): n is a, c, g, or t
tcagtcacgtactacacgaccggtgctcgatttagtagtgtagattccgcgggactcgtgggtcccagacagattcagcggcagtgggtcaggcactgatttcacattgaaatcaccaggtggaggctgaggatgttggatttattactgcatgcaagctacattctggccttttnactttcggccctgggaccaaagtggataccaatcgactgtggctgcacntctgtcttcattctcccgccatctgatagtacgtgaactgagccgggatgggcaagggcgcaagtaggcgannncnntnnnnnnnnnnnnnnnnnnnnnnnnnnn

SEQ ID NO: 131070 - DNA, 563 bp, Homo sapiens
  misc_feature: GYAE6OF02GZ3UL.13.12.B01.1.454.CMB.1.raw
  modified_base (329)..(329): a, c, t, g, unknown or other
  misc_feature (329)..(329): n is a, c, g, or t
  modified_base (334)..(334): a, c, t, g, unknown or other
  misc_feature (334)..(334): n is a, c, g, or t
  modified_base (525)..(527): a, c, t, g, unknown or other
  misc_feature (525)..(527): n is a, c, g, or t
  modified_base (529)..(532): a, c, t, g, unknown or other
  misc_feature (529)..(532): n is a, c, g, or t
  modified_base (534)..(537): a, c, t, g, unknown or other
  misc_feature (534)..(537): n is a, c, g, or t
  modified_base (539)..(563): a, c, t, g, unknown or other
  misc_feature (539)..(563): n is a, c, g, or t
tcagtcacgtactacacgaccggtgctcgatttagtagtgtagattccgcgggagctggatccggcagcccgccgggaagggactggagtggattgggcttatcaatgccagtgggggcaccagctacaaccccctccctcaagagccgcgtcaccattttcagtagacacgtccaagaaccagctctccctgaagctgagttctgtgaccgccgcagacacggccgtgtattactgtgcgcgacaggtggacgtcgtggggaccaaggggaccacggtcaccgtctcctcagcctccaccgaagggcccagtccggtccttcccccgnggccncccctgcctccgaggacgccacccgtccgaggacgccacgacggccggcccgtggggccttcggcccgttgggtaccgaaacgggtaccttaaccgtttcccgttaaggttaccggttcggtaaccgttgggaacgggtccgggggtacttcggggaccgaaaggggtcccgaccgtaagtacggctgcgnnngnnnngnnnngnnnnnnnnnnnnnnnnnnnnnnnnn

SEQ ID NO: 131071 - DNA, 571 bp, Homo sapiens
  misc_feature: GYAE6OF02FYY1R.13.12.B01.1.454.CMB.1.raw
  modified_base (246)..(246): a, c, t, g, unknown or other
  misc_feature (246)..(246): n is a, c, g, or t
  modified_base (515)..(515): a, c, t, g, unknown or other
  misc_feature (515)..(515): n is a, c, g, or t
  modified_base (520)..(520): a, c, t, g, unknown or other
  misc_feature (520)..(520): n is a, c, g, or t
  modified_base (525)..(525): a, c, t, g, unknown or other
  misc_feature (525)..(525): n is a, c, g, or t
  modified_base (528)..(528): a, c, t, g, unknown or other
  misc_feature (528)..(528): n is a, c, g, or t
  modified_base (530)..(531): a, c, t, g, unknown or other
  misc_feature (530)..(531): n is a, c, g, or t
  modified_base (533)..(535): a, c, t, g, unknown or other
  misc_feature (533)..(535): n is a, c, g, or t
  modified_base (540)..(540): a, c, t, g, unknown or other
  misc_feature (540)..(540): n is a, c, g, or t
  modified_base (542)..(542): a, c, t, g, unknown or other
  misc_feature (542)..(542): n is a, c, g, or t
  modified_base (544)..(546): a, c, t, g, unknown or other
  misc_feature (544)..(546): n is a, c, g, or t
  modified_base (548)..(548): a, c, t, g, unknown or other
  misc_feature (548)..(548): n is a, c, g, or t
  modified_base (550)..(550): a, c, t, g, unknown or other
  misc_feature (550)..(550): n is a, c, g, or t
  modified_base (552)..(552): a, c, t, g, unknown or other
  misc_feature (552)..(552): n is a, c, g, or t
  modified_base (554)..(556): a, c, t, g, unknown or other
  misc_feature (554)..(556): n is a, c, g, or t
  modified_base (558)..(564): a, c, t, g, unknown or other
  misc_feature (558)..(564): n is a, c, g, or t
  modified_base (566)..(571): a, c, t, g, unknown or other
  misc_feature (566)..(571): n is a, c, g, or t
tcagtcacgtactacacgaccggtgctcgatttagtagtgtagattccgcgggagctggatccggcagcccgccgggaagggactggagtggattgggcttatcaatgccagtgggggcaccagctacaaccccctccctcaagagccgcgtcaccatttcagtagacacgtccaagaaccagctctccctgaagctgagttctgtgaccgccgcagacacggccgtgtattactgtgcgcgacgnggtggacgtcgtgggccaagggaccacggtcaccgtctcctcgacgccctccaccgaacgggccccagtccggtcccttccccccgtggcccgccccgtgcctacccgagggacgcccaaccccgtccggaacggacgccaacgacggcccggccccgtggggtcctcggccgtcggtacgaaacgggtaccttaaccgtttccgtaagttacggtcgacgttgggacggtccgggcgttcgggacgaacgggccgacgaagtacgcgngactncgtancgngnngnnngcgcngngnnngngngngnnngnnnnnnncnnnnnn

SEQ ID NO: 131072 - DNA, 614 bp, Homo sapiens
  misc_feature: GYAE6OF02IXPNL.13.12.B01.1.454.CMB.1.raw
  modified_base (534)..(534): a, c, t, g, unknown or other
  misc_feature (534)..(534): n is a, c, g, or t
  modified_base (539)..(539): a, c, t, g, unknown or other
  misc_feature (539)..(539): n is a, c, g, or t
  modified_base (544)..(544): a, c, t, g, unknown or other
  misc_feature (544)..(544): n is a, c, g, or t
  modified_base (548)..(548): a, c, t, g, unknown or other
  misc_feature (548)..(548): n is a, c, g, or t
  modified_base (551)..(551): a, c, t, g, unknown or other
  misc_feature (551)..(551): n is a, c, g, or t
  modified_base (562)..(562): a, c, t, g, unknown or other
  misc_feature (562)..(562): n is a, c, g, or t
  modified_base (571)..(571): a, c, t, g, unknown or other
  misc_feature (571)..(571): n is a, c, g, or t
  modified_base (575)..(575): a, c, t, g, unknown or other
  misc_feature (575)..(575): n is a, c, g, or t
  modified_base (578)..(578): a, c, t, g, unknown or other
  misc_feature (578)..(578): n is a, c, g, or t
  modified_base (581)..(582): a, c, t, g, unknown or other
  misc_feature (581)..(582): n is a, c, g, or t
  modified_base (586)..(586): a, c, t, g, unknown or other
  misc_feature (586)..(586): n is a, c, g, or t
  modified_base (596)..(596): a, c, t, g, unknown or other
  misc_feature (596)..(596): n is a, c, g, or t
  modified_base (611)..(611): a, c, t, g, unknown or other
  misc_feature (611)..(611): n is a, c, g, or t
tcagtcacgtactacacgaccggtgctcgattttagtagtgtagattccggcgggaggctggatccggcagcccgccgggaagggactggagtggattcgggcttatcaatgccagtgggggcaccagctacaacccctccctcaagagccgcgtcgaccattttcagtagacacgtccaagaccagctctcctgagctgagttctgtcgaccgccgcagacgacggccgtgtattacgtgtgcgcgacgtaggtggaccgttcgacgggaccaagggaccacggtccaccgtctccctcgacgtccctaccgaccgacgggccccagtccggttcccttccccccgtagggcccgtcccgtcgacctcccgacggacgcctaccgtccggagacgcgacgtacggccggacccgtggggcctcgccgttcgggtacaacggtaccttacttacccgttaacggtacggttacgtacgtcggacgggtccgggtacttacgggaccgttaaagggtccgtacgtaacgtacggntcgancgatncgtnctncggacagtcgngatcaatcngtancgngcnncgcnactcgtcgtnctctcacgtcgtctntcg

SEQ ID NO: 131073 - DNA, 125 bp, Homo sapiens
  misc_feature: GYAE6OF01BOAZY.51.79.H02.1.454.CMB.1.raw
  modified_base (116)..(125): a, c, t, g, unknown or other
  misc_feature (116)..(125): n is a, c, g, or t
tcagcgatcgtatacacgaccggtgctcgatttagtgtcacacgaagggaagggcagcgtcactctgttcccgcctcctctcgtagcactctgagcgggctggcaaggcgcatagnnnnnnnnnn

SEQ ID NO: 131074 - DNA, 158 bp, Homo sapiens
  misc_feature: GYAE6OF01AQ619.51.79.H02.1.454.CMB.1.raw
  modified_base (155)..(158): a, c, t, g, unknown or other
  misc_feature (155)..(158): n is a, c, g, or t
tcagcgatcgtatacacgaccggtgctcgatttagtgtcacacgaagggaagggcacgaccggtgctcgatttagagtgctacgaaggaagggcagcgtcactctgttcccacctcctctcgtagcactctgagcgggctggcaaggcgcatagnnnn

SEQ ID NO: 131075 - DNA, 115 bp, Homo sapiens
  misc_feature: GYAE6OF01BGPEC.51.79.H02.1.454.CMB.1.raw
  modified_base (115)..(115): a, c, t, g, unknown or other
  misc_feature (115)..(115): n is a, c, g, or t
tcagcgatcgtatacacgaccggtgctcgatttagtgtcacacgaagggaaggcagcgtcactctgttcccgccctcctctcgtagcactctgagcggctggcaaggcgcatagn

SEQ ID NO: 131076 - DNA, 115 bp, Homo sapiens; identical to SEQ ID NO: 131075
  misc_feature: GYAE6OF01D9D64.51.79.H02.1.454.CMB.1.raw
  modified_base (115)..(115): a, c, t, g, unknown or other
  misc_feature (115)..(115): n is a, c, g, or t

SEQ ID NO: 131077 - DNA, 117 bp, Homo sapiens
  misc_feature: GYAE6OF01C5P4T.51.79.H02.1.454.CMB.1.raw
  modified_base (117)..(117): a, c, t, g, unknown or other
  misc_feature (117)..(117): n is a, c, g, or t
tcagcgatcgtatacacgaccggtgctcgatttagtgtcacacgaagggaagggcagcgtcactctgttcccgccctcctctcgtagcactctgagcgggctggcaaggcgcatagn

SEQ ID NO: 131078 - DNA, 120 bp, Homo sapiens
  misc_feature: GYAE6OF01EK4RO.51.79.H02.1.454.CMB.1.raw
  modified_base (116)..(120): a, c, t, g, unknown or other
  misc_feature (116)..(120): n is a, c, g, or t
tcagcgatcgtatacacgaccggtgctcgatttagtgtcacacgaagggaagggcagcgtcactctgttcccaccctcctctcgtagcactctgagcggctggcaaggcgcatagnnnnn

SEQ ID NO: 131079 - DNA, 117 bp, Homo sapiens
  misc_feature: GYAE6OF01EAUHD.51.79.H02.1.454.CMB.1.raw
  modified_base (117)..(117): a, c, t, g, unknown or other
  misc_feature (117)..(117): n is a, c, g, or t
tcagcgatcgtatacacgaccggtgctcgatttagtgtcacacgaagggaaagggcagcgtcactctgttcccaccctcctctcgtagcactctgagcggctggcaaggcgcatagn

SEQ ID NO: 131080 - DNA, 117 bp, Homo sapiens
  misc_feature: GYAE6OF01EDT5I.51.79.H02.1.454.CMB.1.raw
  modified_base (117)..(117): a, c, t, g, unknown or other
  misc_feature (117)..(117): n is a, c, g, or t
tcagcgatcgtatacacgaccggtgctcgatttagtgtcacacgaagggaagggcagcgtcactctgttcccaccctcctctcgtagcactctgagcgggctggcaaggcgcatagn

SEQ ID NO: 131081 - DNA, 116 bp, Homo sapiens
  misc_feature: GYAE6OF01BN182.51.79.H02.1.454.CMB.1.raw
  modified_base (116)..(116): a, c, t, g, unknown or other
  misc_feature (116)..(116): n is a, c, g, or t
tcagcgatcgtatacacgaccggtgctcgatttagtgtcacacgaagggaagggcagcgtcactctgttcccaccctcctctcgtagcactctgagcggctggcaaggcgcatagn

SEQ ID NO: 131082 - DNA, 117 bp, Homo sapiens
  misc_feature: GYAE6OF01BDS3M.51.79.H02.1.454.CMB.1.raw
tcagcgatcgtatacacgaccggtgctcgatttagtgtcacacgaagggaaagggcagcgtcactctgttcccaccctcctctcgtagcactctgagcgggctggcaaggcgcatag

SEQ ID NO: 131083 - DNA, 118 bp, Homo sapiens
  misc_feature: GYAE6OF01DZBZQ.51.79.H02.1.454.CMB.1.raw
  modified_base (118)..(118): a, c, t, g, unknown or other
  misc_feature (118)..(118): n is a, c, g, or t
tcagcgatcgtatacacgaccggtgctcgatttagtgtcacacgaagggaaagggcagcgtcactctgttcccaccctcctctcgtagcactctgagcgggctggcaaggcgcatagn

SEQ ID NO: 131084 - DNA, 137 bp, Homo sapiens
  misc_feature: GYAE6OF01CN5T8.51.79.H02.1.454.CMB.1.raw
  modified_base (110)..(110): a, c, t, g, unknown or other
  misc_feature (110)..(110): n is a, c, g, or t
  modified_base (117)..(137): a, c, t, g, unknown or other
  misc_feature (117)..(137): n is a, c, g, or t
tcagcgatcgtatacacgaccggtgctcgatttagtgtcacacgaagggaagggcagcgtcgactctgttcccaccctctctcgtagcactctgagcggctggcaaggcncattgcnnnnnnnnnnnnnnnnnnnnn

SEQ ID NO: 131085 - DNA, 119 bp, Homo sapiens
  misc_feature: GYAE6OF01EZH6S.51.79.H02.1.454.CMB.1.raw
  modified_base (118)..(119): a, c, t, g, unknown or other
  misc_feature (118)..(119): n is a, c, g, or t
tcagcgatcgtatacacgaccggtgctcgatttagtgtcacacgaagggaaagggcagcgtcactctgttcccaccctcctctcgtagcactctgagcgggctggcaaggcgcatagnn

SEQ ID NO: 131086 - DNA, 123 bp, Homo sapiens
  misc_feature: GYAE6OF01AHGY6.51.79.H02.1.454.CMB.1.raw
  modified_base (117)..(123): a, c, t, g, unknown or other
  misc_feature (117)..(123): n is a, c, g, or t
tcagcgatcgtatacacgaccggtgctcgatttagtgtcacacgaagggaaagggcagcgtcactctgttcccaccctcctctcgtagcactctgagcggctggcaaggcgcatagnnnnnnn

SEQ ID NO: 131087 - DNA, 118 bp, Homo sapiens
  misc_feature: GYAE6OF01AKC8I.51.79.H02.1.454.CMB.1.raw
  modified_base (118)..(118): a, c, t, g, unknown or other
  misc_feature (118)..(118): n is a, c, g, or t
tcagcgatcgtatacacgaccggtgctcgatttagtgtcacacgaagggaaagggcagcgtcactctgttcccatcctcctctcgtagcactctgagcgggctggcaaggcgcatagn

SEQ ID NO: 131088 - DNA, 159 bp, Homo sapiens
  misc_feature: GYAE6OF01BJ0SU.51.79.H02.1.454.CMB.1.raw
  modified_base (157)..(159): a, c, t, g, unknown or other
  misc_feature (157)..(159): n is a, c, g, or t
tcagcgatcgtatacacgaccggtgctcgatttagtgtcacacgaagggaagggcacgaccggtgctcgatttagagtgctacgaaggaaagggcagcgtcactctgttcccaccctcctctcgtagcactctgagcgggctggcaaggcgcatagnnn

SEQ ID NO: 131089 - DNA, 117 bp, Homo sapiens; identical to SEQ ID NO: 131079
  misc_feature: GYAE6OF01B3PO1.51.79.H02.1.454.CMB.1.raw
  modified_base (117)..(117): a, c, t, g, unknown or other
  misc_feature (117)..(117): n is a, c, g, or t

SEQ ID NO: 131090 - DNA, 126 bp, Homo sapiens
  misc_feature: GYAE6OF01DW5U5.51.79.H02.1.454.CMB.1.raw
  modified_base (118)..(126): a, c, t, g, unknown or other
  misc_feature (118)..(126): n is a, c, g, or t
tcagcgatcgtatacacgaccggtgctcgatttagtgtcacacgaagggaaagggcagcgtcactctgttcccaccctcctctcgtagcactctgagcgggctggcaaggcgcatagnnnnnnnnn

SEQ ID NO: 131091 - DNA, 119 bp, Homo sapiens
  misc_feature: GYAE6OF01CJE89.51.79.H02.1.454.CMB.1.raw
  modified_base (118)..(119): a, c, t, g, unknown or other
  misc_feature (118)..(119): n is a, c, g, or t
tcagcgatcgtatacacgaccggtgctcgatttagtgtcacacgaagggaaagggcagcgtcactttgttcccgccctcctctcgtagcactctgagcgggctggcaaggcgcatagnn

SEQ ID NO: 131092 - DNA, 118 bp, Homo sapiens
  misc_feature: GYAE6OF01C10Z7.51.79.H02.1.454.CMB.1.raw
  modified_base (118)..(118): a, c, t, g, unknown or other
  misc_feature (118)..(118): n is a, c, g, or t
tcagcgatcgtatacacgaccggtgctcgatttagtgtcacacgaagggaaagggcagcgtcactctgttcccgccctcctctcgtagcactctgagcgggctggcaaggcgcatagn

SEQ ID NO: 131093 - DNA, 120 bp, Homo sapiens
  misc_feature: GYAE6OF01AKIV4.51.79.H02.1.454.CMB.1.raw
  modified_base (118)..(120): a, c, t, g, unknown or other
  misc_feature (118)..(120): n is a, c, g, or t
tcagcgatcgtatacacgaccggtgctcgatttagtgtcacacgaagggaaagggcagcgtcactctgttcccgccctcctctcgtagcactctgagcgggctggcaaggcgcatagnnn

SEQ ID NO: 131094 - DNA, 125 bp, Homo sapiens
  misc_feature: GYAE6OF01E3O8H.51.79.H02.1.454.CMB.1.raw
  modified_base (117)..(125): a, c, t, g, unknown or other
  misc_feature (117)..(125): n is a, c, g, or t
tcagcgatcgtatacacgaccggtgctcgatttagtgtcacacgaagggaagggcagcgtcactctgttcccaccctcctctcgtagcactctgagcgggctggcaaggcgcatagnnnnnnnnn

SEQ ID NO: 131095 - DNA, 113 bp, Homo sapiens
  misc_feature: GYAE6OF02I0TVR.51.79.H02.1.454.CMB.1.raw
  modified_base (113)..(113): a, c, t, g, unknown or other
  misc_feature (113)..(113): n is a, c, g, or t
tcagcgatcgtatacacgaccggtgctcgatttagtgtcacacgaaggaaggcagcgtcactctgttcccgcctcctctcgtagcactctgagcggctggcaaggcgcatagn

SEQ ID NO: 131096 - DNA, 117 bp, Homo sapiens; identical to SEQ ID NO: 131077
  misc_feature: GYAE6OF02HM95B.51.79.H02.1.454.CMB.1.raw
  modified_base (117)..(117): a, c, t, g, unknown or other
  misc_feature (117)..(117): n is a, c, g, or t

SEQ ID NO: 131097 - DNA, 122 bp, Homo sapiens
  misc_feature: GYAE6OF02JP4VR.51.79.H02.1.454.CMB.1.raw
  modified_base (114)..(122): a, c, t, g, unknown or other
  misc_feature (114)..(122): n is a, c, g, or t
tcagcgatcgtatacacgaccggtgctcgatttagtgtcacacgaagggaaggcagcgtcactctgttcccgcctcctctcgtagcactctgacgcggctggcaaggcgcatgnnnnnnnnn

SEQ ID NO: 131098 - DNA, 117 bp, Homo sapiens; identical to SEQ ID NO: 131080
  misc_feature: GYAE6OF02HDH6K.51.79.H02.1.454.CMB.1.raw
  modified_base (117)..(117): a, c, t, g, unknown or other
  misc_feature (117)..(117): n is a, c, g, or t

SEQ ID NO: 131099 - DNA, 160 bp, Homo sapiens
  misc_feature: GYAE6OF02HUM69.51.79.H02.1.454.CMB.1.raw
  modified_base (159)..(160): a, c, t, g, unknown or other
  misc_feature (159)..(160): n is a, c, g, or t
tcagcgatcgtatacacgaccggtgctcgatttagtgtcacacgaagggaaagggcacgaccggtgctcgatttagagtgctacgaagggaaagggcagcgtcactctgttcccgccctcctctcgtagcactctgagcgggctggcaaggcgcatagnn

SEQ ID NO: 131100 - DNA, 123 bp, Homo sapiens
  misc_feature: GYAE6OF02GA8PX.51.79.H02.1.454.CMB.1.raw
  modified_base (118)..(123): a, c, t, g, unknown or other
  misc_feature (118)..(123): n is a, c, g, or t
tcagcgatcgtatacacgaccggtgctcgatttagtgtcacacgaagggaaagggcagcgtcactctgttcccaccctcctctcgtagcactctgagcgggctggcaaggcgcatagnnnnnn

SEQ ID NO: 131101 - DNA, 136 bp, Homo sapiens
  misc_feature: GYAE6OF02GRP6I.51.79.H02.1.454.CMB.1.raw
  modified_base (97)..(97): a, c, t, g, unknown or other
  misc_feature (97)..(97): n is a, c, g, or t
  modified_base (111)..(111): a, c, t, g, unknown or other
  misc_feature (111)..(111): n is a, c, g, or t
  modified_base (117)..(118): a, c, t, g, unknown or other
  misc_feature (117)..(118): n is a, c, g, or t
  modified_base (120)..(136): a, c, t, g, unknown or other
  misc_feature (120)..(136): n is a, c, g, or t
tcagcgatcgtatacacgaccggtgctcgatttagtgtcacacgaagggaaagggcagcgtcactctgttcccaccctcctctcgtagcactctgancgggctggcaaggncatagnncnnnnnnnnnnnnnnnnn

SEQ ID NO: 131102 - DNA, 121 bp, Homo sapiens
  misc_feature: GYAE6OF02I6BQ4.51.79.H02.1.454.CMB.1.raw
  modified_base (119)..(121): a, c, t, g, unknown or other
  misc_feature (119)..(121): n is a, c, g, or t
tcagcgatcgtatacacgaccggtgctcgatttagtgtcacacgaagggaaagggcagcgtcactctgttcccaccctcctctcgtagcactctgagcgggctggcaaggcgcattagnnn

SEQ ID NO: 131103 - DNA, 538 bp, Homo sapiens
  misc_feature: GYAE6OF01DUE1Q.22.56.F01.1.454.CMB.1.raw
  modified_base (518)..(518): a, c, t, g, unknown or other
  misc_feature (518)..(518): n is a, c, g, or t
  modified_base (534)..(538): a, c, t, g, unknown or other
  misc_feature (534)..(538): n is a, c, g, or t
tcagacatacgcgtcacgaccggtgctcgatttagcagacgtctgtcggggttctcattcaccactgcttcagtgggtgtgggctggatccgtcagcccccaggaaaggccctggagtggcttgcactcctttatggggatggcggtgaacactacagtccatctctgaagaccagactcaccatcgcccgggacacctccaagaaccaagtggtccttacactgaccagcgtggaccctgtggacacaacaacatatttctgtgcacagagccgccagttagactggggggcctgtcgtggtggttggtgccgcaatgatgcatttcatatttggggccaaggggcagtggtcaccgtctcggcagccctccaccgaacgggcccagtccggtccttcccccgtggccgcccctgcctcccgaggacgccacccgtccgagacgccacgacggccggccctgggcctcggccctggtcaacggaccttacgttccacgcgtatcgtctgacgcgggntgggcaggcgcatagnnnnn

SEQ ID NO: 131104 - DNA, 733 bp, Homo sapiens
  misc_feature: GYAE6OF01CKQO3.22.56.F01.1.454.CMB.1.raw
  modified_base (240)..(240): a, c, t, g, unknown or other
  misc_feature (240)..(240): n is a, c, g, or t
  modified_base (253)..(253): a, c, t, g, unknown or other
  misc_feature (253)..(253): n is a, c, g, or t
  modified_base (728)..(728): a, c, t, g, unknown or other
  misc_feature (728)..(728): n is a, c, g, or t
tcagacatacgcgtcacgaccggtgctcgatttagcagacgtctgtcggggttctcattcaccactgcttcagtgggtgtgggctggatccgtcagccccaggaaaggccctggagtggcttgcactcctttatggggatggcggtgaacactacagtccatctctgaagccagactcaccatcgcccgggacacctccaaagaaccagtggtccttacactgaccagccgtggacctgngacacaacaactntacttctgtgcacgacgtacgccgaccagttagacggtcgggggcctggtcgtcggtggttggtcgccgtactaagtcgtagtcggtactacgtttacgaagttacgtttacgggggaacctaagggggtaactacgggttcggtaccgtaacccggtttcgacgggtaccacggttacccgtaacccgtaacccgaacggggtaccccctacggttacccgggttccccgtttacccccggtgggtcccgtcccccgtggttacccctacccggaagggtaccgacccgtaaccgtcccgggaaagccgtacccacggaccggcccgggtacctcgggcgttaccgaccgtacggtccggtaacgaacggttaccctaccgttacccgaacggtacttaacgttccggtacggtcggtaaccgggcggtacccggtgggtaaccgaacgggtcgaaacccgtttaggaggacgngtgtg

SEQ ID NO: 131105 - DNA, 677 bp, Homo sapiens
  misc_feature: GYAE6OF01DXU00.22.56.F01.1.454.CMB.1.raw
  modified_base (227)..(227): a, c, t, g, unknown or other
  misc_feature (227)..(227): n is a, c, g, or t
  modified_base (327)..(327): a, c, t, g, unknown or other
  misc_feature (327)..(327): n is a, c, g, or t
  modified_base (329)..(329): a, c, t, g, unknown or other
  misc_feature (329)..(329): n is a, c, g, or t
  modified_base (331)..(331): a, c, t, g, unknown or other
  misc_feature (331)..(331): n is a, c, g, or t
  modified_base (334)..(334): a, c, t, g, unknown or other
  misc_feature (334)..(334): n is a, c, g, or t
  modified_base (336)..(336): a, c, t, g, unknown or other
  misc_feature (336)..(336): n is a, c, g, or t
  modified_base (339)..(339): a, c, t, g, unknown or other
  misc_feature (339)..(339): n is a, c, g, or t
  modified_base (355)..(355): a, c, t, g, unknown or other
  misc_feature (355)..(355): n is a, c, g, or t
  modified_base (669)..(669): a, c, t, g, unknown or other
  misc_feature (669)..(669): n is a, c, g, or t
  modified_base (674)..(674): a, c, t, g, unknown or other
  misc_feature (674)..(674): n is a, c, g, or t
  modified_base (676)..(676): a, c, t, g, unknown or other
  misc_feature (676)..(676): n is a, c, g, or t
tcagacatacgcgtcacgaccggtgctcgatttagcagacgtctgtcggggttctcattcaccactgcttcagtgggtgtgggctggatccgtcagcccccaggaaaggccctggagtggcttgcactcctttagtggggatgggcgtgaacactacagtccatctctagaagaccagactcaccactcgcccgggacaccctccaaacgaaccagtcggtccttanactcgaccagccggtcggaccctgtcggacaacaacaatattatttctgtgcacagacgccgcctagtagcgtgggggcctgtcggtggtggtggtgcgnangntgntnttnattagttggacgaggnaggtcggtcgacgtcgtcgacgaccgtccctaccgaccggaaccgggacccctacggttccccgggtttccccttaccccccgggtcgggtcccccgtacccccgtcggtcccctacccggaggtaccgacccgtaccccgtacgggacgaccgaccgtaaccggccggtcccggtcccggtgggtaccctcggtccgtagggtaccacgggtaccttaccgtacccgtacggtacggttaccgtagttccggtaggaccggggtcccgggtacggtacgggtaccggaaaccgggccttacggaacgtacggncgcgngng

SEQ ID NO: 131106 - DNA, 721 bp, Homo sapiens
  misc_feature: GYAE6OF01DFD1K.22.56.F01.1.454.CMB.1.raw
  modified_base (330)..(330): a, c, t, g, unknown or other
  misc_feature (330)..(330): n is a, c, g, or t
  modified_base (345)..(345): a, c, t, g, unknown or other
  misc_feature (345)..(345): n is a, c, g, or t
  modified_base (414)..(414): a, c, t, g, unknown or other
  misc_feature (414)..(414): n is a, c, g, or t
  modified_base (563)..(563): a, c, t, g, unknown or other
  misc_feature (563)..(563): n is a, c, g, or t
  modified_base (670)..(670): a, c, t, g, unknown or other
  misc_feature (670)..(670): n is a, c, g, or t
  modified_base (682)..(682): a, c, t, g, unknown or other
  misc_feature (682)..(682): n is a, c, g, or t
  modified_base (714)..(714): a, c, t, g, unknown or other
  misc_feature (714)..(714): n is a, c, g, or t
  modified_base (720)..(720): a, c, t, g, unknown or other
  misc_feature (720)..(720): n is a, c, g, or t
tcagacatacgcgtcacgaccggtgctcgatttagcagacgtctgtcgggttctcattcaccactgcttcagtgggtgtgggctggactccgcacgccccgaaggaacggccgtggagtggcttgactacttccgttagtcgggatggtcgtacgaacctactaacgacgtcctagtctacgtacgaacgacccgacgtacctccgaaccgtacggtcccgggacccggaacctccctaaccgaaacgtaaccgtacggttccgtaccttaaccgacgtccgaccggtacggccgtccggtaccgtgaccggaacctaacgaaactactnttttactcgtacgtnaacgtacgacgaccgccgtaacgtggtaaccggcgggtcgggtcttacggtggttgggtggttcggacnccgtaagtactagcttacgtatttcgttagttagttcgggtcggaacgtaggccgttaagcgttcccgacgtctacgccgaccgtaccgtacccggtaccgtaccgccttccggttcccgttccctccgccgtacccgtcgacgtaccncggcaaccgtccgacggtaccgagcgaccgtacgccggtcccgtggtaccgtccggctaccggtacggtaccgtactacccgttacgcccgtacgtcgtgtacccgngttaccgggcgnggtacccggacggtcgtacggctaacgcgtangcagcng

SEQ ID NO: 131107 - DNA, 505 bp, Homo sapiens
  misc_feature: GYAE6OF02HGAC2.22.56.F01.1.454.CMB.1.raw
  modified_base (500)..(500): a, c, t, g, unknown or other
  misc_feature (500)..(500): n is a, c, g, or t
  modified_base (503)..(505): a, c, t, g, unknown or other
  misc_feature (503)..(505): n is a, c, g, or t
tcagacatacgcgtcacgaccggtgctcgatttagcagacgtctgtcggggttctcattcaccactgcttcagtgggtgtgggctggatccgtcagccccaggaaaggccctggagtggcttgcactcctttatggggatggcggtgaacactacagtccatctctgaagaccagactcaccatcgcccgggacacctccaagaaccaagtggtccttacactgaccagcgtggaccctgtggacacaacaacatatttctgtgcacagagccgccagttagactggggggcctgtcgtggtggttggtgccgcaatgatgcatttcatatttggggccaagggacagtggtcacgtctcggcagcctccaccaagggcccatcggtcttcccctggccgccctgctccaggacgcacctccgagacgcacagcgcctgggctgcctggtcaaggctacttccacgcgtatgtctgagcgggctggcaaggcgcagtagncgnnn

SEQ ID NO: 131108 - DNA, 504 bp, Homo sapiens
  misc_feature: GYAE6OF02HQMP9.22.56.F01.1.454.CMB.1.raw
  modified_base (401)..(401): a, c, t, g, unknown or other
  misc_feature (401)..(401): n is a, c, g, or t
  modified_base (426)..(426): a, c, t, g, unknown or other
  misc_feature (426)..(426): n is a, c, g, or t
  modified_base (464)..(464): a, c, t, g, unknown or other
  misc_feature (464)..(464): n is a, c, g, or t
  modified_base (498)..(498): a, c, t, g, unknown or other
  misc_feature (498)..(498): n is a, c, g, or t
  modified_base (502)..(503): a, c, t, g, unknown or other
  misc_feature (502)..(503): n is a, c, g, or t
tcagacatacgcgtcacgaccggtgctcgatttagcagacgtctgtcgggggttctcattcaccactgcttcagtgggtgtgggctggatccgtcagccccaggaaaggccctggagtggcttgcactcctttatggggatggcggtgaacactacagtccatctctgaagaccagacctcaccatcgcccgggacacctccaagaaccaagtggtccttacactgaccagcgtggacccctgtggacacaacaacatatttctgtgctacagagccgccagttagactggggggcctggtcgtggtggttggtgccgcaatgatgcatttcatatttgggcaagggcagtggtcaccgtctcggcagcctccaccaagggcccatcgtcttcccctggcnccctgctccagagcactcgagcgcnacgcgcctgggctgcctggcaggctacttcacgcgtancgtctgacgcgggctgggcaaggccgcgatacgntcgnnc

SEQ ID NO: 131109 - DNA, 556 bp, Homo sapiens
  misc_feature: GYAE6OF02IRJYI.22.56.F01.1.454.CMB.1.raw
  modified_base (309)..(309): a, c, t, g, unknown or other
  misc_feature (309)..(309): n is a, c, g, or t
  modified_base (367)..(367): a, c, t, g, unknown or other
  misc_feature (367)..(367): n is a, c, g, or t
  modified_base (548)..(548): a, c, t, g, unknown or other
  misc_feature (548)..(548): n is a, c, g, or t
  modified_base (555)..(555): a, c, t, g, unknown or other
  misc_feature (555)..(555): n is a, c, g, or t
tcagacatacgcgtcacgaccggtgctcgatttagcagacgtctgtcggggttctcattcaccactgcttcagtgggtgtgggctggatccgtcagcccccaggaaaggccctggagtggcttgcactcctttatggggatggcggtgaacactacagtccatctctgaagaccagactcaccatcgcccgggacacctccaagaaccaagtggtccttacactgaccagcgtggaccctgtggacacaacaacatattctgtgcacagagccgccagttagactggggggcctgtcgtggtggttggngccggcaatgatgcatttcatagtttggggccaagggacagtgtcaccgtcgtcggcngcctccaccaacgggcccagtcggtccttccccgtcggccgccccgtcgcctccaggacgccacctccgagacgcaccagccggccctcgggctcgccgtggtaccgaacggtaccttaccgttcccgacgcgttactcggtctggacggcgggtctgggacaacggtcgacgacgtaggntcgatgng

SEQ ID NO: 131110 - DNA, 612 bp, Homo sapiens
  misc_feature: GYAE6OF02HKWYM.22.56.F01.1.454.CMB.1.raw
  modified_base (609)..(609): a, c, t, g, unknown or other
  misc_feature (609)..(609): n is a, c, g, or t
tcagacatacgcgtcacgaccggtgctcgatttagcagacgtctgtcggggttctcattcaccactgcttcagtgggtgtgggctggatccgtcagccccaggaaaggccctggagtggcttgcactcctttatggggatggcggtgaacactacagtccatctctgaagaccagactcaccatcgcccgggacacctccaagaaccaagtggtccttacactgaccagcgtggaccctgtcggacacaacacatattctgtgcacagagccgccagttagacgtggggggcctggtcggtggtggttggtcgccgcaagtgatgctactttcattagtttggggaccgaagggactaggtcggtctaccggttcgtcggcacggtccctccgaacccgaacgggcccctacgtccggttcccttccccgtcggtccgtcccgtcgcctcccgaaggcgaccgacccgtccgacgacgccacgacggccggtcccgtcgggctcggtccgtcggtaccgaacggtaccttccgtacccgacgtacgttacgtcgtacgtcggacggccgggtcgcggtacgaacgggccgacgtaacgtacgctagcgntcg

SEQ ID NO: 131111 - DNA, 121 bp, Homo sapiens
  misc_feature: GYAE6OF01DFO5B.49.61.F06.1.454.CMB.1.raw
  modified_base (111)..(121): a, c, t, g, unknown or other
  misc_feature (111)..(121): n is a, c, g, or t
tcagagtcgagagacacgaccggtgctcgatttagctacgctctaagggaagggttcctgttcccaccctcctctctctcgactctggagcgggctggcaaggcgcatagnnnnnnnnnnn

SEQ ID NO: 131112 - DNA, 125 bp, Homo sapiens
  misc_feature: GYAE6OF01CTNSK.49.61.F06.1.454.CMB.1.raw
  modified_base (125)..(125): a, c, t, g, unknown or other
  misc_feature (125)..(125): n is a, c, g, or t
tcagagtcgagagacacgaccggtgctcgatttagctacgctctaagggaaaggggctggccctgacgtgtttctgttcccacctcctctctctcgactctgagcgggctggcaaggcgcatagn

SEQ ID NO: 131113 - DNA, 111 bp, Homo sapiens
  misc_feature: GYAE6OF01B9Z1G.49.61.F06.1.454.CMB.1.raw
  modified_base (111)..(111): a, c, t, g, unknown or other
  misc_feature (111)..(111): n is a, c, g, or t
tcagagtcgagagacacgaccggtgctcgatttagctacgctctaagggaaagggttcctgttcccaccctcctctctctcgactctgagcgggctggcaaggcgcatagn

SEQ ID NO: 131114 - DNA, 111 bp, Homo sapiens; identical to SEQ ID NO: 131113
  misc_feature: GYAE6OF01DBZFZ.49.61.F06.1.454.CMB.1.raw
  modified_base (111)..(111): a, c, t, g, unknown or other
  misc_feature (111)..(111): n is a, c, g, or t

SEQ ID NO: 131115 - DNA, 125 bp, Homo sapiens
  misc_feature: GYAE6OF01AZOWX.49.61.F06.1.454.CMB.1.raw
  modified_base (125)..(125): a, c, t, g, unknown or other
  misc_feature (125)..(125): n is a, c, g, or t
tcagagtcgagagacacgaccggtgctcgatttagctacgctctaagggaaagggctggccctgacgtgtttctgttcccgccctcctctctctcgactctgagcgggctggcaaggcgcatagn

SEQ ID NO: 131116 - DNA, 127 bp, Homo sapiens
  misc_feature: GYAE6OF01BLBPB.49.61.F06.1.454.CMB.1.raw
  modified_base (125)..(127): a, c, t, g, unknown or other
  misc_feature (125)..(127): n is a, c, g, or t
tcagagtcgagagacacgaccggtgctcgatttagctacgctctaagggaaagggctggccctgacgtgtttctgttcccaccctcctctctctcgactctgagcgggctggcaaggcgcatagnnn

SEQ ID NO: 131117 - DNA, 125 bp, Homo sapiens
  misc_feature: GYAE6OF01AW0OG.49.61.F06.1.454.CMB.1.raw
  modified_base (125)..(125): a, c, t, g, unknown or other
  misc_feature (125)..(125): n is a, c, g, or t
tcagagtcgagagacacgaccggtgctcgatttagctacgctctaagggaaagggctggccctgacgtgtttctgttcccaccctcctctctctcgactctgagcgggctggcaaggcgcatagn

SEQ ID NO: 131118 - DNA, 143 bp, Homo sapiens
  misc_feature: GYAE6OF01BXYJD.49.61.F06.1.454.CMB.1.raw
  modified_base (125)..(143): a, c, t, g, unknown or other
  misc_feature (125)..(143): n is a, c, g, or t
tcagagtcgagagacacgaccggtgctcgatttagctacgctctaagggaaagggctggccctgacgtgtttctgttcccgccctcctctctctcgactctgagcgggctggcaaggcgcatagnnnnnnnnnnnnnnnnnnn

SEQ ID NO: 131119 - DNA, 124 bp, Homo sapiens
  misc_feature: GYAE6OF01CM7VB.49.61.F06.1.454.CMB.1.raw
  modified_base (119)..(119): a, c, t, g, unknown or other
  misc_feature (119)..(119): n is a, c, g, or t
tcagagtcgagagacacgaccggtgctcgatttagctacgctctaagggaaagggctggccctgacgtgtttctgttcccaccctcctctctctcgactctgagcgggctggcaaggcncatag

SEQ ID NO: 131120 - DNA, 161 bp, Homo sapiens
  misc_feature: GYAE6OF02F5S6A.49.61.F06.1.454.CMB.1.raw
  modified_base (124)..(161): a, c, t, g, unknown or other
  misc_feature (124)..(161): n is a, c, g, or t
tcagagtcgagagacacgaccggtgctcgatttagctacgctctaagggaaagggctggccctgacgtgtttctgttcccgcctcctctctctcgactctgagcgggctggcaaggcgcatagnnnnnnnnnnnnnnnnnnnnnnnnnnnnnnnnnnnnnn

SEQ ID NO: 131121 - DNA, 128 bp, Homo sapiens
  misc_feature: GYAE6OF02GF7B0.49.61.F06.1.454.CMB.1.raw
  modified_base (125)..(128): a, c, t, g, unknown or other
  misc_feature (125)..(128): n is a, c, g, or t
tcagagtcgagagacacgaccggtgctcgatttagctacgctctaagggaaagggctggccctgacgtgtttctgttcccgccctcctctctctcgactctgagcgggctggcaaggcgcatagnnnn

SEQ ID NO: 131122 - DNA, 126 bp, Homo sapiens
  misc_feature: GYAE6OF02IYBN0.49.61.F06.1.454.CMB.1.raw
  modified_base (125)..(126): a, c, t, g, unknown or other
  misc_feature (125)..(126): n is a, c, g, or t
tcagagtcgagagacacgaccggtgctcgatttagctacgctctaagggaaagggctggccctgacgtgtttctgttcccaccctcctctctctcgactctgagcgggctggcaaggcgcatagnn

SEQ ID NO: 131123 - DNA, 127 bp, Homo sapiens; identical to SEQ ID NO: 131116
  misc_feature: GYAE6OF02GU9DD.49.61.F06.1.454.CMB.1.raw
  modified_base (125)..(127): a, c, t, g, unknown or other
  misc_feature (125)..(127): n is a, c, g, or t

SEQ ID NO: 131124 - DNA, 112 bp, Homo sapiens
  misc_feature: GYAE6OF02F8GZK.49.61.F06.1.454.CMB.1.raw
  modified_base (111)..(112): a, c, t, g, unknown or other
  misc_feature (111)..(112): n is a, c, g, or t
tcagagtcgagagacacgaccggtgctcgatttagctacgctctaagggaaagggttcctgttcccaccctcctctctctcgactctgagcgggctggcaaggcgcatagnn

SEQ ID NO: 131125 - DNA, 622 bp, Homo sapiens
  misc_feature: GYAE6OF01BE414.13.65.F10.1.454.CMB.1.raw
  modified_base (315)..(315): a, c, t, g, unknown or other
  misc_feature (315)..(315): n is a, c, g, or t
  modified_base (496)..(496): a, c, t, g, unknown or other
  misc_feature (496)..(496): n is a, c, g, or t
tcagtcacgtactacacgaccggtgctcgatttagctacgctctaagggggggagaggagcccagcactgggattccgaggtatttccattcggtgatcagcactgaacacagaggactcaccatggagttttggctgagctgggttttccttattactattttaaaaggtgtccagtgtgaggtgcagttggtggagtcgtgggaggaggcttggtccgaggcccgggggggtccctgagactctcatgtgcggcctctgggctcaccgtcaacaccaactacatgagctgggtccgcaggctccgagggaagnggccggagtgggtctcgagttatttagtgtcgacggtcgccactattctacgcagacctcggtggacgggggtcccgttcaccatcctaccgagagaccaattccaagaacacggtgtatcttacaaatcgaacgacctgagagtcgaggacacggcctactattacgtgtagacgaaagngtgacgaggaacggacgggtacccccgtaaggtcggggtacccgtggggtagggttacgggtttcgtttcgtttaggaccgtggtcccgggtagggggtcccgtaacggggtaccccgttccgggg

SEQ ID NO: 131126 - DNA, 570 bp, Homo sapiens
  misc_feature: GYAE6OF01EH3Y9.13.65.F10.1.454.CMB.1.raw
  modified_base (289)..(289): a, c, t, g, unknown or other
  misc_feature (289)..(289): n is a, c, g, or t
  modified_base (360)..(360): a, c, t, g, unknown or other
  misc_feature (360)..(360): n is a, c, g, or t
  modified_base (401)..(401): a, c, t, g, unknown or other
  misc_feature (401)..(401): n is a, c, g, or t
tcagtcacgtactacacgaccggtgctcgatttagctacgctctaagggggggagaggagcccagcactgggattccgaggtatttccattcggtgatcagcactgaacacagaggactcaccatggagttttggctgagcgtggtttcgtgtaggctatttaaaggtgccagtgtgaggtgcagctggtggagtctggaggaggcttgatccagcctggggggtccctgagctctcctgtgcagcctctgggttcacgtcagtcacacctacatgacgctgggtcccnccagggctccgaggggaaggggctgggagtgcgtcttcttttatttagtagtagtgtagtacatactccgnacgactccggtgacggggccaattccaccatcgtccagganaacattaccgaaagaacacgcttcgtttactacaaatcgaacagcctgagacgccgatcgaacgacggccttagtattactggtgacgagtagaggtcggggacccaacggttaacgttactacgacttaggtcggacgtcggtcggggaaccacgggtacctaccggg

SEQ ID NO: 131127 - DNA, 532 bp, Homo sapiens
  misc_feature: GYAE6OF01BGRDW.13.65.F10.1.454.CMB.1.raw
  modified_base (525)..(525): a, c, t, g, unknown or other
  misc_feature (525)..(525): n is a, c, g, or t
tcagtcacgtactacacgaccggtgctcgatttagctacgctctaaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtggatcagttgttacaacggtgacacagactttgcacagaagtttgagggcagagtcaccctgaccacagacacatccgcgaacacagcctacatggaactgagaatctgacatctgacgacacgccatatattactgtgcgagtaaggtacggttttgggcgcggactccgtcttgagagtcgtgggcgcggggacagtggtcaccgtctcttcgngtacccg

SEQ ID NO: 131128 - DNA, 565 bp, Homo sapiens
  misc_feature: GYAE6OF01EQT4S.13.65.F10.1.454.CMB.1.raw
  modified_base (294)..(294): a, c, t, g, unknown or other
  misc_feature (294)..(294): n is a, c, g, or t
tcagtcacgtactacacgaccggtgctcgatttagctacgctctaagggggggagaggagcccagcactgggattccgaggtatttccattcggtgatcagcactgaacacagaggactcaccatggagttttggctgagctgggttttccttattactattttaaaaggtgtccagtgtgaggtgcagttggtggagtctggaggaggcttggtccaggccgggggggtccctgagactctcatgtgcggcctctgggctcaccgtcaacaccaactacatgagctgggtccnccaggctccgagggagaggccggagtggggtctcagttatttatgtcgacggtgccacattctacgcagactccgtgaggggccgttcaccatcctccagagacaattccaagaacacggtgtatcttacaaatgaacgacctgagagtcgaggacacggccgtctattactgtgacgaaagatgcagagacgggaccccgtaagtcggggccgtgggtgggtagggttcttacgtttgacttcggacgtggggccgagggacccgtcggg

SEQ ID NO: 131129 - DNA, 623 bp, Homo sapiens
  misc_feature: GYAE6OF01AFIIW.13.65.F10.1.454.CMB.1.raw
tcagtcacgtactacacgaccggtgctcgatttagctacgctctaagggggggagaggagcccagcactgggattccgaggtatttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcattctttgatgattatgccatgcacgtcggggtccggcaacgcctccggaggggaacgggccgtgggaggtgggtctcgtaggttagttaggttaggtaattaggtaggtaacagtaggctagtggcggtactcgtggtaggaacgggccgtattaccacctatcctaccgaggacgaccaaccgacccgaagtaaccccttccgtagtactcgacgaacaagtcgaacgtagttcagaggacgtacgtaggacggacctacgggtcctttagttacttcgtaggtacgtaacgtaaacggttcctaagtttcgcgtaaggtcggtccgttcggtccccttacgtttacttcggtaccgg

SEQ ID NO: 131130 - DNA, 569 bp, Homo sapiens
  misc_feature: GYAE6OF01DTWF7.13.65.F10.1.454.CMB.1.raw
tcagtcacgtactacacgaccggtgctcgatttagctacgctctaagggggggagaggagcccagcactgggattccgaggtatttccattcggtgatcagcactgaacacagaggactcaccatggagttttggctgagctgggttttccttattactattttaaaaggtgtccagtgtgaggtgcagttggtggagtctggaggaggcttggtccaggccgggggggtccctgagactctcatgtgcggcctctgggctcaccgtcaacaccaactacatgagctgggtccgccaggctccaggggaagagggccggagtggggtctcgagtttatttatgtcgacggtgccacattcacgcagacctccggtggacggggccgttcacctatcctccagacgacaattccaagaacacggtgtatcttacaaatagaacgactgagagtcgaggacacggccgtactacttactgtgacgaagatgcgagaggacgggccccgtaagtcggggcgtgggtgggagggttcttcgttgactggcgtggggccagggtacccgtcggg

SEQ ID NO: 131131 - DNA, 569 bp, Homo sapiens
  misc_feature: GYAE6OF01A7V1D.13.65.F10.1.454.CMB.1.raw
  modified_base (482)..(482): a, c, t, g, unknown or other
  misc_feature (482)..(482): n is a, c, g, or t
  modified_base (485)..(485): a, c, t, g, unknown or other
  misc_feature (485)..(485): n is a, c, g, or t
tcagtcacgtactacacgaccggtgctcgatttagctacgctctaagggggggagaggagcccagcactgggattccgaggtatttccattcggtgatcagcactgaacacagaggactcaccatggagttttggctgagctgggttttccttattactattttaaaaggtgtccagtgtgaggtgcagttggtggagtctggaggaggcttggtccaggccgggggggtccctgagactctcatgtgcggcctctgggctcaccgtcaacaccaactacatgagctgggtccgccaggctccgagggaagaggccggagtgggtctcgagttatttatgtcgacggtgccacattctacgcagactccgtggacggggccggttcaccgatcctccaggagacaattccaagaacacggtgtatcttacaaatgaacgacctgagagtcgaggacacggccgtctattactgtgacgaagntgnagacggacgggccccgtaagtcggggcccgtgggtgggagggtttcttcgttgacgtgcgtggggccaggggtaccccgtcggg

SEQ ID NO: 131132 - DNA, 646 bp, Homo sapiens
  misc_feature: GYAE6OF01CSF92.13.65.F10.1.454.CMB.1.raw
  modified_base (391)..(391): a, c, t, g, unknown or other
  misc_feature (391)..(391): n is a, c, g, or t
tcagtcacgtactacacgaccggtgctcgatttagctacgctctaagggggggagaggagcccagcactgggattccgaggtatttccattcggtgatcagcactgaacacagaggactcaccatggagttttggctgagctgggtttccttattactatttaaaggtgtccagtgtgaggtgcagttggtggagtctgggaggaggtcttggtccaggccgggggggtccctgagactctcatgtgcggcctcgtgggctcgaccgtcaacaccaactacatcgagcgtgggtcccgccgaggccaccgaggggaaggacgggccggaggtgggtcctcgtagtttatttagtgtcgacggtcgaccacattcgtacgcagaccgtcggnggacgggtccgtcacgactctccagacgacaacttaccgaagaactacgtctcgtttactacaaatcgaacgtacgccgtagagacgaccgtagacgacgaccgggtccgtagttattacgtggtagaccggtaggacgacggtacggggaccctaacgggtaaacgttaccgtaccggtctaaggtcggtacggtccgggtacgggggtaacccgaaacggggacccacgggtacccgtaccgtcccgtccccg

SEQ ID NO: 131133 - DNA, 876 bp, Homo sapiens
  misc_feature: GYAE6OF01AZ4TR.13.65.F10.1.454.CMB.1.raw
tcagtcacgtactacacgaccggtgctcgatttagctacgctctaaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagagcctggggcctcagtgcaggtcgcctgcagggcctcgtggttactactttttcgactaacgttttggcctattcgtacgtggggtcgcgacgacggtccctggccgacggcttgagtcgcggtggggtgactcgagtttcgtaacgaacggttgaaccacgtagtacttgacctaacgtaaggtaacggtttaggacgggtaccaaggtacgtacccgtaacccgtacgaacccgtaacaacggaccctaacgaccgttacccggaaccggtaaacaaccgtacgtaccccgtaagaacggttacggaaaccgttacgggaaacgggtaacttaccggtaagaaccgtaacgttaccgtaacgggaaacccgtaacccggtaaccggtaacccttaaacttaaccgtttaaaccgtttaacgtttcggggtaacggtaccgggttaaacggggttaaaccggggttttaacgggggttttttccgggggaacccgggttaccgggttaccccgtttaccggttacgtttaacgggtaaccggttaaccgggttacccggggttacgggggtaaccccggggttaaacggggaaacccgttaaacgggtttccgggttaaccccggttaaccccggtttccgtttacccggtttaccgaaccccgggttaaccccccgg

SEQ ID NO: 131134 - DNA, 644 bp, Homo sapiens
  misc_feature: GYAE6OF01DFT53.13.65.F10.1.454.CMB.1.raw
  modified_base (212)..(212): a, c, t, g, unknown or other
  misc_feature (212)..(212): n is a, c, g, or t
  modified_base (387)..(387): a, c, t, g, unknown or other
  misc_feature (387)..(387): n is a, c, g, or t
tcagtcacgtactacacgaccggtgctcgatttagctacgctctaaggggacccaaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctnagtgcaggtcgcctgcagggcctctggttacattttcgactaactttggcatctactgggtgcgacaggcccctggcccacggccttgagtcgcgtggggtgatcgagttgttacgaacggtgacacagtactttgacacgagaagtttgaggtcagacgtcaccctgacccaanacgacacatcccgacgaaacacacgacctactagtacggaactagaacggtaatactaggaacatacctaggaccgaacgaccggaccctaagttaactaactttacgtacgtgtacgaaggtaagggttacgggttttggggccggtacggtaccgttccgtcgttagacgtacgttcggtaccggggtaccggaaggggtaaccgtaggtacggttacctaacccggttccttccgttccgaccgttacccccgg

SEQ ID NO: 131135 - DNA, 589 bp, Homo sapiens
  misc_feature: GYAE6OF01CD7XL.13.65.F10.1.454.CMB.1.raw
  modified_base (313)..(313): a, c, t, g, unknown or other
  misc_feature (313)..(313): n is a, c, g, or t
  modified_base (354)..(354): a, c, t, g, unknown or other
  misc_feature (354)..(354): n is a, c, g, or t
tcagtcacgtactacacgaccggtgctcgatttagctacgctctaagggggggagaggagcccagcactgggattccgaggtatttccattcggtgatcagcactgaacacagaggactcaccatggagttttggctgagctgggttttccttattactattttaaaaggtgtccagtgtgaggtgcagttggtggagtctggaggaggcttggtccaggccgggggggtccctgagactctcatgtgcggcctcgtgggctcaccgtcaacaccaactacatgagctgggtccgccaggctccgagggaagnggccggagtgggtctcgagttatttatgtcgacggtgccanattcacgcagactccgtggaggggcccgttcaccatctccagagacaattccaagaacacggtgtatcttacaaatgaacgactgagagtcgaggacacggccgtctattactgtgacgaaagatgacagaggacgggccccgtaaggtcggggtaccgtgggttgggtagggtttccgtttcgtttggtaccgttggccggttggggacccgtacggggtaaccccgttccggg

SEQ ID NO: 131136 - DNA, 624 bp, Homo sapiens
  misc_feature: GYAE6OF01B4YBC.13.65.F10.1.454.CMB.1.raw
tcagtcacgtactacacgaccggtgctcgatttagctacgctctaaggggacccaaaaaaccacaccccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgactaactttggcatctacgtgggtgcgacaggcccctggccacggccttgagtcgctggggtgatcgagttgttacaacggtgacacagactttgcacgagtaagtttgagggcagagtcacccgtgaccagagacacatccgcgaaacacagaccctaacagtacggaactagaacggtaatacgtagaactagtactagacgaacaccgggaccaatattaactactgtagacgtaggtaacgggttacggggttttacggggccgtacgggtacctcccgttacgttggaagtacgttcgggtacggggaccggtacggggacgtaaggtacggtaccgtacccgttacttccgttacgcggtacccccg

SEQ ID NO: 131137 - DNA, 601 bp, Homo sapiens
  misc_feature: GYAE6OF01AG0QW.13.65.F10.1.454.CMB.1.raw
  modified_base (386)..(386): a, c, t, g, unknown or other
  misc_feature (386)..(386): n is a, c, g, or t
  modified_base (393)..(393): a, c, t, g, unknown or other
  misc_feature (393)..(393): n is a, c, g, or t
tcagtcacgtactacacgaccggtgctcgatttagctacgctctaaggggacccaaaaaccacacccctccttgggagaatcccgtagatcacagctcctcaccatggactggacctggagcatcctttttcttggtggcagcggcaacaggtgtccaccctgaggttcagttggttcagtctggaggaggggtgaagaagccgtggggcctcagtgcaggtcgcctgcagggcctcgtggttactattttcgactaactttggcatctacgtggggtgcgacacggcccctggcccacggccttgagtcgcgtgggggtgatcgagttgttacaacggtgacacagactttgcagagtaagtttgagggcaggagtccacccgtnacccacngaccacatccgaccaacacacggcctacagtacggaactagaaggaatcgtagactatccgtagaccgaccgaccggaccattatattactgtacgacggagtaagggttacgggttttggggcgacggtcgtccgttcgttggtagacgtcggtcggggacggaggggacgtaagttcggtaccaccgttctccttcgcgtaccccg

SEQ ID NO: 131138 - DNA, 699 bp, Homo sapiens
  misc_feature: GYAE6OF01CNKIA.13.65.F10.1.454.CMB.1.raw
  modified_base (411)..(411): a, c, t, g, unknown or other
  misc_feature (411)..(411): n is a, c, g, or t
tcagtcacgtactacacgaccggtgctcgatttagctacgctctaaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagccgtggggcctcagtgcgaggtcgcctgcagggcctcgtggttactatttttacgaactaacgtttggactattcgtacgtgggtgcgtacgacggccccgtggcccacggtccttgacggtccgcgtggggtggacttcgagtttcgtaacgtacggtcgacacgagtacttgacacgagtaagttggaggcagacgtcacctcgacacnacacacgtccgacgaacaccgacgacctaacgtaacgtacggaaaccgttaggaacggtaacttccgtaagtaaaccaggttaccgtacggaaaccgaccgtaaccggtacctaactaatttaacgttaacgtggtacggaacggtaagggtaaacggggttccggggttttagggacccggtacggttaccgtccgttacgttaggaacgtcggttcgggtacgggtacggtaagggaaccttagtaccgggtcctaccggttccttcccgtagaaccccgtccccg

SEQ ID NO: 131139 - DNA, 611 bp, Homo sapiens
  misc_feature: GYAE6OF01ELS7E.13.65.F10.1.454.CMB.1.raw
  modified_base (298)..(298): a, c, t, g, unknown or other
  misc_feature (298)..(298): n is a, c, g, or t
tcagtcacgtactacacgaccggtgctcgatttagctacgctctaagggggggagaggagcccagcactgggattccgaggtattttccattcggtgatcagcactgaacacagaggactcaccatggagttttggctgagctgggttttccttattactattttaaaaggtgtccagtgtgaggtgcagttggtggagtctggaggaggcttggtccaggccgggggggtccctgagactctcatgtgcggcctcgtgggctcgaccgtcaacaccaactacatgagcgtgggtccncaggctccgagggaagaggccggaggtggggtctcgaactagttagtgcttaggtggtcgacccaaccactactactaccgcaagtacctccggtaggaacgggccctattacccacctactcctaccaaggtacgaactaacttaccgaaacgaacgacgtctagtatctacgacaaatcgaacacgcctagagacgacgaggaccacggtactatacttagtagtcgaacgtaagtaacctttacccgtattacgtttcgacgtacggtcgggactacgggaccctggtaccaccgtcctccgcgtacccg

SEQ ID NO: 131140 - DNA, 593 bp, Homo sapiens
  misc_feature: GYAE6OF01B1Q3H.13.65.F10.1.454.CMB.1.raw
tcagtcacgtactacacgaccggtgctcgatttagctacgctctaaggggacccaaaaaaccacacccctccttgggagaatcccgtagatcacagctcctcaccatggactggacctggagcatcctttttcttggtggcagcggcaacaggtgtccaccctgaggttcagttggttcagtctggaggaggggtgaagaagccgtggggcctcagtgcaggtcgcctgcagggcctcgtggttactattttcgactaacgtttgctatctacgtgggtgcgacacggcccctggccacggccttgagtcgcgtggggtgactcaggttcgttacgaacggtgacacgagtactttgcacagtaaggtttgagggcagacgtcacccgtagaccacagacacatccgacgaacacacgcctacatacggactgagatctagacatctcgacgacgacgacatatattacgtgtgacgagtaaggttacgggttttcgggcgtacggtacctccgttcgttcgacgtagtcggtacgggaccggacggggacgtaaggttcggtaccgtaccgtcttccttcgtacgtaccccg

SEQ ID NO: 131141 - DNA, 730 bp, Homo sapiens
  misc_feature: GYAE6OF01CXLLH.13.65.F10.1.454.CMB.1.raw
tcagtcacgtactacacgaccggtgctcgatttagctacgctctaagggggggagaggagcccagcactgggattccgaggtatttccattcggtgatcagcactgaacacagaggactcaccatggagttttggctgagcgttgggttttccttatttacttaatttttaaaaggtgtccagtgtgaggtgctaggttggtggagtcgtgggaggaggtcttggtccgagggcccgggggggtccctgagactctcagtgtcgcggcctcgtgggctcaccgtcaaccaaccaacaacatgagcgtcgggtcccgaccgacggtcctaccgaagggaacggacgggaccggtaggttcgggtcctacgtagttttaacgtttagtcggtacgacgggtcgaccctactacttcacgcagaccgttccggtaggaccgggggtcccgttacaaccgtactcctaccgaaggacgaaactaacgttaccgaaagtaaccgacggttacgttactacgtaactaaagtacgaacgacctggaacgagtacgaggaccgtaccggcgttactaacttacgtgtaagacgaaagagtacgacggtacgacgggacccgggtaccccgtaaaggggtccgggtaccggttggggtacgggttacgggtttcctttacggtttcggtacgtcgggttcggtacggggaacccgtaccggggttacccgttaccggg

SEQ ID NO: 131142 - DNA, 735 bp, Homo sapiens
  misc_feature: GYAE6OF01AOWY3.13.65.F10.1.454.CMB.1.raw
  modified_base (702)..(702): a, c, t, g, unknown or other
  misc_feature (702)..(702): n is a, c, g, or t
tcagtcacgtactacacgaccggtgctcgatttagctacgctctaaggggacccaaaaaccacacccctccttgggagaatcccgtagatcacagctcctcaccatggactggacctggagcatcctttttcttggtggcagcggcaacaggtgtccaccctgaggttcagttggttcagtctggaggaggggtgaaggaagccgtggggcctcgagtgcaggtcgcctgcagggcctctggttacattttcgactaactttggcatctacgtgggtgcgacacggcccctggccacggtccttggacgtcggccgtgggggtgtacgtcgtaggtttcgttaacgaacggttgaacctacgacggtacctttgactaacgtaaggtaagtttgggagggcgaaggtacgtaccgtaaccccgtaggaacccacgaacgaaccaccgtacgtacccggacggaaaccaccgaacgtaccctaacgtacgtaacggaaccgtaggaaggtaactacctagactactacgtacggaccgtaaccgacggtacctaagttaacttagtttaccgttaggtacggacggtaagggtaacgggtttacggggttttcggggaccggtaccggtaacccttcgttacggttacggacggtagtcgggttaccgggggaccggtaggggtaccgtaaggcgggttaccnccggttcgttaccgttccgtaccggtacccccg

SEQ ID NO: 131143 - DNA, 823 bp, Homo sapiens
  misc_feature: GYAE6OF01A4QUO.13.65.F10.1.454.CMB.1.raw
  modified_base (307)..(307): a, c, t, g, unknown or other
  misc_feature (307)..(307): n is a, c, g, or t
tcagtcacgtactacacgaccggtgctcgatttagctacgctctaaggggggggagaggagcccagcactgggattccgaggtatttccattcggtgatcagcactgaacacagaggactcaccatggagttttggctgagctgggttttccttattactattttaaaaggtgtccagtgtgaggtgctagttggtggagtctgggaggaggtcttgggtccgaggcccggggggggtcctggagactctcatgtgcggcctcgtgggctcaccgtcaaccaccaactacatggagctacgggtccnccgaggctccgagggaaggagggccggagtcgggtctcgtagtttatttatggtcgacggtcgcccaatacttaccgtacgccgaagaccgttccggtacgggacgggggtccccgtttacgaacccgtactacccgtaccgaacggtaacggtaacctaaaccgtttaaccccaaaacggtaaccgtaaaccgggttcgttaacgtttacccgtttaacgtaaaacgtttaccggaaacccggtaacccgtagggtaacgggtaaggtaccgggaacgggtaacccggtacccgggtacccggttttaccgttaacgtttaaccggttggttaaccggaacgggtaaaacgtacgttacggaacggtacgggaacgggaacccggggtacccccggttaaagggtccgggggtacccgtgggggttacgggttacggggttttccttttacgggttttacgacgttcgggtccggtaccggggacccggtacccggggtaacccgttccccgggg

SEQ ID NO: 131144 - DNA, 849 bp, Homo sapiens
  misc_feature: GYAE6OF01ACU8Z.13.65.F10.1.454.CMB.1.raw
tcagtcacgtactacacgaccggtgctcgatttagctacgctctaaggggacccaaaaaccacacccctccttgggagaatcccgtagatcacagctcctcaccatggactggaccctggagcacttcctttttcgttgggtggcacggcggaccaacgaggtcgtacccacccgtgtaggttctaggtttggttccaggttcgtagggagggaggggtgaacggacgccgtcggggcctcgaggtcgcgacgggtcgccgtcggacggacgggtcccttcgttacggtttacttacgttttaccgacgttaacgtttcggactacgttctacggtggcgacgacgaggtcctccgtcggacctacgggtccttagacggtccgtcgggtgggtacgtactcgtagttacggtaaccggtacggtacgtaccgacgtactacgtttacgctaacggtaggttagttagggcggacgtacggacggtacccacccgtacgaaccgaacgaacgaccgaccgtacgtaccccggaccaaaccgaccgaaccgtcccgtaaaccgtggttaaaccggacggtaaacggtaccggtaacgtacgttacgtaacccgtacgtttacccgaaccgggaacccgtacccggaaccgtcgttaaatttacgttaccggttttaacgacggttaccggaaacggggttaccgggttaacgggggttttcggggtttaccgggaccccggtacggttacccgtcggtttacgacgggtaccgtcgggtaccgggtacgggtacggagggttaacccgtggtaccgttaccggttcctacgttccgtacgtacccccggg

SEQ ID NO: 131145 - DNA, 697 bp, Homo sapiens
  misc_feature: GYAE6OF01BVCYD.13.65.F10.1.454.CMB.1.raw
  modified_base (291)..(291): a, c, t, g, unknown or other
  misc_feature (291)..(291): n is a, c, g, or t
  modified_base (353)..(353): a, c, t, g, unknown or other
  misc_feature (353)..(353): n is a, c, g, or t
tcagtcacgtactacacgaccggtgctcgatttagctacgctctaaggggacccaaaaaccacacccctccttgggagaatcccgtagatcacagctcctcaccatggactggacctgggagcattcctttttcttggtggcagcggcaacaggtgtccaccctgaggttcaggttggttcagtctgggagggaggggtgaagaagccgtggggcctgagtgcgaggtcgcctggcagggcctcgtggttactattttcgactacgtttggctatctacgtgggtgcgacncggccctggccacggtcttggacgtcggcgtggggtgacttcgaggtttcgttacgacggtnacactagtctttgaccaggtagtacgttggaggtcgacggtacgtccaacccgtagaccacgaacgaacctaacgactacccggaacgaacctaccgaacgtacccgtaacacggtaggtaaacggttacgaaaggaactacgtagaactagtacgtagaaccgacgacggacctatagtacttagtcgtacgacggtaagggtaacgggttacggggttttacgggcggtaccggtaccgttcgttacgttacggtaggtacgtccggggtacgggacggtacggggtaactaacgggttaccggtcgtaaccccgttcgttacgttcccggacgtaccccgg

SEQ ID NO: 131146 - DNA, 646 bp, Homo sapiens
  misc_feature: GYAE6OF01BVIRN.13.65.F10.1.454.CMB.1.raw
  modified_base (453)..(453): a, c, t, g, unknown or other
  misc_feature (453)..(453): n is a, c, g, or t
tcagtcacgtactacacgaccggtgctcgatttagctacgctctaaggggacccaaaaaaccacacccctccttgggagaatcccgtagatcacagctcctcaccatggactggacctggagcattccttttcttggtggcagcggcaacaggtgtccaccctgaggttcagttggttcagtctggaggaggggtgaagaagccgtggggcctcagtgcaggtcgcctgcgagggcctctggttacattttcgactaactttggcatctacgtgggtgcgacacggcccctggccacggccttgacgtcgcgtggggtgactcaggttgtacgacggtgacacagtctttgcacagtaggtttgagggcagacgtcacccgtcgaccacgacacacacgccgacaacgacacgacctaacataggaactagaacggtaatctagaactacgtntacgaccgaccgacgacctaatactattacgtgtacggacgtaggtaacgggttacgggttttacggggcggtaccggtaccgtcccgttcgttacgaacgttcgtcggttacggggaccggtacggggtaaaccgtaacggttcgggtaacccgtaccggtttaccttacccgttcgacccggttacccccg

SEQ ID NO: 131147 - DNA, 682 bp, Homo sapiens
  misc_feature: GYAE6OF01C9BWP.13.65.F10.1.454.CMB.1.raw
  modified_base (556)..(556): a, c, t, g, unknown or other
  misc_feature (556)..(556): n is a, c, g, or t
  modified_base (603)..(603): a, c, t, g, unknown or other
  misc_feature (603)..(603): n is a, c, g, or t
  modified_base (609)..(609): a, c, t, g, unknown or other
  misc_feature (609)..(609): n is a, c, g, or t
  modified_base (645)..(645): a, c, t, g, unknown or other
  misc_feature (645)..(645): n is a, c, g, or t
  modified_base (649)..(649): a, c, t, g, unknown or other
  misc_feature (649)..(649): n is a, c, g, or t
  modified_base (651)..(682): a, c, t, g, unknown or other
  misc_feature (651)..(682): n is a, c, g, or t
tcagtcacgtactacacgaccggtgctcgatttagctacgctctaaagggaaagggactagagtgggtctcagatattagtggtagtggtggtagcacatctcatgtagacctccgtgaagggccggttcaccatctccagagacaattccaaagaacacgatgacttctgacaaatgaaaccgacgcctgacggaaggttcggaacgggacccgttccgggttacccctttttaagttaccgttggtaggttaaaggaaaaaacgtaaacccttaaccagttacggaaccggtcccggaccgggggtttaccttttcgaaccgtttacgggtaccggggggaccgtaaggggttaactttcggtaccggtacccgtacccgttcctcccctacgacccgtaccccgtacccgaaaccccgggtaaccgggcccccttacgttacccccggttttcccccttcccccccggtggggtccccctaccccgtgtccccgtaccgacgggacttccccgaaccccgtcggaacacgaccaccgtacggccggtacccgngggtctccgtcggtacgtccgaaagtccttacccttgtacggtacgngtaccngggacgtccggcgtaccgggactacggagtccgaancagngnnnnnnnnnnnnnnnnnnnnnnnnnnnnnnnn

SEQ ID NO: 131148 - DNA, 784 bp, Homo sapiens
  misc_feature: GYAE6OF01B5S22.13.65.F10.1.454.CMB.1.raw
  modified_base (188)..(188): a, c, t, g, unknown or other
  misc_feature (188)..(188): n is a, c, g, or t
tcagtcacgtactacacgaccggtgctcgatttagctacgctctaagggggggagaggagcccagcactgggattccgaggtatttccattcggtgatcagcactgaacacagaggactcacatggagttttggctgagcgttggttttccttattactatttttaaaaggtgtccagtgtgaggtgnagttggtggagtctgggaggaggctttggtccgagggcccgggggggtccctggagacgtctcgatggtggcggcctcgtcgggctacaccgtacaacaccaactacagtgacgcgttagggcccgccgaggtcctaccggaagggggaagacgggccggaggttcggggtctcgaggtttattttagtggtacgacggtgaccacgtactttcgacgcaacgtacgtaccggtagggacggggtccggttaccaaccgaacgttacctaccgaaaggacgtaacctaaaatttacccgaaacggaaccgtaacggttacggttaacttacttaaccgtaaaagttaacggtaaacccgtaaccggttagaacggtaacggtacgggaaacggtaccggaaccgggtaccgttaaccgttaactttacgtagtacggaacggtaaacggtacttagacgtaaggaaccgggtaaccgggacccccggttaaagggtccggggtaccggtacgggggttaggttacgggtttcgtttcggtttacgtacggttcgtaccgggttacggggaccggtaacgggtaacccggttaccgg

SEQ ID NO: 131149 - DNA, 750 bp, Homo sapiens
  misc_feature: GYAE6OF01B5ZWV.13.65.F10.1.454.CMB.1.raw
  modified_base (218)..(218): a, c, t, g, unknown or other
  misc_feature (218)..(218): n is a, c, g, or t
  modified_base (384)..(384): a, c, t, g, unknown or other
  misc_feature (384)..(384): n is a, c, g, or t
  modified_base (535)..(535): a, c, t, g, unknown or other
  misc_feature (535)..(535): n is a, c, g, or t
  modified_base (563)..(563): a, c, t, g, unknown or other
  misc_feature (563)..(563): n is a, c, g, or t
tcagtcacgtactacacgaccggtgctcgatttagctacgctctaagggggggagaggagcccagcactgggattccgaggtatttccattcggtgatcagcactgaacacagaggactcaccatggtagtttggctgagcgttgggttttccttattacgttaagttttaaaggtgtccgagtgtgaggttgcgtagttggtggagtcgtaggaggnggtcttggtccgaggtccggggggtcctgagactctacatgtcgccgaccttcgtacggtctacctaccgtacgaacacctaacgtacacgtgacgtccggtacgggtccaccgaggtccgaccggaaggggaacggacgggccggtagtcggtctactaagtttnttagtcggtacgtacggtacgcctaactacgtttcgaaccgtcgacgtaccgtacgggtgggaaccggtccggtaccacgtactccgtacgagacgaactaacgtagtaaacgacgtacgtatacgttactactaaagtgaaccgtaccgnggtaagacgtcgtaagccgttacccggntttcgtaacttcggtaccgggtagtaccgtaaagttcgaccgtaacgggacttccgggaaaaccccggtcccgggtaaaggttaccggggtcgttaacgggtttaaccgggtacggtttcgttaccgttagggaaccgttgggttacccgggacccggggtagttaaccccggggttaccgtccggg

SEQ ID NO: 131150 - DNA, 726 bp, Homo sapiens
  misc_feature: GYAE6OF01BEV2H.13.65.F10.1.454.CMB.1.raw
  modified_base (664)..(664): a, c, t, g, unknown or other
  misc_feature (664)..(664): n is a, c, g, or t
tcagtcacgtactacacgaccggtgctcgatttagctacgctctaagggggggagaggagcccagcactgggattccgaggtatttccattcggtgatcagcactgaacacagaggactcaccatggagtttggctgagctgggttttccttattactattttaaaggtgtccagtgtgaggtgcagctggtagagtcgtgggggaggtggtggtacggccgtgggggtaccctcgagactctcctgtgacaacctctggattcagtatttgatgagtagtggactatacgacgtcgggtcccgaccaaccgtccgaaggggaacggggctacggctaggttggggtcctcgttaggtaacgttaaaacgtggtaagtcgggtacgccgtaacggacctaacgtaacttagtcgacgtaacgtacgtcgtacggtacgggaaccggggtcccgtaacgttaccaaccctacgttacccgtaccgaaggacgtaactcggtacgacccgaaagtacccgttccaacattctacgaaacctaagtacgaactcggtaccgtaggaacggtcgaacggacgtaccggttaccttggtttactttcggtcggtacgggacgttagggttacgacggttacgggtggttaccgttaggttcctaacggngtaaacggggtttccggacgggtttacggggaccggggtaaccgttaaacccggggacccgg

SEQ ID NO: 131151 - DNA, 845 bp, Homo sapiens
  misc_feature: GYAE6OF01ESWKM.13.65.F10.1.454.CMB.1.raw
tcagtcacgtactacacgaccggtgctcgatttagctacgctctaagggggggagaggagcccagcactgggattccgaggtatttccattcggtgatcagcactgaacacagaggactcaccatggtagttttggctgagtcgttgggtttttccttaattacttaagttttaaaaggtgtccgagtgtgaggtgctaggttggtggtagtcgtgggagggtaggtcgttcgggtccggacggggtccccgggggggtccctaggacgtacttccgtctagttggtcggccggtccgtcggtcgggtcctccgtaaccccggtaccaaaccaacccgaaacctactacgtaggacggtccggtacgggtcccgaccgtacggccgtaccggaagggggaacggcggggaccggggtagggttcggggttctacgttaaggttttatttaggttggtaccggacggtcaccgtactacgttaccgacgactacgtaaccgttccggggtaggtcccgggtaccgttcaacctcgtacacgaacgaacgtactaacgttaccgaaagtaccgtacggtataccttacgtaactaaacgtacgaaacgtcgtaagaacggtacggtacggaacccggacgttacccggtaccgttttacgagtttaaccggtaggtacgaaacggtaaagtcgtacgtaacgggacggtaacggacccggggttaacccgtaggggcccggggttaaggtccggggttagggtttaaccggtttttctaccgggtttaggtacggttcgggtaccgggtacccggggacccggtttaaacggtcccccgggttaccg

SEQ ID NO: 131152 - DNA, 962 bp, Homo sapiens
  misc_feature: GYAE6OF01DTC4B.13.65.F10.1.454.CMB.1.raw
tcagtcacgtactacacgaccggtgctcgatttagctacgctctaagggacccaaaaaaccacacccctccttgggagaatcccgtagatcacagctcctcaccatggactggacctggagcattccttttcttggtggcagcggcaacgaggtcgtccaccctgaggttcagtttggtcagtctgggaggagggtgaagacgccgtgggcctcgagtcgcgtaggtccgccgtcgcgacgggtccttcgttacggttactacgtttttccgaaccttaacgtttcggactacgttaccgttacggtcggggtcgaccggaaccgaccgggtacccccgttacggggacccgtacccggttacccgtttacggggacggttccgggtacgggttcgggggggtagtaacgttacggtttaacggttttacggtttaaaccggtaaaccgggtacggtaacccgtaaccgtaacggtttaaccgttttacggaacctaaacggttaaaggttaaacgggtttagggaacgggtacgtaacggtaaccggtacccgtaaccccgtacgaacccgtaacgaaacggaacctaaccgtacgaccccggaaaccgaaaccgtaaccgtaacccggacccttaaacggtaaccggtaacgggaacggttaacggtaaacgtaaacgttcgtaaccgtacgtaacgttaccgtaacggtaacccggaaccgtaaccggacccttaaattaacgttacgttttaacgcgggttaccggaacgggttaacggggtttaagggtttaccgggggttttcggggaacccgttaccgggttaccgtttcccggtaggttaacggtacggttaccggttccggggtacggggtaacccgggtaacggggtaacctacggggttaccggttacccgttacccgttagtttccccgtaacgtcccggtaacccccgg

SEQ ID NO: 131153 - DNA, 724 bp, Homo sapiens
  misc_feature: GYAE6OF01A1MSU.13.65.F10.1.454.CMB.1.raw
  modified_base (344)..(344): a, c, t, g, unknown or other
  misc_feature (344)..(344): n is a, c, g, or t
  modified_base (370)..(370): a, c, t, g, unknown or other
  misc_feature (370)..(370): n is a, c, g, or t
tcagtcacgtactacacgaccggtgctcgatttagctacgctctaaggggacccaaaaaccacacccctccttgggagaatcccgtagatcacagctcctcaccatggactggacctggagcattcctttttcttggtggcagcggcaacaggtgtccaccctgaggttcagttggttcagtctggaggaggggtgaagagccgtggggcctcgagtgcaggtcgcctggcagggcctcgtggttacagttttcgactaactttggcatctacgtgggtgacgacacggccctggccacggccttgagtcgcgtggggtgatcgagttgtacgaacggtgacanagtacttgcagagtagttggacgganagtacgtcctaacctcggaaccacgtaacgacacgtacctaccgaacgaaacacgaacgtcctaacagtacggaactaggaacggtaatcgtaagaactactcgtacggaaccgtaaccgaacccggtaactaactttaacgtaacgtttaaccgtagggtacgtaacgggtaaagggtaacggggttaacggggtttttacggggaaccggtaccgggtaacccgttccgttacgttacgggaacgtacggttaccgggtacggggtaaccggtaacgggggtaaacctaacggttacgggttacccgtaacccgggtttacctaccgttaacccggtccggttaacccccgg

SEQ ID NO: 131154 - DNA, 849 bp, Homo sapiens
  misc_feature: GYAE6OF01EOQ6T.13.65.F10.1.454.CMB.1.raw
tcagtcacgtactacacgaccggtgctcgatttagctacgctctaaggggggagaggagcccagcactggattccgaggtatttccattcggtgatcagcactgaacacagaggactcaccatggagttttggctgagtcttgggttttccttattacgttaattttaaaggtgtccagtgtagaggtgcgtagttggtggaggtcgtgggaggtaggtcgttacggtaccggacggggcccggggggttacctggaacgtcctcgtacgtagttcgtcgccggtccttacggtcggcctaccgtaccggacaacctaaccaaccttaacagtacgcggtccgtccggtccacgacggacgtaccggaagggacgcggcggtagtcggtacctagttagttaacgtttctcgggtaccgtcgtacgtacccagttaccttaaccgcggaacgtacggtacctcccggggtgggtaaccggggtcccttaaccacgttaactacccgtactaggtaacgtacgtaaccgttaaccgaagtaaccgtacgggttacttacgttacgttaactaacgtaccggtaacgtaccgtacgggaacgttacggaccgggaaaccggtaccgtacgggttaccttaaccggttaacgttacggttacggaacgttaacccgggtaagttaacggcgaacggtaaacgggtaccgggtaacccggtaaccggtacgggttaccgggtacgggttcgggttaccggggttttaccggttcgtttacgggttacccggttaccgggtttacgggaccgggttacccgggttaaccgggtacccggtttccggtaccccgg

SEQ ID NO: 131155 - DNA, 746 bp, Homo sapiens
  misc_feature: GYAE6OF01ELLHY.13.65.F10.1.454.CMB.1.raw
  modified_base (122)..(122): a, c, t, g, unknown or other
  misc_feature (122)..(122): n is a, c, g, or t
  modified_base (437)..(437): a, c, t, g, unknown or other
  misc_feature (437)..(437): n is a, c, g, or t
  modified_base (571)..(571): a, c, t, g, unknown or other
  misc_feature (571)..(571): n is a, c, g, or t
  modified_base (590)..(590): a, c, t, g, unknown or other
  misc_feature (590)..(590): n is a, c, g, or t
  modified_base (598)..(598): a, c, t, g, unknown or other
  misc_feature (598)..(598): n is a, c, g, or t
tcagtcacgtactacacgaccggtgctcgatttagctacgctctaaggggacccaaaaaaccacacccctcttgggagaatcccgtagatcacagctcctcaccagtggactggacctgganctactttcctttttcgttggtgcgagcggacaacgtggtcgtcccaccgttggacggtttctaggtttcggttcgagttgtgggagggaggggtagaaggtacggcgtcgggcctgtaggtgcgtaggtccgccgtggcgtacggtctcgttagttacttacgtttcgactacgttcgactacgttcgttaccggtggtacgcgaccgaccggtccctcggcccaacggttcgttacgcggtccggtaaggggttgggtacgtaactggtttaggttttacgaacggtacggtcaactacgggtaattcgttacncgaagttaggtttaggacggacggtacctaggaccttacccgccgacgaacgtaacaccggaacaccgtacggaaaccccgttacaacgtaccgtccgtaactacgtagaacggtacgaggttaacgatcgtanatacgtcgacgacgaaccncgtaactnttaacgtcgttagtcggaacggtaggttaacggggttacggttacggggttacgggtccgaccgttacgtaccgtaggttgacggttcgtcgggtaacggcggtaacggtagtaccgtcgtacctcgttactcgttcgcccgttaccg

SEQ ID NO: 131156 - DNA, 703 bp, Homo sapiens
  misc_feature: GYAE6OF01EDW48.13.65.F10.1.454.CMB.1.raw
  modified_base (304)..(304): a, c, t, g, unknown or other
  misc_feature (304)..(304): n is a, c, g, or t
  modified_base (410)..(410): a, c, t, g, unknown or other
  misc_feature (410)..(410): n is a, c, g, or t
  modified_base (688)..(688): a, c, t, g, unknown or other
  misc_feature (688)..(688): n is a, c, g, or t
tcagtcacgtactacacgaccggtgctcgatttagctacgctctaagggggggagaggagcccagcactgggattccgaggtatttccattcggtgatcagcactgaacacagaggactcaccatggagttttggctgagctgggttttccttattactattttaaaaggtgtccagtgtgaggtgctagttggtggagtctgggaggaggcttggtccgagggcccgggggggtccctgagactctcatgtgcggcctcgtggctccaccgtacaacaccaactacatgagtcgtcgggtccnccgaggcctccggaggggaggggctgggagtggcgttcttcttttaatttatagttagtgttagtacatactcgcgagaccgtcgtaggacgggctacttccactntcctaccgaggaacgaactaacttaccgaaagtaacctccgtacttttgttttacccttaacaaagttacgaaaccacggacccttggaaagaccgacccgtagtcgaacggtaccgggtccgttagttaacgtccgttggtacgggtacgaacggaggacccggttacggggaccccctaaaggttaaacccgtttagtaaccccgatttaggggtcccggtaacgggtccggtaccggggggaccctaaaccgggggacctaacccggggttcccnccgttccgtaccccg

SEQ ID NO: 131157 - DNA, 1001 bp, Homo sapiens
  misc_feature: GYAE6OF01EVMDF.13.65.F10.1.454.CMB.1.raw
  modified_base (195)..(195): a, c, t, g, unknown or other
  misc_feature (195)..(195): n is a, c, g, or t
tcagtcacgtactacacgaccggtgctcgatttagctacgctctaagggggggagaggagcccagcactgggattccgaggtatttccattcggtgatcagcactgaacacagaggactcaccatggtaggtttggctgagtcgttgggttttccttattacttaagtttaaaggtcgcccaggtgtgaggtgcngcgtggtggagtcgtgggaggaggtcttgactccgacggccgggtcgggggtacctaggtacgtaccttccgttccgtgtcggacctacgtccgttccggttccgggtaccgtacccggtacgtaaccgtaaccctaacccgtaactacgtacgtacggtccggtaccgggtcccggtccggaccggtaccggtaccgggaacggggggtaacggggggtccgggttaggggtacggtcgggttcccggttttacctttttaccgtttttttaacgttttaagggtttaaggtttaaggggtttaaccggtttaaggttaaccgttaacccgttaacccgttacccggtacccgtaaaccgggtacccgggtttcccggggtaccggggtaaccggggggtacccgtttaccgtaccccgtaccgtaccgttaaccccggttacgaaaccgggtaaaccgttaaacctaaccgtaacccggtaaacgtaaccccgttaacggttaccgttttaccgttttaacccgtaacgttaaaacgttacccggaaacgtttaacccggccggttaaggaccgggtaccgggtaacccgaagttaccggaccggttaacccgggtccgttaacggttttaaccgttaccggttagggtcggaaacggtacgggaacggttacccggggtaacccgggtaacccgtaacccggttaaacggtttaccgaacgttaccgttagggcccggttaaccggggtcggtaaccgggtacccccgggaaagtcccgggtaacccggttcccgtacccccg

SEQ ID NO: 131158 - DNA, 936 bp, Homo sapiens
  misc_feature: GYAE6OF01CII8M.13.65.F10.1.454.CMB.1.raw
  modified_base (700)..(700): a, c, t, g, unknown or other
  misc_feature (700)..(700): n is a, c, g, or t
tcagtcacgtactacacgaccggtgctcgatttagctacgctctaagggggggagaggagcccagcactgggattccgaggtatttccattcggtgatcagcactgaacacagagactcacatggtagtttggctgagtcgttggttttaccttattaacttaagttttaaaggtcgtccgaggtgtgtaggtgcgtaggttgggtggtagtcgtgggagggacggtcgttcgggtccgacggggcccgggggggtcctaggacgactctactaggttcggtcggtccggtcctcgggtcgggtccttaccgaaccgtacaaaccgtacccgtaaactacgacgttacggacgtacgggttccgggtacccggacccggtaaggtcccgacccggggtaaaggggtaaccgggaccgggggtacccgggttaagggttcggggttaccgtaccgtttaaggttttacgttttacggttccgggtacccgtaccggggtactacccggttaccttaaccttccggttacccgaacgtacggttacccgttccccggggtagggtacccgggggttacccgttaaccaacgttacgttacccgtaccgaacggtacgtaaacccgttaacgttaacccggaagtaacccggttaggttaaccgtacttaacgttaaacccgaagtttaaccgaaaccggttntaccggacggagtacccggtacgtacgtacggtacccggtaccggtacgttacgttaacttacggtacggtcgtaaacggacgggttaccgaccggggttacccggaaccggttaaccgttaaacggttaccccggtaaccgtggttacgggtaacggtaccggggtacccgggtacgggaacccggtaacgggtcccggtaaaccgggtcccctaacccgggttccctaacccgg

SEQ ID NO: 131159 - DNA, 719 bp, Homo sapiens
  misc_feature: GYAE6OF01C6B0X.13.65.F10.1.454.CMB.1.raw
  modified_base (183)..(183): a, c, t, g, unknown or other
  misc_feature (183)..(183): n is a, c, g, or t
  modified_base (193)..(193): a, c, t, g, unknown or other
  misc_feature (193)..(193): n is a, c, g, or t
  modified_base (306)..(306): a, c, t, g, unknown or other
  misc_feature (306)..(306): n is a, c, g, or t
  modified_base (561)..(561): a, c, t, g, unknown or other
  misc_feature (561)..(561): n is a, c, g, or t
  modified_base (625)..(625): a, c, t, g, unknown or other
  misc_feature (625)..(625): n is a, c, g, or t
  modified_base (683)..(683): a, c, t, g, unknown or other
  misc_feature (683)..(683): n is a, c, g, or t
  modified_base (700)..(700): a, c, t, g, unknown or other
  misc_feature (700)..(700): n is a, c, g, or t
tcagtcacgtactacacgaccggtgctcgatttagctacgctctaaggggggagaggagcccagcactgggattccgaggtatttccattcggtgatcagcactgaacacagaggactcaccagtggtagttttggctgagtcgttggtttctatactatttaaaggtgtacagtgtgaggtncgtaggttgnggagtcgtagggaggagtcgttggccgaggggcccggggggtcctaggacgacctctacgtagtgtcggccgtccgtcgtcggcctaccgaccgtacaaccactaacatgagngtcgcggtcccgcgacggtccgtacggagggaacgacgggcggtacgtgggttcctagttaagttatttaacggtgtaccggtacgtcgtacctaacgttcgtacctacgacctaacggtcccggttacgggtacggggaaccggggtttccctaacctaccgtacgtttaccccacgggaacggtaacctaaaacttacgtaccccgaaagtaacccggttagtacgtactactaacggtaaagcgtaaaccgngttaacgaaggttcggaccgaaggcccggttacggtctagttacgtacgtgccgaaagtcaggnacgggtacgacggtacccggttgacgggacggttggagggttgtaacgtttggttacnggtacggcgcggggtancccgggtaagtcccggtcg

SEQ ID NO: 131160 - DNA, 890 bp, Homo sapiens
  misc_feature: GYAE6OF01A6Y5H.13.65.F10.1.454.CMB.1.raw
tcagtcacgtactacacgaccggtgctcgatttagctacgctctaagggggggagaggagcccagcactgggattccgaggtatttccattcggtgatcagcactgaacacagaggactcaccatggtagtttggctgagtcgttcgggttttccttattacttaattttaaaaggtgtccagtggtggaggtgcgtaggttgggtggtagtcgtagggaggtggtcgttcgggtccggacggggtcccgggggggtccctggtacgtacctctcgtagtggcggtccggtccgtcggtcgggtcctccgaccgtacaaccaacctaactacagtcggacggtcggtccgggtcccgaccggacggtccggtacggaacggggaacggtaccggggtccggggtagggttcgggtaccgttacgttaagtttacgtttaggttacggtacccgggtacggtccgtaacccttacgtacgtttaccaccgtacgtaccgtacccgttcggggtacggggtccggggttaccccgttacccgtaacctacgttcccgtaacggaacggtaaccgtaaacgttaaccgttaaaccgaaacgtaaaccggtaccggttaagttaacttaacgttaaaccgaaacgtaacggtaaccgtaaccggtaacggtaagggtacggtaaccggtacgggtaacccgtaccgggtaccgttaaccgttacgttacgtaacggtacggaacggtaaagtcgtacgaacggacgggaccgggtaacccgggtaccccggttagggtacccgggtcgggtcgggttacgggtttcgggtttcgttacggttacggtcgtcgggtcggtaccggggtaccggtaacccgggtccggttacccgg

SEQ ID NO: 131161 - DNA, 949 bp, Homo sapiens
  misc_feature: GYAE6OF01C8HIG.13.65.F10.1.454.CMB.1.raw
tcagtcacgtactacacgaccggtgctcgatttagctacgctctaagggggggagagggagcccagcactgggattccgaggtatttccattcggtgatcagcactgaacacagaggactcaccatggtagttttggctgagcttgggttttccttattacttaattttaaaggtgtccgagtgtgtaggtgctaggttggtggtagtcgtgggaggtaggtcgttgggtccgacggggtcccgggggggtccctaggacgtactccgtcgtacgtggtcggccggtccgttcggttacgggtcctaccgtacccggtaccaaacctaaaccctaaacgtaacctaagtacgggtaacgccgttaccgggggtcccaccggtaccggtccgtaccggaagggggaaacggcggggaccggttaggtcgggttcttacgtaggttttactttacggtcggtacggtacggttcaccgtacgtacgttccgtaacgtcgtaacgtacccgttacgggtacgggtaccggggttcccgtttaccaaccgtactcccgtacgaacggtaacgtaaacctacgttacccaaaggtaacccgtgggttaacttacgttacgttaaacgtaaacgtacggtaaaccgtccgtaagggtaacgtacgggttacggaaccggtacccggtaccggttacccgtttagttaacgtttacgttacggtaaccggtaaagggtaagttacggtacggtaacccggaacgggtaaccgggggtaacccccggggttaccccgggttaaacgggggtccggggttaaccgggggtttcggggttaacgggggttttcccgggtttttaaaccgtttcccggtttacggggaccgtttacccggggggtacgggttacccgggggtaacccccgggtaaccgggttaccccccgggttaccggg

SEQ ID NO: 131162 - DNA, 880 bp, Homo sapiens
  misc_feature: GYAE6OF01B9H19.13.65.F10.1.454.CMB.1.raw
tcagtcacgtactacacgaccggtgctcgatttagctacgctctaaggggacccaaaaaccacacccctccttgggagaatcccgtagatcacagctcctcaccatggactggacctggagcattccttttcttggtggcagcggcaacgaggtcgtccaccctggaggttcagttggttcagtcgtggaggaggggtgaagaacgccgtggggcctcgagtgcgaggtcgccgtgcgagggtccttcgttggttactagttttccgaacctaacgttttggacttactacgtacggtcgggtcgaccggaaccgtaccgggtcccccgttagggccccgtacgggttaccgtttacggacggttccggtcgggttacgggggttcgaacgttcgttacgggtttacgttaacccggaacggtacgaactacggaacgttaccggttttggaaccgtaaacgtagggttaaacggttttacggaacgggtaccgaacggtaccgtaccctaacccggttaccggaacctaacgtaacggaccctaacgtaccgtacccggaaccgtaaacgacccgttaacgacccgttaagaaccgttagggtaaccgttagaacgggttaacctacggtaccgtaacgttacttaccgggcggtaaccgtaacccggaccggtaaccttaagttaaccgttaagtttcggtaacggtcggtaacccggttaagggttaccggggtttacgggtttacggggtaccgtaaccggttccgttaacggtccggttaacgtaacggttacgtccggggtaacgggcccgggttaaagggaccgttacggtaccgtacccggttacgttaccgtccgtacgccgggtaacccg

SEQ ID NO: 131163 - DNA, 659 bp, Homo sapiens
  misc_feature: GYAE6OF01E32OK.13.65.F10.1.454.CMB.1.raw
  modified_base (144)..(144): a, c, t, g, unknown or other
  misc_feature (144)..(144): n is a, c, g, or t
  modified_base (373)..(373): a, c, t, g, unknown or other
  misc_feature (373)..(373): n is a, c, g, or t
  modified_base (420)..(420): a, c, t, g, unknown or other
  misc_feature (420)..(420): n is a, c, g, or t
tcagtcacgtactacacgaccggtgctcgatttagctacgctctaaggggacccaaaaaccacacccctccttgggagaatcccgtagatcacagctcctcaccatggactggacctggagcattcctttttcttggtggcagnggcaacaggtgtccaccctgaggttcagttggttcagtctggaggaggggtgaagaaggccctggggcctcagtgcgaggtcgcctgcgacgggcctctggttactattttcgactaacttttggcatcgtacgtgggtgcgacacggcccctggccacggccttgagtcgcgtggggtgactcagttgtacgaacggtgacacagtactttgcacgagtagttgaggnagagtcacccgtgaccgacagacacactccgacgaacacacgcctanacgtacggaactggaacggtattccgtacgactacgttacgtacggaaccgaccaccggtaccgtaattaacgttactttaacgtggtacggacgtagggtaaacgggtttcggggtttcggggaccgtacggtaccgttccgtcggttagaacggtcgtccggtaggggacccggtaggggtaacccgtaaggttccggtaccgttacgttacccgttcctttccgccggttaccccg

SEQ ID NO: 131164 - DNA, 816 bp, Homo sapiens
  misc_feature: GYAE6OF01B1UTP.13.65.F10.1.454.CMB.1.raw
  modified_base (197)..(197): a, c, t, g, unknown or other
  misc_feature (197)..(197): n is a, c, g, or t
  modified_base (593)..(593): a, c, t, g, unknown or other
  misc_feature (593)..(593): n is a, c, g, or t
tcagtcacgtactacacgaccggtgctcgatttagctacgctctaagggggggagaggagcccagcactgggattccgaggtatttccattcggtgatcagcactgaacacagaggactcaccagtggagttttgctgagcgttggttttccttattactaattttaaaaggtgtccagtgtgaggtgcaggttggnggagtcgtagggagggacggtcgttgggtccgacggggcccggggggggttccctggacgacttcctctagtcggtcgccgggtccgtccggttcgggcctaccgtaccgtaccaaaaccacccaaacgttaccagtgaaccgtcggttccgggcccgcgacggccgtaccggagggaaggaccgggcggaggtcggtctacgtagtttatttagtcggtacggtaccgggtgaccctatactccgtacgccgtacggccgttcgggacgggtcgggtcccggttacaccgtactaccgtaccgaaagaacgaactaacgtaccgaaagtaaccggtagttacgtactacctaaataaagacaacgacgtcgtaaggaaggtccgacgtacggtanacccgggtaccggttacgttacggtaattacggttaggaaccggtaggagggtaaccggttcggggaacccccgggttaacgtaaacccgggttaaaccggtttaccaacggggttccttaaccggggtacggtacccgggttacgggaaccccgggggaaccggtaaaccccggggtaccccgtaaaccgggtccccgtaaaccccgttcccggtaaacccc

SEQ ID NO: 131165 - DNA, 528 bp, Homo sapiens
  misc_feature: GYAE6OF02IWNWD.13.65.F10.1.454.CMB.1.raw
  modified_base (438)..(438): a, c, t, g, unknown or other
  misc_feature (438)..(438): n is a, c, g, or t
  modified_base (499)..(499): a, c, t, g, unknown or other
  misc_feature (499)..(499): n is a, c, g, or t
tcagtcacgtactacacgaccggtgctcgatttagctacgctctaaggggggagaggagcccagcactgggattccgaggtatttccattcggtgatcaggactgaacagagagaactcaccatggagttttggctgagctgggtttccttgttgctattttaaaaggtgcccagtgtgaggtgcagctggtggagtctggaggaggcttgatccagcctgggggtccctgagactctcctgtgcagcctctgggtcaccgtcagtcacacctaccatgagctggtccgccaggctccagggaaggggcgtggagtgcgtctctttatttatagtagtggtagtacatactcgcagactccgtgagggcgatcaccatctccagagacaattccaaagaacacgctgtttcttcaaatgaacagcctgagagccagtnacgacggccgtgtattactagtgacgagagagtcggggcccacgaacgttactacgcttanggacgtctggggccaagggacccagtccg

SEQ ID NO: 131166 - DNA, 542 bp, Homo sapiens
  misc_feature: GYAE6OF02IMZ1F.13.65.F10.1.454.CMB.1.raw
tcagtcacgtactacacgaccggtgctcgatttagctacgctctaaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagagcctggggcctcagtgcaggtcgcctgcagggcctctggttacattttcgacaactttggcatctactgggtgcgacaggcccctggcccacggccttgagtcgcgtggggtggatcagttgttacaacggtgacacagactttgcacagaagtttgagggcagagtcaccctgaccacagacacatccgacgaacacagcctacataggaactgaggaatctagacatctgacgacacgaccatatattactgtagcgagaaggtacggttttgggcggtacggactccgtcgtgagtagtcgtcgggcgagggacaagtcggctaccgtctctcacgtcccg

SEQ ID NO: 131167 - DNA, 550 bp, Homo sapiens
  misc_feature: GYAE6OF02GGU0J.13.65.F10.1.454.CMB.1.raw
  modified_base (457)..(457): a, c, t, g, unknown or other
  misc_feature (457)..(457): n is a, c, g, or t
tcagtcacgtactacacgaccggtgctcgatttagctacgctctaaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtggatcaggttgttacaacggtgacacagactttgcactagtaagtttgagggccagagtcaccctgaccacagacacatccgcgaacacagcctacataggaactgaggaatcgtagacatctgacgacgacgcatatattactgtgngagaaggtacggttttgggcggacggtacgtccgtcttagacgagtcgtagggccgagggaacagtacggtacgaccgtctcgttcagtcccg

SEQ ID NO: 131168 - DNA, 705 bp, Homo sapiens
  misc_feature: GYAE6OF02JS1JR.13.65.F10.1.454.CMB.1.raw
  modified_base (309)..(309): a, c, t, g, unknown or other
  misc_feature (309)..(309): n is a, c, g, or t
tcagtcacgtactacacgaccggtgctcgatttagctacgctctaaggggacccaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcagtctacgtggtgcgacaggcccctggccacggccttgagtcgcgtgggnggatcagttgttacaacggtgacacgagactttgcacgagtaacgtttgagggcagagtcaccgtcgacacagacacatccgacgaaacacgacgaccgtacacgtacggaacgtacgaagggaacttacgtagaaccgtacgtccgttaggaaccgaaccgtaacccgggaccaaacttattaacgtttaacctgtacggacggtaaggtaaacgggtttacggggtttttaggggaccgggttaccgggtacccgttccggtttacccgttaggttacggtacgttaccgggttcggggtacccgggtaacgggggtaaccgttaacggttccgggttacccgggaaacccggtttcccgtttacccggttacccgtaccgggttaccccccgg

SEQ ID NO: 131169 - DNA, 693 bp, Homo sapiens
  misc_feature: GYAE6OF02I2JAX.13.65.F10.1.454.CMB.1.raw
  modified_base (433)..(433): a, c, t, g, unknown or other
  misc_feature (433)..(433): n is a, c, g, or t
  modified_base (448)..(448): a, c, t, g, unknown or other
  misc_feature (448)..(448): n is a, c, g, or t
tcagtcacgtactacacgaccggtgctcgatttagctacgctctaaggggacccaaaaaccacacccctccttgggagaatcccgtagatcacagctcctcaccatggactggacctggagcatccttttcttggtggcagcggcaacgaggtcgtcccaccctgtaggttctaggtttggttcagtcgtggagggagggtagaagaacgccgtgggcctcgagtgcgaggtccgccgtgcgacgggtccttcgttacggttaacttacgttttacgaaccttaacgtttggactattccttacggtggtcgcgaacgaccggcccctggccgaccggtccttagacgtcgcgtggggtgatcgtagttcgttaacgaacggtcgacagacgtactttgacacgagtaagttgaggcagtacgtacctacccngaccacgagacaacncgtacccgacgaacaccgacgaccctaacacgtaggaacgtaggaacggtaactacgtacgacacgttcgtacgacgaacgaccggacctaattacttattactggtacgacgtaaggtaacgggttacggggttttcgggaccgggtacggtaccgttccgttcgtagacggtacgtcggtccgggaccggtacgggtaacgtaggttacggtacgtacccgttcttaccgtcgacgtaccccg

SEQ ID NO: 131170 - DNA, 571 bp, Homo sapiens
  misc_feature: GYAE6OF02JIN8C.13.65.F10.1.454.CMB.1.raw
  modified_base (380)..(380): a, c, t, g, unknown or other
  misc_feature (380)..(380): n is a, c, g, or t
  modified_base (396)..(396): a, c, t, g, unknown or other
  misc_feature (396)..(396): n is a, c, g, or t
  modified_base (406)..(406): a, c, t, g, unknown or other
  misc_feature (406)..(406): n is a, c, g, or t
  modified_base (411)..(411): a, c, t, g, unknown or other
  misc_feature (411)..(411): n is a, c, g, or t
tcagtcacgtactacacgaccggtgctcgatttagctacgctctaaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagagcctggggcctcagtgcaggtcgcctgcagggcctcgtggttacattttcgactaactttggcatctacgtgggtgcgtacaggcccctggccacggccttgagtcgctggggtgatcgagttgttacgacggtgacacagactttgcacagaacgtttgagggtcagagtcacctgaccanagacacatccgcaacncagcctacangaacngagatcagacatctgacgacacggaccagtatattactgtagacgagtaacggtacgggttttaggggcgacggtacgtccgtacgttagacgtacgtacggtcgggaccggtagggacgtaaggtcggtactaccggttcctacgttccgagtaccccg

SEQ ID NO: 131171 - DNA, 660 bp, Homo sapiens
  misc_feature: GYAE6OF02IUYY2.13.65.F10.1.454.CMB.1.raw
tcagtcacgtactacacgaccggtgctcgatttagctacgctctaagggggggagaggagcccagcactgggattccgaggtgtttccattcggtgatcagcactgaacacagaggactcaccatggagttttggctgagctgggttttccttgttgctatttaaaggtgcccagtgtgaggtgcagctggtggagtcgtggaggaggcttgatccagccgtgggggtccctgagactctcctgtgcagcctcgtggttcaccgtcagtcaccacctacatgagcgtgggtccgccgacggccgtccgaggggaaggggcctggaggtgcgtcgttacttttagttatagttagtggtagtaacatacctcgacagaccttcggtgacggggccagttaccaccacttcctaccgaagacgaaactaaacttccaaaggaactaccggtctttagtttaccgttaccaaaagttccgaaaacgtacgtacccgttagacgacggacccgtaagtagacccgtaccggtacccgttagttacttaacgtcggtgtaacggagtaacgaggttcccgggaccgaacggttaacgttaaccgtacgtaccgttaggtacggtacggttccggaccggggtaaccgaacgggtcccctaacggg

SEQ ID NO: 131172 - DNA, 546 bp, Homo sapiens
  misc_feature: GYAE6OF02GTDHR.13.65.F10.1.454.CMB.1.raw
tcagtcacgtactacacgaccggtgctcgatttagctacgctctaaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgccctgcagggcctctggttacattttcgacaactttggcatctactgggtgcgacaggcccctggccacggccttgagtcgctggggtgatcagttgtacaacggtgacacagactttgcacagaagtttgagggcagagtcaccctgaccacagacacatccgcgaacacagcctacataggaactgaggaatctgacatctgacgacacggccatatattactgtgcgagaagggtacggttttggggcgtcggactccgtcttagagtacgtcgtcgggccgaagggacaagtggtaccgaccgtcgtcttccagtccccg

SEQ ID NO: 131173 - DNA, 587 bp, Homo sapiens
  misc_feature: GYAE6OF02HPFGN.13.65.F10.1.454.CMB.1.raw
  modified_base (344)..(344): a, c, t, g, unknown or other
  misc_feature (344)..(344): n is a, c, g, or t
tcagtcacgtactacacgaccggtgctcgatttagctacgctctaaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgactaactttggcatctactgggtgcgacaggcccctggccacggccttgagtcgctggggtgatcagttgttacacggtgacacagactttgcanagaagtttgagggcagagtcacctgaccacagacacatccgacgaacacacgcctacactaggaactgaggaatctagacatctagacgacaccggccatatacttacgtgtgacgagtaacgggtacgggtttttcggggcggtacggaccgttcccgttcgttacgtagtacgtcggtcggggtaccggacggggaccgaaggtcggtaccgtacccggttctaccgttcgacgtaccccg

SEQ ID NO: 131174 - DNA, 560 bp, Homo sapiens
  misc_feature: GYAE6OF02HIWNK.13.65.F10.1.454.CMB.1.raw
tcagtcacgtactacacgaccggtgctcgatttagctacgctctaaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgactaactttggcatctactgggtgcgacaggcccctggccacggccttgagtcgctggggtggatcagttgttacaacggtgacacagactttgcacagaagtttgagggcagagtcaccctgaccacagacacatccgcgaacacagcctacatggaactgaggatctgacatctgacgacacgccatatatactgtgcgaagaagggtacggttttgggggacgtcggacttccgtcttaggagtagtcggtggggaccgaagggggtacgaagtcgggtcgaccggttcctccttccgacgtaccccg

SEQ ID NO: 131175 - DNA, 593 bp, Homo sapiens
  misc_feature: GYAE6OF02FYWNK.13.65.F10.1.454.CMB.1.raw
  modified_base (367)..(367): a, c, t, g, unknown or other
  misc_feature (367)..(367): n is a, c, g, or t
  modified_base (377)..(377): a, c, t, g, unknown or other
  misc_feature (377)..(377): n is a, c, g, or t
  modified_base (405)..(405): a, c, t, g, unknown or other
  misc_feature (405)..(405): n is a, c, g, or t
  modified_base (438)..(438): a, c, t, g, unknown or other
  misc_feature (438)..(438): n is a, c, g, or t
tcagtcacgtactacacgaccggtgctcgatttagctacgctctaagggggggagaggagcccagcactgggattccgaggtatttccattcggtgatcagcactgaacacagaggactcaccatggagtttttggctgagcgtggttttccgttattaacgtattttaaaaggtgtccagtgtgaggtgcagttggtggagtctggaggaggcttggtccagccggggggtccctgagactctcatgtgcggcctctgggctcaccgtcaacaccaactacatgagctgggtccgccaggctccgagggagagggccggtagtcgggtctcgagtttatttatgtcgacggtgccacattctacgnacgactccgnggacggggccgttcaccgatcctccagngaacaacgttcaagaacacggtgtaattcttanaaactagaacgacctgagagtacgaggacgacggcctcttatactgtgacgaaagatgacaggagaccgggaccccgtagtcgggaccgtgggtagggtacgggttctttcgtttgacgttggtcggtcggggtacccgtacgggacccgtcggg

SEQ ID NO: 131176 - DNA, 540 bp, Homo sapiens
  misc_feature: GYAE6OF02F4IUP.13.65.F10.1.454.CMB.1.raw
  modified_base (492)..(492): a, c, t, g, unknown or other
  misc_feature (492)..(492): n is a, c, g, or t
tcagtcacgtactacacgaccggtgctcgatttagctacgctctaaggggacccaaaaaaccacaccccctccttgggagaatcccgtagatcacagctcctcaccatggactggacctggagcatcctttttcttggtggcagcggcaacaggtgtccaccctgaggttcagttggttcagtctggaggaggggtgaagaagccgtggggcctcagtgcaggtcgcctgcgagggcctcgtggttactattttcgactaactttggcatctacgtgggtgcgacacggcccctggccacggccttgagtcgctggggtgatcagttgtacacggtgacacagactttgcacagtaagtttgagggcagagtccaccctgaccacagacacatcccgacgaacacacgcctacagtggaactgaggatctgacatctgacgacacgccatatattactgtgcgagaaggtcggttttgggcgtcggctcctntgagatcgtgggccgagggacaagtggtacaccgtctctcgagtcccg

SEQ ID NO: 131177 - DNA, 530 bp, Homo sapiens
  misc_feature: GYAE6OF02FYGSP.13.65.F10.1.454.CMB.1.raw
  modified_base (374)..(374): a, c, t, g, unknown or other
  misc_feature (374)..(374): n is a, c, g, or t
  modified_base (526)..(526): a, c, t, g, unknown or other
  misc_feature (526)..(526): n is a, c, g, or t
tcagtcacgtactacacgaccggtgctcgatttagctacgctctaaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtgatcagttgttacaacggtgacacagactttgcacagaagtttgagggcagagtcacctgaccanagacacatccgcgaacacacgcctacatggaactgaggaatctgacatctgacgacacggccaatatattactgtgcgagaaggtacggttttggggcgcgactctctgagagtcgtgggccgagggtacagtcggtcaccgtcgtcttcgntccc

SEQ ID NO: 131178 - DNA, 584 bp, Homo sapiens
  misc_feature: GYAE6OF02HG65P.13.65.F10.1.454.CMB.1.raw
  modified_base (299)..(299): a, c, t, g, unknown or other
  misc_feature (299)..(299): n is a, c, g, or t
  modified_base (419)..(419): a, c, t, g, unknown or other
  misc_feature (419)..(419): n is a, c, g, or t
  modified_base (435)..(435): a, c, t, g, unknown or other
  misc_feature (435)..(435): n is a, c, g, or t
  modified_base (467)..(467): a, c, t, g, unknown or other
  misc_feature (467)..(467): n is a, c, g, or t
  modified_base (474)..(474): a, c, t, g, unknown or other
  misc_feature (474)..(474): n is a, c, g, or t
  modified_base (485)..(485): a, c, t, g, unknown or other
  misc_feature (485)..(485): n is a, c, g, or t
tcagtcacgtactacacgaccggtgctcgatttagctacgctctaagggggggagaggagcccagcactgggattccgaggtatttccattcggtgatcagcactgaacacagagactcaccatggagtttggctgagctgggttttccttattactattttaaaaggtgtccagtgtgaggtgcagttggtggagtctgggaggaggcttggtccaggccgggggggtccctggagactctcatgtgcggtcctcgtgggctcaccgtcaacaccaactacatcgaagctgggtcccncaggcctaccaggggaagaggccggaagtggggtcctcagttatttatgtcgacggtgccacattctacgcagacctccgtggacgggtccgttcaccatcctcagagacaattaccaanacgagtagtatcttanaatagaacactgagagtcgagacgacgccgtntattacngtagacgaaancgtgcagaggacgaccccgtaaggtgggacccgtgggtacggtacgggtttcttacgtttcgacgtcggtcggtcggggaccacggggtaccctacggg

SEQ ID NO: 131179 - DNA, 728 bp, Homo sapiens
  misc_feature: GYAE6OF02JLKGM.13.65.F10.1.454.CMB.1.raw
  modified_base (277)..(277): a, c, t, g, unknown or other
  misc_feature (277)..(277): n is a, c, g, or t
  modified_base (283)..(283): a, c, t, g, unknown or other
  misc_feature (283)..(283): n is a, c, g, or t
  modified_base (407)..(407): a, c, t, g, unknown or other
  misc_feature (407)..(407): n is a, c, g, or t
tcagtcacgtactacacgaccggtgctcgatttagctacgctctaaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagccgtggggcctcagtgcaggtcgcctgcgagggcctcgtggttacattttcgactaacgtttggcatctactgggtncgtacnggcccgtggccacggccttgcgtcgcgtggggtgatcgagttcgttacgaacggtcgacaccgtaagcgtttgcgactaggtaagtttggagggtccaaggtcgtaccacccgtaggacccaanacggtacacactacccgcgaaaccagtacggccttaacgacgttaacggaaacgtacggaacgggtaaattaccgtagggtaacccaggttccctacgggaaaccgtaaccgaccgggaaccaacgtttaacgttacttaaccgtggttacggacgtaaacggggttaaagggtttaccggggtttttacgggggccgtacgggttaacccgttcccgtttaggtaccggtaaggtacgttaccgggttacgggggacccggaaggggtaacccgtaagtccgggtccggtaaccgttcgtaacgtttaccggcgtccccg

SEQ ID NO: 131180 - DNA, 985 bp, Homo sapiens
  misc_feature: GYAE6OF02HXA4N.13.65.F10.1.454.CMB.1.raw
tcagtcacgtactacacgaccggtgctcgatttagctacgctctaaggggggagaggagcccagcactgggattccgaggtatttccattcggtgatcagcactgaacacagaggacctcacagtggtagtttgctgagtcgttcggtttttaccttattacttaaagttttaaaaggtcgtaccgtagttggtaggtaggtcgacgttaggtttgggtgggtaacgttcggtaggggaagggtacggttcgtttcgggtacccgacgggggtccccgggggggttccctaggtacgtaccttctactagttggtcggccggtcctcggtcgggtcctaccgtacccgtacaaccaacctaaactacagtagacgtcggtcggtcccgccgtacggtcctaccggaaggggaacggaccggggaccggagggttcgggtcttacgtaagtttttattacggtcggtaccggtacgggtcgtacctaacgtactttaccgtaccgacgaacgtacccggtttacccgggtacgggggacccggggggttccccgttaacccaaccgttaccgttacccgtacccgtaaaggaaaccgttaacctaacgtttaacccgaaaacggtaacccgggttaccgggttaacgtttaacttaaccgtttaaacgaaagttaaccggaaaacccgtaccggtaggaaacgggttaacggtacggaaccgggtaacccggtaccgggtacccggtttaactttaaccgtttaaccgttagggtaccggtaaaccggtaaaaggtcgttaacgggaaccggtaaacgggtaacccggggtaaccccgggtaccccgggtttaacggggtaccggggttacccgggttgggggtttaaccggggttacgggtttttcccgtttacgggtttagtaccggttcgggtacccgggttacccgggggtaacccgtacccggggttacccgttacccggg

SEQ ID NO: 131181 - DNA, 739 bp, Homo sapiens
  misc_feature: GYAE6OF02HCYH9.13.65.F10.1.454.CMB.1.raw
  modified_base (237)..(237): a, c, t, g, unknown or other
  misc_feature (237)..(237): n is a, c, g, or t
tcagtcacgtactacacgaccggtgctcgatttagctacgctctaagggggggagaggagcccagcactgggattccgaggtatttccattcggtgatcagcactgaacacagaggactcaccatggattttggctgagctgggttttccttattactattttaaaaggtgtccagtcgtgaggtgcagttggtggagtctggaggaggcttggtccgagccgggggggtccctganacgtctcacgtgtgccggcctctgggctcaccgtacaactaccaacgtacatcgagcgtcgggtcccgcaaggtctccgaagggacgagggccggtagtcggtactccgtaggttatttacgcgtcgtacggtcgtcctactatttccgacggctaggtacctcgtacgggaaccggggttccgttacgaccgttatacccgtccgaagtacgtaacctaacgtttacccgaacggtaaccgtacgggtttaagttaaccgtacgtttaaccgaaattcggaaaccgttacgtacggtagtaacggtcggaacggtacggtacggtccgtttacgtaactttacgacggttacgtaaccggaagtacgtacgacgtacggacgtacccgggtacccgttacgcgggtacccgttgggtacgggtttaccggttaccgtttcgtttaccggtaccttcgggtacccgttaccggggtaccgtaccgggttaccccgtacgggg

SEQ ID NO: 131182 - DNA, 591 bp, Homo sapiens
  misc_feature: GYAE6OF02F18EO.13.65.F10.1.454.CMB.1.raw
tcagtcacgtactacacgaccggtgctcgatttagctacgctctaagggggggagaggagcccagcactgggattccgaggtatttccattcggtgatcagcaatgaacacagaggactcaccatggagttttggctgagctgggttttccttattactattttaaaaggtgtccagtgtgaggtgcagttggtggagtctggaggaggcttggtccaggccgggggggtccctgagactctcatgtgcggcctctgggctcaccgtcaacaccaactacatgagctgggtcccgccaggctccgagggaagagggccggagtgggtctcagttatttatgtcgacggtgccacattctacgcagactccggtggacggggccggttcaccatctccagagacaattccaagaacacggtagtatcttacaaatagaacgactgagagtacgaggaccgacggccgtacgtattacgtgtgacgaagagtgacgagagacgggaccccgtagtcggggtccggtgggtgggtagggtttcgtttcgtttcggtacgttcggtcggtcggggccgtacgggtacccgtcggg

SEQ ID NO: 131183 - DNA, 795 bp, Homo sapiens
  misc_feature: GYAE6OF02JQA7I.13.65.F10.1.454.CMB.1.raw
tcagtcacgtactacacgaccggtgctcgatttagctacgctctaagggggggagaggagcccagcactgggattccgaggtatttccattcggtgatcagcactgaacacagaggactcaccatggagttttggctgagctgggttttccttattactattttaaaaggtgtccagtgtgaggtgcaggttggtggagtctggaggaggcttggtccaggtccgggggggtccctgagactctcagtgtgcgctcgtggctcgaccgtcaacgaccaactacatgacgtcgtcgggtccgccgaggctcccgaaggggaacgacgggaccggtagggtcggtaccttacgtaggtttaatttagtcgtacgggtaccggttcgacccgtaactattttccgaaccgcgaacggtaccgttccgtacgggacgggttcccgacgtttcacctactctacccgaagacgtaacctaacgtaccgaaaacgaaccgtaccggtacgtttacgtttacccgtttacaaaaaacgttcgggaaaaccaacggtcccgttaaggaaacgggttccggaacccggtaacgttaccggaacccgttacccggggtaccgttttacggtaaacctttcggggaccgttagggaccgggtaaccgtagggtacgggtaccgggaaccccacgtttaaaccggtacccgtaggttacccttagggtaccgggacgtttaccggggtacggggtaaccccggaaaccggggttaaccccggtccgggtacccgtacccgtcccccg

SEQ ID NO: 131184 - DNA, 561 bp, Homo sapiens
  misc_feature: GYAE6OF02G45GC.13.65.F10.1.454.CMB.1.raw
  modified_base (417)..(417): a, c, t, g, unknown or other
  misc_feature (417)..(417): n is a, c, g, or t
  modified_base (475)..(475): a, c, t, g, unknown or other
  misc_feature (475)..(475): n is a, c, g, or t
tcagtcacgtactacacgaccggtgctcgatttagctacgctctaaggggggggagaggagcccagcactgggattccgaggtatttccattcggtgatcagcactgaacacagaggactcaccatggagttttggctgagctgggttttccttattactattttaaaaggtgtccagtgtgaggtgcagttggtggagtctgggaggaggcttggtccaggccggggggggtccctgagactctcatgtgcggcctctgggctcaccgtcaacaccaactacatgagctgggtccgccaggctccagggaagaggccggagtgggtctcagttatttatgtcgacggtgccacattctacgcagactccgtgaggggccggttcaccatctcagagacaattccaagaacacggtntatctacaatacgacgacctgagagtcgagacacggccgtctattactgtgacgaagntgacaggagaccgggaccccgtagtcgggccgtggtgggtaggttctttcgtttgacttggcgtcggggccgacgggaccgtcggg

SEQ ID NO: 131185 - DNA, 598 bp, Homo sapiens
  misc_feature: GYAE6OF02FKH8M.13.65.F10.1.454.CMB.1.raw
  modified_base (236)..(236): a, c, t, g, unknown or other
  misc_feature (236)..(236): n is a, c, g, or t
  modified_base (332)..(332): a, c, t, g, unknown or other
  misc_feature (332)..(332): n is a, c, g, or t
tcagtcacgtactacacgaccggtgctcgatttagctacgctctaaggggacccaaaaaccacacccctccttgggagaatcccgtagatcacagctcctcaccatggactggacctggagcatcctttttcttggtggcagcggcaacaggtgtccaccctgaggttcagttggttcagtctggaggaggggtgaagaagcctggggcctcagtgcaggtcgcctgcagggcctntggttacattttcgacaacttttggcatctactgggtgcgacacggcccctggccacggtccttgagtcgctggggtgatcagttgtacaacggtnacacgatacctttgcacaggtaaagtttgaggggtcaggagtcaccctggaccacgagacacatcccgcgaaacacgacgcctacatcggaactgaggaatctgacatcgtagacgacacggaccaattactacttactgtagcgtaaggaagggtacgggttttcgggggacgtcggaacttccgtcgttcgagtacgtcggtaggggaccgtaagggtaacgaaggttcggtaccgtaccgttcgtccgttacgaccgtacccg

SEQ ID NO: 131186 - DNA, 594 bp, Homo sapiens
  misc_feature: GYAE6OF02G5LRE.13.65.F10.1.454.CMB.1.raw
tcagtcacgtactacacgaccggtgctcgatttagctacgctctaaggggacccaaaaaccacacccctccttgggagaatcccgtagatcacagctcctcaccatggactggacctggagcatcctttttcttggtggcagcggcaacaggtgtccaccctgaggttcagttggttcagtctggaggaggggtgaagaagcctggggcctcagtgcaggtcgcctgcagggcctctggttacattttcgactaactttggcatctactgggtgcgacaggcccctggccacggccttgagtcgctggggtggatcagttgttacgaacggtgacacagtactttgcacagtaagtttgagggcagagtcaaccctgaaccacagaacacactccgacgaacacacgcctacacgtacggaactggaaggaatactagaacactctagacgacgacggccaatatacttactcgtagacgaagaagggttacggttttggggcgtcggacctccgtcgttgagtacgtcggtacgggccggtaagggaacgtaaggtcggtaccgtaccgtcgttccgttacgtacgtaccccg

SEQ ID NO: 131187 - DNA, 805 bp, Homo sapiens
  misc_feature: GYAE6OF02H4SDG.13.65.F10.1.454.CMB.1.raw
tcagtcacgtactacacgaccggtgctcgatttagctacgctctaagggggggagaggagcccagcactgggattccgaggtatttccattcggtgatcagcactgaacacagaggactcaccatggagtttggctgagcttgggttttccttattacttaattttaaaaggtgtccagtgtgaggtgctagttggtggagtcgtgggaggaggtcgttggtccgagggcccgggggggtccctggacgtactctcagtgtggcggcctcgtcgggctccaccgtcaaccaaccaaactacaatggacgtcgtcgggtcccgccgaggcctacccggaaggggaaacgacggggcccgggaaggtcggggttcctacgtaggtttaacttttagtggttaccggacgggttcgcccgtaactacgtttacctaccggactaaccggtaccgttcccgggtagggacggggtcccggttacacctagtcctaccgagtaacgacctaaacttaccgaagtaaaccgtacggttacgttattaccgtttaacaaagttacggaaaccgtaccgtacggaaggacggttacggacgggaacccgtaccggggtccgttaaccgtttaacgtttaccgtcggttacgaaccggtaaaagtcggtacgtacgaacggtaacgggaccggggtacccccgttagggtaccggggccggtttaggggtcggggttaacgggtttccgtttcggtttacggtacgttcgggtaccggtaccgggggtaccggtaccgggtacccgttccgggg

SEQ ID NO: 131188 - DNA, 713 bp, Homo sapiens
  misc_feature: GYAE6OF02F7XEB.13.65.F10.1.454.CMB.1.raw
  modified_base (222)..(222): a, c, t, g, unknown or other
  misc_feature (222)..(222): n is a, c, g, or t
  modified_base (235)..(235): a, c, t, g, unknown or other
  misc_feature (235)..(235): n is a, c, g, or t
  modified_base (276)..(276): a, c, t, g, unknown or other
  misc_feature (276)..(276): n is a, c, g, or t
tcagtcacgtactacacgaccggtgctcgatttagctacgctctaaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcncctgcagggcctntggttactattttcgactaactttggcatcgtactggggtncgacacggcccctggccaacggccttagagttcgcgtggggtagatcgagtttcggttacaacggtgacacgagtacctttggacacgagtaacggtttggacggggactaggtacgtccaaccccgttgaacccacgtaacggaccaactaacgtccccggacgaaacgtaaccacggtaccctaacgagtacggaacgtacggaggtaatcgtacgtaactacgtctacggaaccgaccgaaccggcctaactaattacgttacgttagtacggtaccggaaggtaacggggttacgggtttttacgggggaccgtaccgggtaccgttccgttccgttaggtaccggttagtccgggtacggggtaccggaacggggtacgtaacggttcggtaccgtacccggttaaccgtcgtttaccggaccgttaccccg

SEQ ID NO: 131189 - DNA, 780 bp, Homo sapiens
  misc_feature: GYAE6OF02JQIMO.13.65.F10.1.454.CMB.1.raw
  modified_base (207)..(207): a, c, t, g, unknown or other
  misc_feature (207)..(207): n is a, c, g, or t
  modified_base (235)..(235): a, c, t, g, unknown or other
  misc_feature (235)..(235): n is a, c, g, or t
  modified_base (339)..(339): a, c, t, g, unknown or other
  misc_feature (339)..(339): n is a, c, g, or t
tcagtcacgtactacacgaccggtgctcgatttagctacgctctaagggggggaggaggagcccagcactgggattccgaggtatttccattcggtgatcagcactgaacacagaggactcaccatggagtttggctgagctgggtttccttattactattttaaaagtgtccagtgtgaggtgcagtggtggagtctggaggaggnttggtccgaggtccgggggggtcctggngacgtctcatgtcgcggtcctcgtgggctccgaccgtcaacaccaactacatgagctgggtcccgaccgaggctaccgagggaagacgggccggaggtcggctntagtttattagtcggtcgaacggtcgacctacgtacttcacgcaacgacgttccgcgggtaacgggtcccgttacaccgtacgtcctacccgaaggaacgtaacctaacgtttacccgaaaggtaacccgaaccggtttagttaacttaccgttaacaaaaaggtacgaaaaccggttacctaggtaacgggtaacgtaccggtaaacgggtaaccggaaccgggttaccggtactttaacgttaacggttacgttagaaacccgggtaaaaggtcgtaacgggaccgtaaagggaaccgggtaccggggtaccccgggtaaggtaccgggggtacccgttaacgggggtcgggtttaacggggtttacctttcgggtttaaggacccgttcggggaccggttcgggggtaacccgacccggggttaaacccttcccgggg

SEQ ID NO: 131190 - DNA, 673 bp, Homo sapiens
  misc_feature: GYAE6OF02IG3PB.13.65.F10.1.454.CMB.1.raw
tcagtcacgtactacacgaccggtgctcgatttagctacgctctaagggggggagaggagcccagcactgggattccgaggtatttccattcggtgatcagcactgaacacagaggactcaccatggagttttggctgagctgggttttccttattactattttaaaagtgtccagtgtgagtgcagttggtggagtctggaggaggcttggtccaggcccgggggggtcctggagacgtctcagtgtgcggcctcgtgggctcaccgtcaacaccaactacatgacgcgtcgggtccgccgacggcgtccgaaggggaacgacggccggaggtcgggtctacgtagtttattagtggttcgaacggttcgcctaacgtattcctacggtcaaggtacctccgggtagggacggggtcccggtttaccaaccgtacgtcccgtccgaagacgaacctaacgttaccgaaagtaaccgaccggttagtaactcttaacgaaagtacgaacgtacctgaacggtacgacggaacgtaccgacgtccggtcttaattacgtgtacgacgaagtagtcgacaggaaccggacgtcccggtagcgggtacgtgggtacgggtacggtttcgttcgttacgtcgttacggcggtacggggtaccacgggtaccgtccgg

SEQ ID NO: 131191 - DNA, 727 bp, Homo sapiens
  misc_feature: GYAE6OF02JMWC0.13.65.F10.1.454.CMB.1.raw
  modified_base (399)..(399): a, c, t, g, unknown or other
  misc_feature (399)..(399): n is a, c, g, or t
tcagtcacgtactacacgaccggtgctcgatttagctacgctctaagggggggagaggagcccagcactgggattccgaggtatttccattcggtgatcagcactgaacacagaggactcaccatggtagtttggctgagcttgggttttccttgttgcttaattttaaaaggtgcccagtgtgaggtgcagctggtggtagtcgtgggagggaggcttggactccgaggcccggttcgggggggtccccttaggacgtacctccgttccgttaggtcgcgtacgtcccgttccggttcgggttcccacccgtacgtacgtccaaccgtacccgtactaagtcgacgtcggtaccgggtccgccgtacggcccgtacgggacggggagggtccgtaggnggtcgtccgttcgtttacgttttaagtttagtaggttacggttaggttaacgtaatacgtaccgtccgactaccgtaccgtcggtacggaccgggtctaacgttaccacctacgtctacgacgtaagactaactacaacgaaccgtctagttcgtactaacaatcgaactcgactgaacgacgtcagcgaccgtacgtcgttaatacgttacgtcggtacgaggtaacgtacggacggtaccggtaaccgtacggtaaacttaccggtaccgagttaaccggcgtaccgggttaccggtacgggaaccggtaacccggcgtaacccgg

SEQ ID NO: 131192 - DNA, 648 bp, Homo sapiens
  misc_feature: GYAE6OF02IF59H.13.65.F10.1.454.CMB.1.raw
  modified_base (318)..(318): a, c, t, g, unknown or other
  misc_feature (318)..(318): n is a, c, g, or t
  modified_base (568)..(568): a, c, t, g, unknown or other
  misc_feature (568)..(568): n is a, c, g, or t
tcagtcacgtactacacgaccggtgctcgatttagctacgctctaaggggacccaaaaaaccacaccccctccttgggagaatcccgtagatcacagctcctcaccatggactggacctggagcatcctttttcttggtggcagcggcaacaggtgtccaccctgaggttcagttggttcagtctggaggagggtgaagaagccgtggggcctcgagtgcaggtcgcctgcgagggcctcgtggttactattttcgactaacgttttggactatctacgtgggtgtcgacaggcccctggcccacggccttgagtcgngtggggtgatcgagttgttacaacggtgacacgagactttgcacgaggtaagtttggagggacaggagtcacccgtagaccaactacgaacacgtactcgaccgaacacgacctacctactagtacgaacgtaggaaacgtatcgacgtacacttacgacggactaaccgaccggacctaattaataacgttcgtagtaggtacgaagggtacgggtttacgggtttcgggcggtaccgtcgttaccgtntacggacgtgtcgggtcgggtaccggagggtacgtacggtcggtaccgttaccgtcgtttaccgtccgtaccgtaccccg

SEQ ID NO: 131193 - DNA, 658 bp, Homo sapiens
  misc_feature: GYAE6OF02GUCRP.13.65.F10.1.454.CMB.1.raw
  modified_base (312)..(312): a, c, t, g, unknown or other
  misc_feature (312)..(312): n is a, c, g, or t
  modified_base (387)..(387): a, c, t, g, unknown or other
  misc_feature (387)..(387): n is a, c, g, or t
tcagtcacgtactacacgaccggtgctcgatttagctacgctctaagggggggagaggagcccagcactgggattccgaggtatttccattcggtgatcagcactgaacacagaggactcaccatggagttttggctgagctgggttttccttattactattttaaaaggtgtccagtgtgaggtgcagttggtggagtctggaggaggcgttggtccgaggcccggggggggttccctggacgactctcatggtgcgggcctcgtgggcctccgaccgtcaaccacccaactacatgacgcgtgggtcccnccgaggcctccggagggaagacggggccggaggtcgggtctcgtagtttatttatggtcgacggtcgacctactnttcctacgccaacgaccgtccgtaggggcggggtcccggttacacctatccgtccaagacgaacaacgttaccgaagtaaccgacgggtgtactctaacaaatacgaaccgacctgaagaggtcgaaggaccgacggccgttctaacttacgtggtacgtacgaaagtgtgacgaggaccgacccgggtacccgtagggtccgggtcggtggggtcggttacggttcttcgttagacgtggtaccgggtcggccggtacggtaccgtccgg

SEQ ID NO: 131194 - DNA, 671 bp, Homo sapiens
  misc_feature: GYAE6OF02JTQHX.13.65.F10.1.454.CMB.1.raw
  modified_base (204)..(204): a, c, t, g, unknown or other
  misc_feature (204)..(204): n is a, c, g, or t
  modified_base (240)..(240): a, c, t, g, unknown or other
  misc_feature (240)..(240): n is a, c, g, or t
  modified_base (260)..(260): a, c, t, g, unknown or other
  misc_feature (260)..(260): n is a, c, g, or t
  modified_base (288)..(288): a, c, t, g, unknown or other
  misc_feature (288)..(288): n is a, c, g, or t
  modified_base (306)..(306): a, c, t, g, unknown or other
  misc_feature (306)..(306): n is a, c, g, or t
  modified_base (420)..(420): a, c, t, g, unknown or other
  misc_feature (420)..(420): n is a, c, g, or t
  modified_base (555)..(555): a, c, t, g, unknown or other
  misc_feature (555)..(555): n is a, c, g, or t
tcagtcacgtactacacgaccggtgctcgatttagctacgctctaagggggggagagggagcccagcactgggattccgaggtatttccattcggtgatcagcactgaacacagaggactcaccatggagttttggctgagcgtgggtttcctattaacgtatttaaaggtgttccagtgtgaggtgcaggttggtggagttcnggaggaggctttggccaggcccggggggtcctgagntctcagtgtgcgtccgtcgnggctacgaccgtcaaccacactaaccgntcgagcgtcggccgaccnggctcagggagacggtcgaggtggtctgagtttatagtcgtcggacggtcaccgacattcgacaccgagtccgtcggtcggacggggtcccgttcaaacgtcgttctacgtaanacgaacgtaacttaccgaacgtaaccgtacggttatacggtaaccttacgaaagttaccgagtaccctagggagtaaggtcgacgggacctaacgggtccgtataacgggttctcgagaaccggttaagtctaancgggacgaaaccggtttcgggaaccccgttagggcggttaacccgggtgggtccggttacggttaacggttttcaaggccggttggtccggacggtacgggttaacggccttacgg

SEQ ID NO: 131195 - DNA, 810 bp, Homo sapiens
  misc_feature: GYAE6OF02I24T1.13.65.F10.1.454.CMB.1.raw
  modified_base (133)..(133): a, c, t, g, unknown or other
  misc_feature (133)..(133): n is a, c, g, or t
  modified_base (156)..(156): a, c, t, g, unknown or other
  misc_feature (156)..(156): n is a, c, g, or t
  modified_base (189)..(189): a, c, t, g, unknown or other
  misc_feature (189)..(189): n is a, c, g, or t
  modified_base (198)..(198): a, c, t, g, unknown or other
  misc_feature (198)..(198): n is a, c, g, or t
  modified_base (520)..(520): a, c, t, g, unknown or other
  misc_feature (520)..(520): n is a, c, g, or t
  modified_base (571)..(571): a, c, t, g, unknown or other
  misc_feature (571)..(571): n is a, c, g, or t
tcagtcacgtactacacgaccggtgctcgatttagctacgctctaaggggacccaaaaaccacacccctcttgggagaatcccgtagatcacagctcctcgaccatggactggacctggagctattccttttntgggtcggacaggacggcaacgnggtcgtccaccctggagttcgaggtttgtacgngtcgtgggnggagggtgaacgtagcgtgggcctgagtcgacgacggtcgcgtacgcggcggtccttaacggttgttaccgtatttaccggacgttaccgtttaggacttacggacctttcggcgggggttccaacggtccggtaaccggtccccggtaacggtccccgaccggttcgttacgggtcgggtccggtaacggttcggggggttataaccgtttaccgttaggttaccggttaaacggccggtttaccgaaccgtcgttaacgggtttacttaccggaccgtaaggtaacggtttacggttacgacgggttcgaaccgttaacnccggtactacgacgaacgacgttacaacggccgaccgtaaacggaccctancccgttaacgacgttacgtaacgtacggtacggtacgtaacgtcgtaacacggttagaccgtaacgaccggacggtagtaaccgtataacgttgaccggttaggtaccgagggtacgttacgggttcggttaccgggtcgtaccgttaccgcgtttaagccgggttaagcggacggggttacacggtaacggtcggtattaccggccgttcgttacgtacggttccgaccggttaaccg

SEQ ID NO: 131196 - DNA, 731 bp, Homo sapiens
  misc_feature: GYAE6OF02IABBU.13.65.F10.1.454.CMB.1.raw
tcagtcacgtactacacgaccggtgctcgatttagctacgctctaagggggggagaggagcccagcactgggattccgaggtatttccattcggtgatcagcactgaacacagaggactcaccatggagttttggctgagctgggttttccttattactattttaaaaggtgtccagtgtgaggtgcagttggtggagtctggaggaggcttggtccaggcccgggggggtccctgagactcgtcatgtgcggctctgggctcgaccgtcaaacaccaactacactgagctgggtccaccaggctccgaagggaagcggccggaggtgggtctctagtttatttatgtcggacggtgccactattctacgcagacctcgtggacggggtccggttcaaccgacgtcctacccgaggtaacgacctaaacttacccaaacgaaaccgtacgggtacgttaactccgtttaacaaaacgtacggaaaccgtacccttaggaacggtaacggttaacggaacgggtaaccgtaacccggggtcccgttaaccgttaacgtttaccgtaggttacggaaccggtaaaaggtagtacggacaaagggtaccggaaccgggtacccccggtaaggtccggggtaccgttcggggtagggtacgggtttccgtttaccgtttacggtaccgttacgggccgttacgggggaccccgtacggggtaccccgttaccggg

SEQ ID NO: 131197 - DNA, 881 bp, Homo sapiens
  misc_feature: GYAE6OF02H6QM2.13.65.F10.1.454.CMB.1.raw
  modified_base (190)..(190): a, c, t, g, unknown or other
  misc_feature (190)..(190): n is a, c, g, or t
  modified_base (848)..(848): a, c, t, g, unknown or other
  misc_feature (848)..(848): n is a, c, g, or t
tcagtcacgtactacacgaccggtgctcgatttagctacgctctaagggggggaggaggagcccagcactgggattccgaggtatttccattcggtgatcagcactgaacacagaggactcaccatggagtttggctgagctggttttccttgttgtcttagttttaaaggtgccctagtgtgaggtgcngcgtggtggagtcgtgggaggtaggtcgttgactccgacggtcccgttgggggggtccctacggaaggtaccgttcttcccgttgtcgtaccgaccggtccttccggttcggggttacctacccggttaccgaccggttccaaaccaacccttaacaccgttaggacgtcccggtaggggttccgtacccggacggtaccccgttacgggaacgggggtaaacgggggtcgtaagggtcggttcggtccgtttaccgttttcgtttttaaagttttagttagggttacggtttagggttaacgttaacgtacttaccggttacccgataaccggtacttacccggggttaggaaccgggggtctaacctttacccggaaccctacgttcctaccgggtaacggtaacgtaccgtaaaaccgtttaaccccggaaaacgaaacccggtaccggttacctttttaacgggtttaacccctttaattaaaaaccgggttaaccgttaaacgggtaaccccgttacggaacccggttaagggtacccgaaccgggttgtaacccggtaacggaccccgggttaaccgtttacgtacgtttaccggttcgagggtaacggaagtcggacgggtccgtaccggtaacgtaacttacgcggtacngtacgacggttccgacgggacacgggcctacgg

SEQ ID NO: 131198 - DNA, 715 bp, Homo sapiens
  misc_feature: GYAE6OF02FRPF1.13.65.F10.1.454.CMB.1.raw
  modified_base (319)..(319): a, c, t, g, unknown or other
  misc_feature (319)..(319): n is a, c, g, or t
  modified_base (323)..(323): a, c, t, g, unknown or other
  misc_feature (323)..(323): n is a, c, g, or t
  modified_base (488)..(488): a, c, t, g, unknown or other
  misc_feature (488)..(488): n is a, c, g, or t
tcagtcacgtactacacgaccggtgctcgatttagctacgctctaaggggacccaaaaaccacacccctccttgggagaatcccgtagatcacagctcctcaccatggactggacctggagcatcctttttcttggtggcagcggcaacaggtgtccaccctgaggttcagttggttcagtctggaggaggggtgaagaagccgtggggcctcagtgcaggtcgcctgcagggcctcgtgttacattttcgactaactttggcatctacgtgggtgcgacgacggcccctggccacggccttgagtcgcgtcggggtgntcgngttgttacgaacggtgacacgtacgtattgctacgagtaagttggaggcaggagtaccacccgtagaccaacagaccacgtacgtcccgacaaaccgaccacgtaccctacgtactaggaacctaggaacggtaatcgtacgaactagtactacggacggaaccncgggtaccctaagtaacttacgtttacgtcgtcgggtacgtaaggggtaacgggtttaccggggttttttacggggaccgggttaccgggtaccgttacccgtttcggttacgtacggtttaccggttccgggttaccgggggaccggttaagggggaaccgtaagggttccggttacccgggtacccggtttccgtttcccgttaccggtaccgttaacccccggg

SEQ ID NO: 131199 - DNA, 624 bp, Homo sapiens
  misc_feature: GYAE6OF02FTKFI.13.65.F10.1.454.CMB.1.raw
  modified_base (370)..(370): a, c, t, g, unknown or other
  misc_feature (370)..(370): n is a, c, g, or t
  modified_base (413)..(413): a, c, t, g, unknown or other
  misc_feature (413)..(413): n is a, c, g, or t
  modified_base (436)..(436): a, c, t, g, unknown or other
  misc_feature (436)..(436): n is a, c, g, or t
tcagtcacgtactacacgaccggtgctcgatttagctacgctctaaggggacccaaaaaaccacacccctccttgggagaatcccgtagatcacagctcctcaccatggactggacctggagcatcctttttcttggtggcagcggcaacaggtgtccaccctgaggttcagttggttcagtctggaggaggggtgaagaagcctggggcctcagtgcaggtcgcctgcagggcctctggttactattttcgacaactttggcatctactgggtcgcgacaggcccctggccgacggccttgagtcgcgtggggtgatcgagttgttaccgtaacggtgacacagtactttgcacagaagtttggagggnagagtcacctgaccacagacacatccgacaacacacgccacanaggaactgagaatctagactacnctacgacgacgacgaccaatattacttacgtggtagacgtaaggtaagggttacgggtttttacggggcggtaccggtaccgtacccgttcgttacgtaacgacgttcggtacggggtaccggacgggtaacgtaacggttacgggtaccgtaccgttaccgttaccgttaccgtaccgtaaccccgg

SEQ ID NO: 131200 - DNA, 780 bp, Homo sapiens
  misc_feature: GYAE6OF02GH5WM.13.65.F10.1.454.CMB.1.raw
  modified_base (551)..(551): a, c, t, g, unknown or other
  misc_feature (551)..(551): n is a, c, g, or t
tcagtcacgtactacacgaccggtgctcgatttagctacgctctaaggggggggagaggagcccagcactgggattccgaggtgtttccattcggtgatcagcactgaacacagaggactcaccatggagttttggctgagcttgggttttccttgttgcttattttaaaaggtgccagtgtgaggtgcagttggtggagtcgtggagggaggcgttgggtccgacgggccgggggggtccctggagactctcatgtgcggcctcgtgggcctcgaccgtacaaccaacctaactacagtgacgtcgtcgggtcccgccgaggtcctaccggaagggaaggacgggccggtagggtcgggtctacgtaagtttatttagtcggtccggtacggtcgtaccaacttacgttaccaccggactacgtaccgttccgggtagggtaacccggggtccggttaaccaccgtactccgtacgagaacgtaaccgtaacttaccgaaaacgtaacgtacggtacgttaactacttaaacgaaagttcggaaacccgnttacggagtacggtacggaacggtaccgaccggtccgtacttaacgttacgttcgtaagaaccgtaaagtcgtacgtacgaacgggaccgggtaacccgggtaccccggttaagggtccggggtaccggtttcggggtaacggggtttaccggtttttccgttttaggtttaccgttacgggtccggttccggggtaccgggggtaccccggacgggtttaaccccggg

SEQ ID NO: 131201 - DNA, 631 bp, Homo sapiens
  misc_feature: GYAE6OF02GKUWC.13.65.F10.1.454.CMB.1.raw
  modified_base (355)..(355): a, c, t, g, unknown or other
  misc_feature (355)..(355): n is a, c, g, or t
  modified_base (427)..(427): a, c, t, g, unknown or other
  misc_feature (427)..(427): n is a, c, g, or t
  modified_base (496)..(496): a, c, t, g, unknown or other
  misc_feature (496)..(496): n is a, c, g, or t
tcagtcacgtactacacgaccggtgctcgatttagctacgctctaagggggggagaggagcccagcactgggattccgaggtatttccattcggtgatcagcactgaacacagaggactcaccatggagttttggctgagctgggttttccttattactattttaaaaggtgtccagtgtgaggtgcagttggtggagtctggaggaggcttggtccaggccgggggggtccctgagactctcatgtgcggcctcgtcgggctcaccgtcaaccaccaactacatgagcgtggtccgccaggctccgaggagacggcggagtggtcgtctagttatttatgtcgacggtgaccanttcacgctagactcgtgacggggtccgtacacgatcctcagtacgactaatcaagaacgacgtgtatactanaaactagaactacgtgagacggtacgacggacaccggacgtactaacttgtacggttgaacgtaaacgngttacgagaacggtacggaaccgggtaccccgggttacggtccgggccgttaacggggtcgggttaagggttccgttttacgtttggtaccgtcggtacgttccggggggacgtaacccggggtaccttaccggg

SEQ ID NO: 131202 - DNA, 696 bp, Homo sapiens
  misc_feature: GYAE6OF02JA7Z5.13.65.F10.1.454.CMB.1.raw
  modified_base (190)..(190): a, c, t, g, unknown or other
  misc_feature (190)..(190): n is a, c, g, or t
  modified_base (336)..(336): a, c, t, g, unknown or other
  misc_feature (336)..(336): n is a, c, g, or t
  modified_base (380)..(380): a, c, t, g, unknown or other
  misc_feature (380)..(380): n is a, c, g, or t
  modified_base (416)..(416): a, c, t, g, unknown or other
  misc_feature (416)..(416): n is a, c, g, or t
tcagtcacgtactacacgaccggtgctcgatttagctacgctctaaggggacccaaaaaccacacccctccttgggagaatcccgtagatcacagctcctcaccatggactggacctggagcatccttttcttggtggcagcggcaacgaggtgtcccaccctgaggttcagttggttcagtctggaggnggggtgaaggaagccgtggggccgtcaggtgcgaggttccgcctggcgagggccctctggttactagttttcactaactttggcatacgtacgtgggtgcgacgacggcccctcggccaccggccttgacgttcgaccgtgggggngatacgaggttgttaacgacggtcgacaccgagtacttcgacanaggtattggacggcagtacgtccacctaggacccanaacggacacgtacgtcccggaacgactacacgccctaacgtactacggaacgtaggaacggtaactcgtacgaacgcttacgtagacccgtaaacgaccggtaccacgttaactactttaacgtcgttacggacggtaccgtaaggggttaccggttttcgggcggtacggtacccgttcgtacgttacgtacgtacggtccgggtaaccggaccgggtaacggtacgaacggtttacgtaccccgtaccgttaccgtttccctaccggtcgtaaccccg

SEQ ID NO: 131203 - DNA, 864 bp, Homo sapiens
  misc_feature: GYAE6OF02HEJHL.13.65.F10.1.454.CMB.1.raw
  modified_base (183)..(183): a, c, t, g, unknown or other
  misc_feature (183)..(183): n is a, c, g, or t
  modified_base (589)..(589): a, c, t, g, unknown or other
  misc_feature (589)..(589): n is a, c, g, or t
tcagtcacgtactacacgaccggtgctcgatttagctacgctctaagggggggagaggagcccagcactgggattccgaggtatttccattcggtgatcagcactgaacacagaggactcaccatggagttttggctgagctggttttccttgttgctattttaaaggtgccagtgtgaggtnacagtctggtggagtctggaggaggtcttgatccaggccgtgggggtccctgacgactctctgtgcagcctcgtcggttcaccgtcagtcaccacctacatggacgtcgtcgggtccgaccgtaggaccgtacggaaaggggagggtccgttagggaaggtcggtaccggttccgttttacttttaagttttaagttagggttaaggttagggtttaacgtaacctaacgttaaccgtacccgacgtaacgtaccgttaccggttacggggaccgggtaccgtaactttccaacccgtacgttcctacccgaaggtaacgtaaaccgttaacctttaacccgaaaacgtaacccgtaccgtacgttttacgggtttaaccttaaaccgtaaaacgtacggtaaacncccgggttaaccctaggaaaccggtacgtaaccccggtaagtaacccggtaacccggtaacccgggttacccgtttaagtttaaccctttacgggttacggtacggtaacgtaacggtaccgggtttacgggaacccgggggtaaccccgttaaacccggttaaaaccggtttaaccctaaccgggtaaccgttttacccggaccggggttacccggttaccggggttaacccggggggaacccggtaacccggggtaaacccgttaaccccggg

SEQ ID NO: 131204 - DNA, 797 bp, Homo sapiens
  misc_feature: GYAE6OF02JY2HG.13.65.F10.1.454.CMB.1.raw
  modified_base (222)..(222): a, c, t, g, unknown or other
  misc_feature (222)..(222): n is a, c, g, or t
tcagtcacgtactacacgaccggtgctcgatttagctacgctctaaggggacccaaaaaccacacccctccttgggagaatcccgtagatcacagctcctcaccatggactggacctggagcatcctttcttggtggcacgcggcaacgaggtgtccacctgaggttcagttggtcagtcgtggaggagggtgaagagcgtgggcctcgagtgcagggtccnctgcgacggcctgtacggtactatttcgactaacgttgcatcgtacgtgggtgcgacgacggtcccgtcgaccacggtccttggacgtcgtcggtggggtcgaacgttcgtacggttacgttaccgaacgggtcgaccgtaacgtacggtaccgtttggaccgtaacgtaaggtaaggtttacggaacggggttacgtacggtaaccgttcccgtaaccccgttaaggtaaccccgtaaagtaccggtaaaccgtaaccgtacgtacccgggaacctaaacccgaacgtaccgggtaccctaaacggagttaacgggtaacgtaccggaacggtaacctagtacgtaacgttacctacgaccggtaaccgtacccgtacggaacctagttaaccgtttaacggttaacgttacggtacggtaaccggagggttaaacgggttaccgggttttccgggtccggtacggtaccgtccgtttacggaccgtaggtaccggtaacggtacgggtaccggtaaggggtaccgtaacggttacgaccggttaccccttaggtacctccgtacccgtacccg

SEQ ID NO: 131205 - DNA, 674 bp, Homo sapiens
  misc_feature: GYAE6OF01E1GBV.37.13.B02.1.454.CMB.1.raw
  modified_base (330)..(330): a, c, t, g, unknown or other
  misc_feature (330)..(330): n is a, c, g, or t
tcagtagtgtagatcacgaccggtgctcgattttagtctagcgactttagggtttgggggaggcttggtaccagccctggggggtcccttgagacttctccttgtgcagcctctggttcatctttagcaactacgccatgtagctgggtccgccaggcttccagggaaggggctggtaagtgggtctcaggtattactggtagtggtaataccgtcatactacggcagactccgtgacggggccgttcaccgtctccagagacaattccaagatacggtctatctggaaatgaacagcctgagagccgaggacacggcccctgtattacngtgcgagagatcagacgagtatagcagcagctctagactacgtgggccacggaaccctggtccaccgtctcctcacgtccctaccacccgaaacgggccctacgtaccgggtaccctttccccccgtacggccctacccccgtcccttacccaaacgacgtaccacccgtaccgttaccggggggccaacgaacggacccgggccccgttacggggacccgtcggtcccgttcgggtacctaaacgggtaccttaccgtttacccgaacgtttccgtaacgtaccgttaacggtcggtaacggccgggtacgtacgggtacgaaaggggccgtacgacgtacgg

SEQ ID NO: 131206 - DNA, 567 bp, Homo sapiens
  misc_feature: GYAE6OF01C7YFD.37.13.B02.1.454.CMB.1.raw
  modified_base (551)..(551): a, c, t, g, unknown or other
  misc_feature (551)..(551): n is a, c, g, or t
tcagtagtgtagatcacgaccggtgctcgatttagtctagcgactttggggtttagggggacggacgttgggtacagcctaggggggtaccctggaggactctcctcgtgcagcccttctggttttcctaccctttcgacaagtgtagccatgacctgggtccgccgaggctccaggggaaggggctggagtgggtctcatccattagtagtagtggtacttacatatactacgcagactcagtgagggccgttcaccatctccagggacaattccaagaacacactgtctctgcaaatgaacagcctgagagtcgaggacacggccttatattactgtgtgaagggacctctagccccttatagcagcgctggtcctggtactttgacgactggggccagggaaccctggtcaccgtctcctcacgcctccaccaacgggccccatccggtcttccccctggccgccctgcctccaggacgccacctccgagagcacagccgccctgggcctcgcctggtcaagggcctacgttccactcctacactacngagcgggctgggaccg

SEQ ID NO: 131207 - DNA, 609 bp, Homo sapiens
  misc_feature: GYAE6OF01ECPBP.37.13.B02.1.454.CMB.1.raw
  modified_base (223)..(223): a, c, t, g, unknown or other
  misc_feature (223)..(223): n is a, c, g, or t
  modified_base (311)..(311): a, c, t, g, unknown or other
  misc_feature (311)..(311): n is a, c, g, or t
  modified_base (328)..(328): a, c, t, g, unknown or other
  misc_feature (328)..(328): n is a, c, g, or t
  modified_base (456)..(456): a, c, t, g, unknown or other
  misc_feature (456)..(456): n is a, c, g, or t
tcagtagtgtagatcacgaccggtgctcgatttagtctagcgactttgggttaggggggaggcttggtacagcctggggggtccctgagactctcctggtgcagccgacctggtttcatcttttacgcgaaccttaccgccatgagcgtgggtccgccgagggctccagggaaggggctggagtcgggtctcagggtacttactggtacgtggtaactaccgnatactacgcagactccggtgacgggccggttcaccgtctccagagacaacgttccaaagaatacggtctaatctaggaaatgtaaacngctgagagccgaggacnccggcctctattactgtgcgagagatcgacgacggtaagtaagtacggcagcagtctcgtgacgtacgtggggccacgggaacctggtcaccgtctcctcacgcctcaccgacggccatcgtctcccngcacctctcaacgctcacctgtacgggcacgacgtccggtcccgtgggtcctcggcccgtagggtacaaacgggtactaccttaccaacttaccgtaacgtacgttacgtcggacggccgggtacctcggacgtaagggtccgtgtacgtacg

SEQ ID NO: 131208 - DNA, 898 bp, Homo sapiens
  misc_feature: GYAE6OF01BRPGO.37.13.B02.1.454.CMB.1.raw
tcagtagtgtagatcacgaccggtgctcgatttagtctagcgactttaggggtttgggggaggcgttggtacctagccctggggggtccctgagactctcctgtgcagcctctggtttcatctttagccaactacgtccatgagctggggtccgccaggcgttccagggaagggcttggaggtgggtcggccaacatacgagggaggtggtggtacgaaaacgtatgtgggactctgtgcgggccgacgttcgaccagtctcctagacgacaacgccaaaacgtcactgtactccgtcgtaccaaagtcggacggtcctagaaggtacgttccggaacggtaccgaaccgggcgttggtacggtaagtttaacgttggtaggacggtaggtacgtactttacggaactaacggttaaaggttttcggagggttacggtaacgtttaggttataggtagttacggtcgtttaacgtacgtaacgttacccggtaggggtacccgaaacgggtacctacgttccggttaccgtaaccccggttcttacccgttacgaccggtaccccttaaccccgaaacccggtaaccggggaccccttaacggtttcccccgggtttaccccgtttacccccccggtagggtcccccgtacccccgttacgggtaacccgttaccccggaacggggtacccgtacccggtaacccccgtaccggggtaaccgggtaccgaccccgaaccgggtaccgggtcccgggtaccccggttaggggtacccgttccgggtacccggttacgggggttaacccgtaaacggggttcccgggttaaaccccgttccggaacgttccccggtaaacggtaccccggttacgggtacccgggacggggtaccccggg

SEQ ID NO: 131209 - DNA, 794 bp, Homo sapiens
  misc_feature: GYAE6OF01DTZAV.37.13.B02.1.454.CMB.1.raw
tcagtagtgtagatcacgaccggtgctcgatttagtctagcgactttgggtttagggggtagggcttgggtacacgcctggggggtccctggagactctcctgtgcagcctctggttcatctttagcaactacgccatgagcgtgggttccgccaggctccgagggggtaacggggcttgggagttggggttactcgagggtacttactgggtaggtggtaataccgcatactacgcagactccgtgacgggcgttcaccatctcgaggacaattccaagacacactgtctctgcgaaatcgaacagtcctagacgagtcgaggacgacggccttatagttactggtaggtaggaagggtaccgtacgttaggccccttagtacgtcacgcggtacgtggtccgttaggttacttagacgtaacgtcggggaccaacgggaccctgggtaccgaaccggtccttacccgttcacgtccctacccaacccgaacgggtaccccaacgttaccggtaacccttacccccgttacgggtcccggttaccccgttacgtacccttaacccgaaagtaaccggtaccgtaacccgttccgggttaccggggggacccgtaaccggaaccgggtacccgggtaccccggttcgggtaccgttcggtcccggttacgggttaccggaaacggggtaaccgttaacccggtttacccgtacggttaccgttaaccggtaacctttaccggttacggtaccgggtaccggggtaccggtacgggcccggtaacgggtacccgg

SEQ ID NO: 131210 - DNA, 734 bp, Homo sapiens
  misc_feature: GYAE6OF01C2L69.37.13.B02.1.454.CMB.1.raw
  modified_base (344)..(344): a, c, t, g, unknown or other
  misc_feature (344)..(344): n is a, c, g, or t
  modified_base (400)..(400): a, c, t, g, unknown or other
  misc_feature (400)..(400): n is a, c, g, or t
tcagtagtgtagatcacgaccggtgctcgatttagtctagcgactttggggtttcggggaggccttgggtacacgcctggggggtccctgagactctcctgtgcagcctctggttcatcttagcaactacgcagtgagcgtggtccgccgaggtccttccgaggggaacgggtcttagggaggttcgggtctacgtaggttattacgtggtagtggtaactaccggctacgtaacgtcgacgacgacctccggtggaccgggtccgttacacccgttcctccgaagacgaacaacgttccaaagtactaccggtcttaactcgtaaggtaaactcgaaaaccgnggccctaggacgacggaccggacggaccgtaccgggccccttagtaacgtttccgnggttacgtacggaggtaacgtagtacggaacggtaacggtagtaacgtacgacctaggactacggtctacgtacgacgtaccggtcggggaccctaaccggtaccctcggaccctacgtcctacctcgaccgtccctaaccgaaccgaccggtacctacgtccggtaccccttcccgtacgaccctccctacgaccgagtaccgactaccgtcggacgggaccacggcgccggtccgtcggtctcggtcgtacggactaacgtaccgtacctaccgtactacgtacgtacgtacgtcggacggtcggcggtacgacggaccggcgtcgagtacg

SEQ ID NO: 131211 - DNA, 538 bp, Homo sapiens
  misc_feature: GYAE6OF02HEE9D.37.13.B02.1.454.CMB.1.raw
  modified_base (531)..(538): a, c, t, g, unknown or other
  misc_feature (531)..(538): n is a, c, g, or t
tcagtagtgtagatcacgaccggtgctcgatttagtctagcgactttgggtttagggggaggcttggtacagcctgggggtccctgagactctcctgtgcagcctctggtttcatctttagcaactacgccatgagctgggtccgccaggctccagggaaggggctggagtgggtctcaggtattaatgggaatggtgataccacatactacgcagactccgtgaagggccggttcaccatctccagggacaattccaagaacacactgtctctgcaaatgaacagcctgagagtcgaggacacggccatgtattactgtacgagagaacagacgttggggccagggaaccctggtaccaccggtctcctcagccctccaccaagggcccatcggtccttcccctggccgccctgcctccaggacgccacctccgagacgccgacacgccgggcccctggggcctggccctggtcaacggtactaccttccatcctaccactactgacgcgggctggcaaggcgcagtagnnnnnnnn

SEQ ID NO: 131212 - DNA, 707 bp, Homo sapiens
  misc_feature: GYAE6OF02G2IJD.37.13.B02.1.454.CMB.1.raw
tcagtagtgtagatcacgaccggtgctcgatttagtctagcgactttagggtttgggggaagggcttgggtacagccttggggggtccctgagactctcctgtgcagcctctggtttcatcctttagcaactacgccagtgagctgggtccgccaggctccgaggggaagggctggagtgggtctcaggtattacgtggtagtggtaataccgcatacctacgcagactccgtgaccgggtccgttcaccgtctccagacgacaattccaagaactacggtctatctaggaaatgaacagcctagtaagagccgaggacacgggccctactaagttactgtcgacgagagatcagtacggatatagctagcagctctgacctacgtcggggaccacggaaccctgggtaccaccggttctcctacgacggccctaccgacccgtaacgggcccctaacgttcccgggtaccctttacccccgtacgggaccctaaccccgttacccttaacccgaaacggtaccgtacctacccgttccggtaccgggggtacctaaccgtaccgggtcccggtacccggtacggggccttacggtacccgtacgggttaccgaacggttaccttaccgtttacccgacgttaccgtaacctaaccttaccgtacggacgtccgggtacgtacgggccgtaaggccgtacgagtacg

SEQ ID NO: 131213 - DNA, 273 bp, Homo sapiens
  misc_feature: GYAE6OF02G5D1L.37.13.B02.1.454.CMB.1.raw
  modified_base (186)..(186): a, c, t, g, unknown or other
  misc_feature (186)..(186): n is a, c, g, or t
  modified_base (214)..(214): a, c, t, g, unknown or other
  misc_feature (214)..(214): n is a, c, g, or t
  modified_base (235)..(273): a, c, t, g, unknown or other
  misc_feature (235)..(273): n is a, c, g, or t
tcagtagtgtagatcacgaccggtgctcgatttagtctagcgactttgtgtttggggggaggcttggtacagcctggggggtccctgagactctcctgtgcagcctctggtttcatctttagcactacgccatgagctgggtcccgccagggcctaccgaaggggaaggggctgggaggtgggtcnctaggtattacgtggtaggtaggttaanaccgcattaacgtacgcaacnnnnnnnnnnnnnnnnnnnnnnnnnnnnnnnnnnnnnnn

SEQ ID NO: 131214 - DNA, 439 bp, Homo sapiens
  misc_feature: GYAE6OF01AI4I5.7.27.C05.1.454.CMB.1.raw
  modified_base (400)..(400): a, c, t, g, unknown or other
  misc_feature (400)..(400): n is a, c, g, or t
  modified_base (433)..(439): a, c, t, g, unknown or other
  misc_feature (433)..(439): n is a, c, g, or t
tcagcgtgtctctacacgaccggtgctcgatttagacgcgatcgaagggtttggggccccagggcagagggtcaccatctcctgcactgggaacgcctccaacatcgggactttttatgatgcacactggtaccagcgccttccaggaacagcccccaccctcctcattcataataataacattcggccctcaggggtccctgaccgcttctctggctccaagtctggctcctcagcctccctggccatcactgggctccaggctgacgatgagggtgaatattactgccagtcatatgacagcagcctgcgtctttgggtgttcggcggagggccaagctgaccgtctacgtcagcccaaggctgccccctggtcactctgttcccaccctcctctagngacacgctgagcgggctgggcaaggcgcatagnnnnnnn

SEQ ID NO: 131215 - DNA, 440 bp, Homo sapiens
  misc_feature: GYAE6OF01EEZBJ.7.27.C05.1.454.CMB.1.raw
  modified_base (434)..(440): a, c, t, g, unknown or other
  misc_feature (434)..(440): n is a, c, g, or t
tcagcgtgtctctacacgaccggtgctcgatttagacgcgatcgaagggtttggggccccagggcagagggtcaccatctcctgcactgggaacgcctccaacatcgggactttttatgatgcacactggtaccagcgccttccaggaacagcccccaccctcctcattcataataataacattcggccctcaggggtccctgaccgcttctctggctccaagtctggctcctcagcctccctggccatcactgggctccaggctgacgatgagggtgaatattactgccagtcatatgacagcagcctgcgtctttgggtgttcggcggagggaccaagctgaccgtcctacgtcagcccaaggctgccccctcggtcactctgttcccaccctctctagagacacgctgagcgggctggcaaggcgcatagnnnnnnn

SEQ ID NO: 131216 - DNA, 436 bp, Homo sapiens
  misc_feature: GYAE6OF01ETJ7Z.7.27.C05.1.454.CMB.1.raw
  modified_base (433)..(436): a, c, t, g, unknown or other
  misc_feature (433)..(436): n is a, c, g, or t
tcagcgtgtctctacacgaccggtgctcgatttagacgcgatcgaagggtttgggccccagggcagagggtcaccatctcctgcactgggaacgcctccaacatcgggacttttatgatgcacactggtaccagcgccttccaggaacagcccccaccctcctcattcataataataacattcggccctcaggggtccctgaccgcttctctggctccaagtctggctcctcagcctccctggccatcactgggctccaggctgacgatgagggtgaatattactgccagtcatatgacagcagcctgcgtctttgggtgttcggcggagggaccaagctgaccgtcctacgtcagcccaaggctgccccctcggtcactctgttcccgccctcctctagagacacgctgagcgggctggcaaggcgcatagnnnn

SEQ ID NO: 131217 - DNA, 438 bp, Homo sapiens
  misc_feature: GYAE6OF01D3GRM.7.27.C05.1.454.CMB.1.raw
  modified_base (434)..(438): a, c, t, g, unknown or other
  misc_feature (434)..(438): n is a, c, g, or t
tcagcgtgtctctacacgaccggtgctcgatttagacgcgatcgaagggtttggggccccagggcagagggtcaccatctcctgcactgggaacgcctccaacatcgggactttttatgatgcacactggtaccagcgccttccaggaacagcccccaccctcctcattcataataataacattcggccctcaggggtccctgaccgcttctctggctccaagtctggctcctcagcctcctggccatcactgggctccaggctgacgatgagggtgaatattactgccagtcatatgacagcagcctgcgtctttgggtgttcggcggagggaccaagctgaccgtcctacgtcagcccaaggctgccccctcggtcactctgttcccaccctcctctagagacacgctgagcgggctggcaaggcgcatagnnnnn

SEQ ID NO: 131218 - DNA, 451 bp, Homo sapiens
  misc_feature: GYAE6OF01CX36B.7.27.C05.1.454.CMB.1.raw
  modified_base (440)..(451): a, c, t, g, unknown or other
  misc_feature (440)..(451): n is a, c, g, or t
tcagcgtgtctctacacgaccggtgctcgatttagacgcgatcgaagggtttggggccccagggcagagggtcaccatctcctgcactgggaacgcctccaacatcgggactttttatgatgcacactggtaccagcgccttccaggaacagcccccaccctcctcattcataataataacattcggccctcaggggtccctgaccgcttctctggctccaagtctggctcctcagcctccctggccatcactgggctccaggctgacgatgagggtgaatattactgccagtcatatgacagcagcctgcgtctttgggtgttcggcggagggaccaagctgaccgtcctacgtcagcccaaggctcgccccctcggtcactctcgttccccgccctcctctagacgacacgctgagcgggctgggcaaggcgcatagnnnnnnnnnnnn

SEQ ID NO: 131219 - DNA, 448 bp, Homo sapiens
  misc_feature: GYAE6OF01AE5HD.7.27.C05.1.454.CMB.1.raw
  modified_base (441)..(448): a, c, t, g, unknown or other
  misc_feature (441)..(448): n is a, c, g, or t
tcagcgtgtctctacacgaccggtgctcgatttagacgcgatcgaagggtttggggccccagggcagagggtcaccatctcctgcactgggaacgcctccaacatcgggactttttatgatgcacactggtaccagcgccttccaggaacagcccccaccctcctcattcataataataacattcggccctcaggggtccctgaccgcttctctggctccaagtctggctcctcagcctccctggccatcactgggctccaggctgacgatgagggtgaatattactgccagtcatatgacagcagcctgcgtctttgggtgttcggcggagggaccaagctgaccgtcctacgtcagcccaaggctcgccccctcggtcactctcgttccccaccctcctctagacgacacgctgagcgggctgggcaaggcgcatacgnnnnnnnn

SEQ ID NO: 131220 - DNA, 442 bp, Homo sapiens
  misc_feature: GYAE6OF01D2UZO.7.27.C05.1.454.CMB.1.raw
  modified_base (435)..(442): a, c, t, g, unknown or other
  misc_feature (435)..(442): n is a, c, g, or t
tcagcgtgtctctacacgaccggtgctcgatttagacgcgatcgaagggtttggggccccagggcagagggtcaccatctcctgcactgggaacggctccaacatcgggactttttatgatgcacactggtaccagcgccttccaggaacagcccccaccctcctcattcataataataacattcggccctcaggggtccctgaccgcttctctggctccaagtctggctcctcagcctccctggccatcactgggctccaggctgacgatgagggtgaatattactgccagtcatatgacagcagcctgcgtctttgggtgttcggcggagggaccaagctgaccgtcctacgtcagcccaaggctgccccctggtcactctgttcccgccctcctctagagacacgctgagcgggctgggcaaggcgcatagnnnnnnnn

SEQ ID NO: 131221 - DNA, 452 bp, Homo sapiens
  misc_feature: GYAE6OF01AQHXK.7.27.C05.1.454.CMB.1.raw
  modified_base (441)..(452): a, c, t, g, unknown or other
  misc_feature (441)..(452): n is a, c, g, or t
tcagcgtgtctctacacgaccggtgctcgatttagacgcgatcgaagggtttggggccccagggcagagggtcaccatctcctgcactgggaacgcctccaacatcgggactttttatgatgcacactggtaccagcgccttccaggaacagcccccaccctcctcattcataataataacattcggccctcaggggtccctgaccgcttctctggctccaagtctggctcctcagcctccctggccatcactgggctccaggctgacgatgagggtgaatattactgccagtcatatgacagcagcctgcgtctttgggtgttcgggcggagggaccaagctgaccgtcacgtcagcccaaggctcgccccctggtccactctcgttccccaccctcctctacgacgacacgctgagcgggctgggcaagggcgcatagnnnnnnnnnnnn

SEQ ID NO: 131222 - DNA, 441 bp, Homo sapiens
  misc_feature: GYAE6OF01B2V1L.7.27.C05.1.454.CMB.1.raw
  modified_base (431)..(431): a, c, t, g, unknown or other
  misc_feature (431)..(431): n is a, c, g, or t
  modified_base (436)..(441): a, c, t, g, unknown or other
  misc_feature (436)..(441): n is a, c, g, or t
tcagcgtgtctctacacgaccggtgctcgatttagacgcgatcgaagggtttggggccccagggcagagggtcaccatctcctgcactgggaacgcctccaacatcgggactttttatgatgcacactggtaccagcgccttccaggaacagcccccaccctcctcattcataataataacattcggccctcaggggtccctgaccgcttctctggctccaagtctggctcctcagcctccctggccatcactgggctccaggctgacgatgagggtgaatattactgccagtcatatgacagcagcctgcgtctttgggtgttcggcggagggaccaagctgaccgtcctacgtcagcccaaggctcgccccctggtcactcctgttccccaccctcctctagacgacacgctgagcgggctggcaggcncatgnnnnnn

SEQ ID NO: 131223 - DNA, 467 bp, Homo sapiens
  misc_feature: GYAE6OF01CQTT1.7.27.C05.1.454.CMB.1.raw
  modified_base (398)..(398): a, c, t, g, unknown or other
  misc_feature (398)..(398): n is a, c, g, or t
  modified_base (453)..(467): a, c, t, g, unknown or other
  misc_feature (453)..(467): n is a, c, g, or t
tcagcgtgtctctacacgaccggtgctcgatttagacgcgatcgaagggtttggggccccagggcagagggtcaccatctcctgcactgggaacgcctccaacatcgggactttttatgatgcacactggtaccagcgccttccaggaacagcccccaccctcctcattcataataataacattcggccctcaggggtccctgaccgcttctctggctccaagtctggctcctcagcctcctggccatcactgggctccaggctgacgatggagggtgaatattactgccagtcatatgacagcagcctgcgttcgtttgggtgttcgggcggagggaccaagctcgaccgtctacgtcagcccaaggctcgccccctcggtcactcctcgtaccccnccctcctctacgacgacacgctggacggccgggctgggacgaacggcgacatagnnnnnnnnnnnnnnn

SEQ ID NO: 131224 - DNA, 454 bp, Homo sapiens
  misc_feature: GYAE6OF01E5ZPN.7.27.C05.1.454.CMB.1.raw
  modified_base (443)..(454): a, c, t, g, unknown or other
  misc_feature (443)..(454): n is a, c, g, or t
tcagcgtgtctctacacgaccggtgctcgatttagacgcgatcgaagggtttggggccccagggcagagggtcaccatctcctgcactgggaacgcctccaacatcgggactttttatgatgcacactggtaccagcgccttccaggaacagcccccaccctcctcattcataataataacattcggccctcaggggtccctgaccgcttctctggctccaagtctggctcctcagcctccctggccatcactgggctccaggctgacgatgagggtgaatattactgccagtcatatgacagcagcctgcgttctttgggtgttcggcggagggaccaagctgaccgtcctacgtcagcccaaggctcgccccctcggtcactctcgttccccaccctcctctagacgacacgctgacgcgggctgggcaagggcgcatagnnnnnnnnnnnn

SEQ ID NO: 131225 - DNA, 449 bp, Homo sapiens
  misc_feature: GYAE6OF01EZ8B5.7.27.C05.1.454.CMB.1.raw
  modified_base (322)..(322): a, c, t, g, unknown or other
  misc_feature (322)..(322): n is a, c, g, or t
  modified_base (400)..(400): a, c, t, g, unknown or other
  misc_feature (400)..(400): n is a, c, g, or t
  modified_base (439)..(449): a, c, t, g, unknown or other
  misc_feature (439)..(449): n is a, c, g, or t
tcagcgtgtctctacacgaccggtgctcgatttagacgcgatcgaagggtttggggccccagggcagagggtcaccatctcctgcactgggaacgcctccaacatcgggactttttatgatgcacactggtaccagcgccttccaggaacagcccccaccctcctcattcataataataacattcggccctcaggggtccctgaccgcttctctggctccaagtctggctcctcagcctccctggccatcactgggctccaggctgacgatgagggtgaatattactgccagtcatatgacagcagcctgcgtctttgggtnttcggcggagggaccaagctgaccgtcctacgtcagcccaaggctgccccctcggtcactctgttccccacccttccnctagacgacacgctgagcgggctgggcaaggcgcatagnnnnnnnnnnn

SEQ ID NO: 131226 - DNA, 546 bp, Homo sapiens
  misc_feature: GYAE6OF01DBNVI.7.27.C05.1.454.CMB.1.raw
  modified_base (511)..(515): a, c, t, g, unknown or other
  misc_feature (511)..(515): n is a, c, g, or t
  modified_base (517)..(526): a, c, t, g, unknown or other
  misc_feature (517)..(526): n is a, c, g, or t
  modified_base (528)..(530): a, c, t, g, unknown or other
  misc_feature (528)..(530): n is a, c, g, or t
  modified_base (532)..(532): a, c, t, g, unknown or other
  misc_feature (532)..(532): n is a, c, g, or t
  modified_base (534)..(534): a, c, t, g, unknown or other
  misc_feature (534)..(534): n is a, c, g, or t
  modified_base (536)..(536): a, c, t, g, unknown or other
  misc_feature (536)..(536): n is a, c, g, or t
  modified_base (538)..(538): a, c, t, g, unknown or other
  misc_feature (538)..(538): n is a, c, g, or t
  modified_base (540)..(546): a, c, t, g, unknown or other
  misc_feature (540)..(546): n is a, c, g, or t
tcagcgtgtctctacacgaccggtgctcgatttagacgcgatcgaagggtttaggggccccagggacgagagggtcaccatcctcctgcactgggaacgcctccaacatcgggactttttactgatgcacactgggtaccagcgccttccaggacagcccccaccctcctcattcataataataacattcggccctcaggggtccctgaccgcttctctggctccaagtctggctcctcagcctccctggccatcactggctcaggctgacgatgaggtgaatattactgccagtcatatgacagacagcctgccgttactttgggtgtttcggcggagggaccaagctacgaccgtcctacgtacacggccccaaagggcctacggtcccccctcgggttacaaccgttccgttcggtttcccccacccgttcccttacgttaacgttaacgtaccaaccgcttggaacggtccgggcgttcgggcaaacgggcgccgaagtaaggcagnnnnntnnnnnnnnnncnnngngngngngnnnnnnn

SEQ ID NO: 131227 - DNA, 481 bp, Homo sapiens
  misc_feature: GYAE6OF01B4YEC.7.27.C05.1.454.CMB.1.raw
  modified_base (284)..(284): a, c, t, g, unknown or other
  misc_feature (284)..(284): n is a, c, g, or t
  modified_base (403)..(403): a, c, t, g, unknown or other
  misc_feature (403)..(403): n is a, c, g, or t
  modified_base (456)..(481): a, c, t, g, unknown or other
  misc_feature (456)..(481): n is a, c, g, or t
tcagcgtgtctctacacgaccggtgctcgatttagacgcgatcgaagggtttgggggccccagggcagagggtcaccatctcctgcactgggaacgcctccaacatcgggactttttatgatgcacactggtaccagcgcccttccaggaacagccccccaccctcctcattcataataataacattcggccctcaggggtccctgaccgcttctctggctccaagtctggcctcctcagccctccctggccatcacgtgggctccaggctgacgatggaggtnaattattactgccagtcatatgacagcagcctgcgttgtttgggtgttcggcggaggaccagctgaccgtcgtacgtcacgccaaggctacgcccctcggtcacgttcgtcgttccccnccctcctctagacgacacgctcgaggcgggctggacgaacggcgacagtagcnnnnnnnnnnnnnnnnnnnnnnnnnn

SEQ ID NO: 131228 - DNA, 477 bp, Homo sapiens
  misc_feature: GYAE6OF01BXYLQ.7.27.C05.1.454.CMB.1.raw
  modified_base (280)..(280): a, c, t, g, unknown or other
  misc_feature (280)..(280): n is a, c, g, or t
  modified_base (332)..(332): a, c, t, g, unknown or other
  misc_feature (332)..(332): n is a, c, g, or t
  modified_base (417)..(417): a, c, t, g, unknown or other
  misc_feature (417)..(417): n is a, c, g, or t
  modified_base (447)..(477): a, c, t, g, unknown or other
  misc_feature (447)..(477): n is a, c, g, or t
tcagcgtgtctctacacgaccggtgctcgatttagacgcgatcgaagggtttggggccccagggcggagagggtcaccatctcctgcactgggaacgcctccaacatcgggactttttatcgatgcacactggtaccagcgccttccaggaacagcccccacctcctcattcataataataacattcggcccctcaggggtcccctgaccgcttcctctggctccaagtctggctcctcacgcctccctggccatcactggctcagctgacgatgaggtnaatattactcgcccagtccatatgacagcagcctgcgtcttgggtgttcggnggtaggacctaagctgaccgtcacgtcacgcccaaggcctcgccccctggtccactcctcgttccccgccctcctctagacgacncgctgacgcgggtctggcaaggcgcatagnnnnnnnnnnnnnnnnnnnnnnnnnnnnnnn

SEQ ID NO: 131229 - DNA, 612 bp, Homo sapiens
  misc_feature: GYAE6OF01B0614.7.27.C05.1.454.CMB.1.raw
  modified_base (278)..(278): a, c, t, g, unknown or other
  misc_feature (278)..(278): n is a, c, g, or t
  modified_base (590)..(612): a, c, t, g, unknown or other
  misc_feature (590)..(612): n is a, c, g, or t
tcagcgtgtctctacacgaccggtgctcgatttagacgcgatcgaagggtttggggccccagggcagagggtcaccatctcctgcactgggaacgcctccaacatcgggactttttatgatgcacactggtaccagcgccttccaggaacagcccccacctcctcattcataataataacattcggccctcaggggtccctgaccgcttctctggctccaagtctggctcctcagcctccctggccatcactgggctccaggctgacgatggagggtnaattattactgccagtcatatgacagcagccgtgtcgttcgttttggggtcggtttcggggacgggtaacgggaaccctaaggtccgtacggtacccgttcccgttaaccggtccgaccgaccccgaaacgggtccttacccggccccccccgttcgggtaccctaccctttcccgttccgtttaccccccccgtaacccccgtttccccgttacccgttaacgggaaccgtaacccgtaacccgtcgttacgggacggggtcccgggggtaccgtacggggaccggaaacgggcccggtacctagtaggcnnnnnnnnnnnnnnnnnnnnnnn

SEQ ID NO: 131230 - DNA, 475 bp, Homo sapiens
  misc_feature: GYAE6OF01B4RFA.7.27.C05.1.454.CMB.1.raw
  modified_base (282)..(282): a, c, t, g, unknown or other
  misc_feature (282)..(282): n is a, c, g, or t
  modified_base (320)..(320): a, c, t, g, unknown or other
  misc_feature (320)..(320): n is a, c, g, or t
  modified_base (423)..(423): a, c, t, g, unknown or other
  misc_feature (423)..(423): n is a, c, g, or t
  modified_base (460)..(475): a, c, t, g, unknown or other
  misc_feature (460)..(475): n is a, c, g, or t
tcagcgtgtctctacacgaccggtgctcgatttagacgcgatcgaagggtttggggccccagggcagagggtcaccatctcctgcactgggaacgcctccaacatcgggactttttatgatgcacactggtaccagcgccttccaggaacacgcccccaccctcctcattcataataataacattcggccctcaggggtccctgaccgcttctctggctccaagtctggctcctcagccctcctggccatcactgggcctccgaggctgacgatggagggtnaattattactgccagtcatatgacagcagcctgcgttntttgggtgttcgggcggaggaccaagctgaccgtcctacgtcacggcccaaggcctccgccccctgtccactcgttccgtccccgccctcctctacgacgacncgctggacggccggcgtcgggacgaggccgcatacgnnnnnnnnnnnnnnnn

SEQ ID NO: 131231 - DNA, 449 bp, Homo sapiens
  misc_feature: GYAE6OF01DU90X.7.27.C05.1.454.CMB.1.raw
  modified_base (439)..(449): a, c, t, g, unknown or other
  misc_feature (439)..(449): n is a, c, g, or t
tcagcgtgtctctacacgaccggtgctcgatttagacgcgatcgaagggtttggggccccagggcagagggtcaccatctcctgcactgggaacgcctccaacatcgggactttttatgatgcacactggtaccagcgccttttccaggaacagcccccaccctcctcattcataataataacattcggccctcaggggtccctgaccgcttctctggctccaagtctggctcctcagcctccctggccatcactgggctccaggctgacgatgagggtgaatattactgccagtcatatgacagcagcctgcgtcgtttgggtgttcggcgggaggacaagctcgaccgtcctacgtcacgcccaagcctcgcccctcgtcactctcgtcccacctcctctagacgacacgctgacgcgggctggcaaggcgcatagnnnnnnnnnnn

SEQ ID NO: 131232 - DNA, 457 bp, Homo sapiens
  misc_feature: GYAE6OF01A5U6E.7.27.C05.1.454.CMB.1.raw
  modified_base (436)..(457): a, c, t, g, unknown or other
  misc_feature (436)..(457): n is a, c, g, or t
tcagcgtgtctctacacgaccggtgctcgatttagacgcgatcgaagggtttggggccccagggcagagggtcaccatctcctgcactgggaacgcctccaacatcgggactttttatgatgcacactggtaccagcgccttccaggaacagcccccaccctcctcattcataataataacattcggccctcaggggtccctgaccgcttctctggctccaagtctggctctcagcctcctggccatcactgggctcaggctgacgatgagggtgaatattaactgccagtcatatgacagcagcctgcgtctttgggtgttcggcggagggaccaagctgaccgtctacgcagcccaaaggctcgccccctcggtcactctcgttccccaccctcctctagcgacacgctgaggcgggctgggcaggcgcatagnnnnnnnnnnnnnnnnnnnnnn

SEQ ID NO: 131233 - DNA, 491 bp, Homo sapiens
  misc_feature: GYAE6OF01E1VIR.7.27.C05.1.454.CMB.1.raw
  modified_base (469)..(469): a, c, t, g, unknown or other
  misc_feature (469)..(469): n is a, c, g, or t
  modified_base (471)..(491): a, c, t, g, unknown or other
  misc_feature (471)..(491): n is a, c, g, or t
tcagcgtgtctctacacgaccggtgctcgatttagacgcgatcgaagggtttggggcccccagggcagagggtcaccatctcctgcactgggaacgcctccaacatcgggactttttatgatgcacactggtaccagcgccttccaggaacagcccccaccctcctcattcataataataacattcggccctcaggggtccctgaccgcttctctggctccaagtctggctcctcagcctccctggccatcactgggctccaggctgacgatggagggtgaatattactgccagtcatatgacagcagcctggcgttcgttttgggtgttcgggcggagggaccaagctgacccgtcctacgtcacgcccaaggcctcggccccctcggtccactcctcgttccccacccttcctctagacgaccacgctggacggccggggctgggacaacgggccgaccaagtacgngnnnnnnnnnnnnnnnnnnnnn

SEQ ID NO: 131234 - DNA, 474 bp, Homo sapiens
  misc_feature: GYAE6OF01DZ53Y.7.27.C05.1.454.CMB.1.raw
  modified_base (335)..(335): a, c, t, g, unknown or other
  misc_feature (335)..(335): n is a, c, g, or t
  modified_base (454)..(474): a, c, t, g, unknown or other
  misc_feature (454)..(474): n is a, c, g, or t
tcagcgtgtctctacacgaccggtgctcgatttagacgcgatcgaagggtttggggccccagggcagagggtcaccatctcctgcactgggaacgcctccaacatcgggactttttatgatgcacactggtaccagcgccttccaggaacacgcccccaccctcctcattcataataataacattcggccctcagggggtcccctgaccgcttctctggctccaagtctggctcctcacgcctccctggccatccactgggctccaggctgacgatgagggtgaatattactgccagtcatatgacagcagcctgcgttctttgggtgttcgggnggaggaccaagtctgaccgtcctagtccagcccaaggcctcgcccctggtcactctcgttccccgccctctctacgagacacgctgacggcgggcgtcgggcaacgggccgctagacgnnnnnnnnnnnnnnnnnnnnn

SEQ ID NO: 131235 - DNA, 558 bp, Homo sapiens
  misc_feature: GYAE6OF01CU3E1.7.27.C05.1.454.CMB.1.raw
  modified_base (530)..(533): a, c, t, g, unknown or other
  misc_feature (530)..(533): n is a, c, g, or t
  modified_base (535)..(558): a, c, t, g, unknown or other
  misc_feature (535)..(558): n is a, c, g, or t
tcagcgtgtctctacacgaccggtgctcgatttagacgcgatcgaagggtttggggcccccagggcagagggtcaccatctcctgcactgggaacgcctccaacatcgggacttttttatgatgcacactggtaccagcgccttccaggaacacgcccccaccctcctcattcataataataacattcggccctcaggggtccctgaccgcttctctggctccaagtctggctcctcacgccctccctggccatcacgtgggcctccaggctgacgatggagggtagaatattactgccagtcatatgacagcagcctgtcgttcgtttgggtgttcgggcgggtagggaccaaggtcctggacccgttccgtacgtcgaacgtcccgaaaggcctcgccccccgttcggtcctaccgttcccgttcgttaccccctaccccctccgttaccgtaacgacgaccacggtcgtcggaacgggtccggggtaccgtcggggaccgaacgggccgtacgaacgttacgagcgnnnngnnnnnnnnnnnnnnnnnnnnnnnn

SEQ ID NO: 131236 - DNA, 459 bp, Homo sapiens
  misc_feature: GYAE6OF01DHTL3.7.27.C05.1.454.CMB.1.raw
  modified_base (279)..(279): a, c, t, g, unknown or other
  misc_feature (279)..(279): n is a, c, g, or t
  modified_base (415)..(415): a, c, t, g, unknown or other
  misc_feature (415)..(415): n is a, c, g, or t
  modified_base (449)..(459): a, c, t, g, unknown or other
  misc_feature (449)..(459): n is a, c, g, or t
tcagcgtgtctctacacgaccggtgctcgatttagacgcgatcgaagggtttggggccccagggcagagggtcaccatctcctgcactgggaacgcctccaacatcgggactttttatgatgcacactggtaccagcgccttccaggaacacgcccccaccctcctcattcataataataacattcggccctcaggggtccctgaccgcttctctggctccaagtctggctcctcagcctcctggccatcactgggctccgaggctgacgatggaggtnaatattactgccagtcatatgacagcagcctgcgttcgtttgggtgttcgggcgggaggaccaagctacgaccgtctacgtcacgcccaggcctcgcccctgtccactcctcgtcccaccctcctactagacgacncgctgacggcggcgtcggacgaaggcgacatagnnnnnnnnnnn

SEQ ID NO: 131237 - DNA, 649 bp, Homo sapiens
  misc_feature: GYAE6OF01CBTCM.7.27.C05.1.454.CMB.1.raw
  modified_base (198)..(198): a, c, t, g, unknown or other
  misc_feature (198)..(198): n is a, c, g, or t
  modified_base (335)..(335): a, c, t, g, unknown or other
  misc_feature (335)..(335): n is a, c, g, or t
  modified_base (584)..(584): a, c, t, g, unknown or other
  misc_feature (584)..(584): n is a, c, g, or t
  modified_base (595)..(595): a, c, t, g, unknown or other
  misc_feature (595)..(595): n is a, c, g, or t
  modified_base (604)..(604): a, c, t, g, unknown or other
  misc_feature (604)..(604): n is a, c, g, or t
  modified_base (611)..(611): a, c, t, g, unknown or other
  misc_feature (611)..(611): n is a, c, g, or t
  modified_base (613)..(614): a, c, t, g, unknown or other
  misc_feature (613)..(614): n is a, c, g, or t
  modified_base (616)..(616): a, c, t, g, unknown or other
  misc_feature (616)..(616): n is a, c, g, or t
  modified_base (620)..(620): a, c, t, g, unknown or other
  misc_feature (620)..(620): n is a, c, g, or t
  modified_base (633)..(633): a, c, t, g, unknown or other
  misc_feature (633)..(633): n is a, c, g, or t
  modified_base (635)..(635): a, c, t, g, unknown or other
  misc_feature (635)..(635): n is a, c, g, or t
  modified_base (637)..(637): a, c, t, g, unknown or other
  misc_feature (637)..(637): n is a, c, g, or t
  modified_base (639)..(639): a, c, t, g, unknown or other
  misc_feature (639)..(639): n is a, c, g, or t
  modified_base (642)..(642): a, c, t, g, unknown or other
  misc_feature (642)..(642): n is a, c, g, or t
tcagcgtgtctctacacgaccggtgctcgatttagacgcgatcgaagggtttgggggccccagggccagagggtcaccatctcctgcgactgggaacgccgtcccaacatcgggactttttatggactcgcacactggtaccagcgcccttcgaggaaccaagcccccacctcctcacttcaataataaactaaactntttccggccctcgaggggtccctgacccgtcttctctggcctccaaggtcctgcctcctcagtccctcccgtggcccatcacgttcgggcctccgagggtcgtgaccgtatggaaggggtcaaaattacttaaccgnggaccctacgtccattagtcgtacaggtcacggcctcgtaccgtttcgtttggggtcggttccgggacggtacgggaacccaaggtcctacggacccgtcctaacggtcaacggtccccgaaagggtcctaccgccccccttggtacctaaccttcgtaccgttacccccacctcctctaacggacgaccaaccgtcgtacggaacggtccgggtacctacggaacgtaaacggccgtaccaataacgntactcgactcncggctcggngcgacgngnngnacanacgcgtgcgcgcncncncnctnctctctc

SEQ ID NO: 131238 - DNA, 446 bp, Homo sapiens
  misc_feature: GYAE6OF01DUFNQ.7.27.C05.1.454.CMB.1.raw
  modified_base (440)..(446): a, c, t, g, unknown or other
  misc_feature (440)..(446): n is a, c, g, or t
tcagcgtgtctctacacgaccggtgctcgatttagacgcgatcgaagggtttggggccccggggcagagggtcaccatctcctgcactgggaacgcctccaacatcgggactttttatgatgcacactggtaccagcgccttccaggaacagcccccaccctcctcattcataataataacattcggccctcaggggtccctgaccgcttctctggctccaagtctggctcctcagcctccctggccatcactgggctccaggctgacgatgagggtgaatattactgccagtcatatgacagcagcctgcgtcgtttgggtgttcggcggagggaccaagctgaccgtcctacgtcagcccaaggctcgcccctggtcactctcgttcccgccctctctagacgacacgcgtgacgcgggctggcaagggcgcagtagnnnnnnn

SEQ ID NO: 131239 - DNA, 463 bp, Homo sapiens
  misc_feature: GYAE6OF01B6GCS.7.27.C05.1.454.CMB.1.raw
  modified_base (450)..(463): a, c, t, g, unknown or other
  misc_feature (450)..(463): n is a, c, g, or t
tcagcgtgtctctacacgaccggtgctcgatttagacgcgatcgaagggtttggggcccccagggcagagggtcaccatctcctgcactgggaacgcctccaacatcgggactttttatgatgcacactggtaccagcgccttccaggaacacgcccccaccctcctcattcataataataacattcggccctcaggggtccctgaccgcttctctggctccaagtctggctcctcacgccctccctggccatcacgtgggctccaggctgacgatgagggtgaatattactgccagtcatatgacagcagcctgcgttcgtttgggtgttcgggcggaggaccaagctcgaccgtctacgtcacgcccaagcctcgcccctgcactctcgttccccaccctctctagacgacacgctggacggcgggcgtggacgaaggcgacagtagnnnnnnnnnnnnnn

SEQ ID NO: 131240 - DNA, 475 bp, Homo sapiens
  misc_feature: GYAE6OF01BBD6W.7.27.C05.1.454.CMB.1.raw
  modified_base (463)..(475): a, c, t, g, unknown or other
  misc_feature (463)..(475): n is a, c, g, or t
tcagcgtgtctctacacgaccggtgctcgatttagacgcgatcgaagggtttggggccccagggcagagggtcaccatctcctgcactgggaacgcctccaacatcgggactttttatgatgcacactggtaccagcgccttccaggaacagcccccaccctcctcattcataataataacattcggccctcaggggtccctgaccgcttctctggctccaagtctggctcctcagccctcctggccatcactgggctccaggctgacgatgagggtgaatattactgccagtcatatgacagcagcctgcgttcgttttgggtcgttcgggcgggacgggaccaagctcgacccgtcctacgtcacgcccaaggcctcgcccccgtggtccactccgtcgttccccgcccttcctcgtagacgaccacgtctaggacggcgggctcggcgaaggccgcatgnnnnnnnnnnnnn

SEQ ID NO: 131241 - DNA, 482 bp, Homo sapiens
  misc_feature: GYAE6OF01C6LG0.7.27.C05.1.454.CMB.1.raw
  modified_base (396)..(396): a, c, t, g, unknown or other
  misc_feature (396)..(396): n is a, c, g, or t
  modified_base (433)..(433): a, c, t, g, unknown or other
  misc_feature (433)..(433): n is a, c, g, or t
  modified_base (456)..(457): a, c, t, g, unknown or other
  misc_feature (456)..(457): n is a, c, g, or t
  modified_base (459)..(482): a, c, t, g, unknown or other
  misc_feature (459)..(482): n is a, c, g, or t
tcagcgtgtctctacacgaccggtgctcgatttagacgcgatcgaagggtttggggccccagggcagagggtcaccatctcctgcactgggaacgcctccaacatcgggacttttttatgatgcacactggtaccagcgccttccaggaacacgcccccaccctcctcattcataataataacattcggccctcaggggtccctgaccgcttctctggctcaagtctggctcctcagcctcctggccatcactgggctcaggctgacgatggaggtgaatattactgccagtcatatgacagcagctgcgttcgttgggtgtttcgggcgggaggaccaagctcgaccgtctacgtcacgcccgaagcctcgccccgtgtccactctccgtccccncctcctactacgacgacgacgcgtggacggtccgggngtcgggacgaacggcgacatagnngnnnnnnnnnnnnnnnnnnnnnnnn

SEQ ID NO: 131242 - DNA, 457 bp, Homo sapiens
  misc_feature: GYAE6OF01D4GBA.7.27.C05.1.454.CMB.1.raw
  modified_base (443)..(457): a, c, t, g, unknown or other
  misc_feature (443)..(457): n is a, c, g, or t
tcagcgtgtctctacacgaccggtgctcgatttagacgcgatcgaagggtttggggccccagggcagagggtcaccatctcctgcactgggaacgcctccaacatcgggactttttatgatgcacactggtaccagcgccttccaggaacagcccccaccctcctcattcataataataacattcggccctcaggggtccctgaccgcttctctggctccaagtctggctcctcagcctccctggccatcactgggctccaggctgacgatgagggtgaatattactgccagtcatatgacagcagcctgcgtctttgggtgttcgggcggagggaccaagctcgaccgtcctacgtcacgcccaaggctcgccccctggtccactctcgttccccaccctcctctagacgacacgctgagcgggctggcaaggcgcagtagnnnnnnnnnnnnnnn

SEQ ID NO: 131243 - DNA, 720 bp, Homo sapiens
  misc_feature: GYAE6OF01B7DO1.7.27.C05.1.454.CMB.1.raw
  modified_base (245)..(245): a, c, t, g, unknown or other
  misc_feature (245)..(245): n is a, c, g, or t
  modified_base (693)..(720): a, c, t, g, unknown or other
  misc_feature (693)..(720): n is a, c, g, or t
tcagcgtgtctctacacgaccggtgctcgatttagacgcgatcgaagggtttggggccccagggcagagggtcaccatctcctgcactgggaacgcctccaacatcgggtactttttatgatgcacactggtaccagcgccttccaggaaccacgcccccaccctcctcattcaataaataaataacattccggccctcgacggggtccctgaccgcttctctcggctccaagtctcggctcctnacgccctcctggccatccacgtcgggcctccgaggctagaacgtagtggggtaagggtagtaaattacgttaacctcggacctaagttacaattaacgtacggaaacacggacctacggtccccttgggttccggttttcggtttttcggggggtaccgggtttaccggggaccgggggaaacggtaaacccgaaagggtcccggttaccggtaaaccccgttcccgttaacccgggtaaccgaaacccggttaccccgaaacgggtccccgttaccccggtcccccccggtttacggtacccctaccccgttttccgttcccccggtttaccccccctaacccctttcccggttaacccgtaacggtaaccgaacccgtacccggtcccggtaacgggaccggggtcccggggtaccggtacgggaaccgaacgggacgacaacggnnnnnnnnnnnnnnnnnnnnnnnnnnnn

SEQ ID NO: 131244 - DNA, 467 bp, Homo sapiens
  misc_feature: GYAE6OF01BJNFC.7.27.C05.1.454.CMB.1.raw
  modified_base (451)..(467): a, c, t, g, unknown or other
  misc_feature (451)..(467): n is a, c, g, or t
tcagcgtgtctctacacgaccggtgctcgatttagacgcgatcgaagggtttgggggccccagggcagagggtcaccatctcctgcactgggaacgcctccaacatcgggactttttatgatgcacactggtaccagcgccttccaggaacagcccccaccctcctcattcataataataacattcggccctcaggggtccctgaccgcttctctggctccaagtctggctcctcagcctccctggccatcactgggctccaggctgacgatgagggtgaatattactgccagtcatatgacagcagcctgcgtcgtttgggtgttcgggcggagggaccaagctgaccgtcctacgtcacgcccaaggctcgccccctcggtcacgtcctcgttccccaccctcctctacgagaccacgctgacggcgggctgggacacgggcacatagnnnnnnnnnnnnnnnnn

SEQ ID NO: 131245 - DNA, 583 bp, Homo sapiens
  misc_feature: GYAE6OF01D07E6.7.27.C05.1.454.CMB.1.raw
  modified_base (555)..(583): a, c, t, g, unknown or other
  misc_feature (555)..(583): n is a, c, g, or t
tcagcgtgtctctacacgaccggtgctcgatttagacgcgatcgaagggtttggggccccagggcagagggtcaccatctcctgcactgggaacgcctccaacatcgggacttttttatgatgcacactggtaccagcgccttccaggaacagcccccaccctcctcattcataataataacattcggccctgagggggtccctggaccgcttctctggctccaagtctggctcctcagccctccctggccatccactgggctccgaggctgacgatggagggtgaattattactgccctagtcattatgaacagcagcctggcgtttcgttttggggtgttcgggcgggacgggaaccaaggtcctaggtacccgtccgttaacggtccaacggccccgaaagggtccctcccggacccccccgttcgggtacctaaccgttcccgtttcccggttacccccctacccctttcccgttaccttaacggaccgtaaccgaccggtcgtacgggacgggcgggtccgtcgggacgaacgggccgacgtaataggcnnnnnnnnnnnnnnnnnnnnnnnnnnnnn

SEQ ID NO: 131246 - DNA, 512 bp, Homo sapiens
  misc_feature: GYAE6OF01CGHQ4.7.27.C05.1.454.CMB.1.raw
  modified_base (288)..(288): a, c, t, g, unknown or other
  misc_feature (288)..(288): n is a, c, g, or t
  modified_base (312)..(312): a, c, t, g, unknown or other
  misc_feature (312)..(312): n is a, c, g, or t
  modified_base (480)..(480): a, c, t, g, unknown or other
  misc_feature (480)..(480): n is a, c, g, or t
  modified_base (484)..(512): a, c, t, g, unknown or other
  misc_feature (484)..(512): n is a, c, g, or t
tcagcgtgtctctacacgaccggtgctcgatttagacgcgatcgaagggtttggggcccccagggcagagggtcaccatctcctgcactgggaacgcctccaacatcgggacttttttatgatgcacactggtaccagcgccttccaggaacacgcccccaccctcctcattcataaataataacattcggccctcgaggggtccctgaccgcttctctggctccaagtctggctcctcacgccctcccgtggccatcacgtgggcctccaggctgacgatgagggtnaatattactgccagtcatatgacngcagcctgcgttcgtttgggtgttcgggacgggagggaccaagctcgaccgttcacgtcacgccaaggcctcgccccctggtccacttctcgtccccacctcctactacgacgaccacggctaggacgggccgggtcgtacgggacgtaacgggccgacgaacgtagnacgnnnnnnnnnnnnnnnnnnnnnnnnnnnnn

SEQ ID NO: 131247 - DNA, 501 bp, Homo sapiens
  misc_feature: GYAE6OF01D0OB0.7.27.C05.1.454.CMB.1.raw
  modified_base (180)..(180): a, c, t, g, unknown or other
  misc_feature (180)..(180): n is a, c, g, or t
  modified_base (286)..(286): a, c, t, g, unknown or other
  misc_feature (286)..(286): n is a, c, g, or t
  modified_base (468)..(468): a, c, t, g, unknown or other
  misc_feature (468)..(468): n is a, c, g, or t
  modified_base (474)..(501): a, c, t, g, unknown or other
  misc_feature (474)..(501): n is a, c, g, or t
tcagcgtgtctctacacgaccggtgctcgatttagacgcgatcgaagggtttggggccccagggcagagggtcaccatctcctgcactgggaacgcctccaacatcgggactttttatgatgcacactggtaccagcgccttccaggacagcccccacctcctcattcataataataacnttcggccctcaggggtccctgaccgcttctctggctccaagtctggctcctcacgccctcctggccatcactgggctccagctgacgatggaggtgaattattacngcctagtcatatgacagcagcctgcgttcgtttgggtgttcggcggaggaaccagcgtacgaccgtcctacggtcacggcccgtaaggcctccggtcccccctagggtcccaaccgttccttccgttacccccacccttccgtactacgacgactacgcgtagcggcggctgggacaggccnatagcnnnnnnnnnnnnnnnnnnnnnnnnnnnn

SEQ ID NO: 131248 - DNA, 478 bp, Homo sapiens
  misc_feature: GYAE6OF01BC8AM.7.27.C05.1.454.CMB.1.raw
  modified_base (465)..(478): a, c, t, g, unknown or other
  misc_feature (465)..(478): n is a, c, g, or t
tcagcgtgtctctacacgaccggtgctcgatttagacgcgatcgaagggtttggggccccagggcagagggtcaccatctcctgcactgggaacgcctccaacatcgggactttttatgatgcacactggtaccagcgccttccaggaacagccccccaccctcctcattcataataataacattcggccctcaggggtccctgaccgcttctctggctccaagtctggctcctcagccctccctggccatcactgggctccaggctgacgatggagggtgaattattactgccagtcatatgacagcagccctgcgttcgtttgggtgtttcgggcgggaggaccaagctgacccgtcctacgtcacgcccaaggcctcgccccctcggtcactctcgttccccacccttcctctagacgaccacgtctggacggcggggcctgggacgaagggcgacagtagnnnnnnnnnnnnnn

SEQ ID NO: 131249 - DNA, 471 bp, Homo sapiens
  misc_feature: GYAE6OF01CCPMB.7.27.C05.1.454.CMB.1.raw
  modified_base (278)..(278): a, c, t, g, unknown or other
  misc_feature (278)..(278): n is a, c, g, or t
  modified_base (282)..(282): a, c, t, g, unknown or other
  misc_feature (282)..(282): n is a, c, g, or t
  modified_base (287)..(287): a, c, t, g, unknown or other
  misc_feature (287)..(287): n is a, c, g, or t
  modified_base (325)..(325): a, c, t, g, unknown or other
  misc_feature (325)..(325): n is a, c, g, or t
  modified_base (445)..(445): a, c, t, g, unknown or other
  misc_feature (445)..(445): n is a, c, g, or t
  modified_base (451)..(471): a, c, t, g, unknown or other
  misc_feature (451)..(471): n is a, c, g, or t
tcagcgtgtctctacacgaccggtgctcgatttagacgcgatcgaagggtttggggccccagggcagagggtcaccatctcctgcactgggaacgcctccaacatcgggactttttatgatgcacactggtaccagcgccttccaggaacagcccccacctcctcattcataataataacattcggccctcaggggtccctgaccgcttctctggctccaagtctggctcctcagcctccctggccatcactgggctccaggctgacgatggagggtnaatnttacngccagtcatatgacagcagccctgcgttctttggggtnttcgggcgggaggtaccaaggcttcgacccgtcctaacgtcagcccaagggctcgccccctggtccacttctcgttccccaccctcctctagcgacacgctgagcgggctggcaaggccncatcgnnnnnnnnnnnnnnnnnnnnn

SEQ ID NO: 131250 - DNA, 509 bp, Homo sapiens
  misc_feature: GYAE6OF01BOWSI.7.27.C05.1.454.CMB.1.raw
  modified_base (309)..(309): a, c, t, g, unknown or other
  misc_feature (309)..(309): n is a, c, g, or t
  modified_base (488)..(488): a, c, t, g, unknown or other
  misc_feature (488)..(488): n is a, c, g, or t
  modified_base (490)..(509): a, c, t, g, unknown or other
  misc_feature (490)..(509): n is a, c, g, or t
tcagcgtgtctctacacgaccggtgctcgatttagacgcgatcgaagggtttggggccccagggcagagggtcaccatctcctgcactgggaacgcctccaacatcgggactttttatgatgcacactggtaccagcgccttccaggaacacgcccccaccctcctcattcataataataacattcggccctcgaggggtccctgaccgtcttctctggctcagtctgctcctcacgccctccctgccatcacgtgggcctccgaggctgacgagtggagggtagaaattattacgcgcctagtcaatntagacagcacgctggtccgtttgtttgggtgttcgggcggacggacagtctacgaccgttcgacgtcacgcccgaagccctccgtcccccgtggtcctacctccttccgtcccctaccctcctacgtacgacgtaccacgtcgtacggacggcgggtcgcgggacgaacggcgacagtngnnnnnnnnnnnnnnnnnnnn

SEQ ID NO: 131251 - DNA, 721 bp, Homo sapiens
  misc_feature: GYAE6OF01C55WT.7.27.C05.1.454.CMB.1.raw
  modified_base (119)..(119): a, c, t, g, unknown or other
  misc_feature (119)..(119): n is a, c, g, or t
  modified_base (247)..(247): a, c, t, g, unknown or other
  misc_feature (247)..(247): n is a, c, g, or t
  modified_base (259)..(259): a, c, t, g, unknown or other
  misc_feature (259)..(259): n is a, c, g, or t
  modified_base (669)..(669): a, c, t, g, unknown or other
  misc_feature (669)..(669): n is a, c, g, or t
  modified_base (675)..(675): a, c, t, g, unknown or other
  misc_feature (675)..(675): n is a, c, g, or t
  modified_base (680)..(680): a, c, t, g, unknown or other
  misc_feature (680)..(680): n is a, c, g, or t
  modified_base (683)..(683): a, c, t, g, unknown or other
  misc_feature (683)..(683): n is a, c, g, or t
  modified_base (696)..(696): a, c, t, g, unknown or other
  misc_feature (696)..(696): n is a, c, g, or t
  modified_base (698)..(698): a, c, t, g, unknown or other
  misc_feature (698)..(698): n is a, c, g, or t
  modified_base (704)..(704): a, c, t, g, unknown or other
  misc_feature (704)..(704): n is a, c, g, or t
  modified_base (706)..(710): a, c, t, g, unknown or other
  misc_feature (706)..(710): n is a, c, g, or t
  modified_base (712)..(713): a, c, t, g, unknown or other
  misc_feature (712)..(713): n is a, c, g, or t
  modified_base (715)..(721): a, c, t, g, unknown or other
  misc_feature (715)..(721): n is a, c, g, or t
tcagcgtgtctctacacgaccggtgctcgatttagacgcgatcgaagggtttggggccccagggcagagggtcaccatctcctgcactgggaacgcctccaacatcgggacttttttangatgcacactggtaccagcgccttccaggaacacgcccccacctcctcattcaataataataacatttccggccctcgacggggtccctgacccgtcttctcgtggctaccagtctcggcctcctacncgtcccttccgnggaccatccgacgtcgggcctccgaggcctgacgtatggagggtataaattagttaaccgcggacctaggtactaaggttacacggaacacggtccaacgcccgttggtccggttttcggttttagggggttacggtttccggggacggggaaaccgggtaaccaaacggtcccgttacgggtaaacccccggtttccgttaaccgggtaacgaccggaccccggaaaggggtcccttacccggccccccggtttcgggtaccctaacccgttttcccgtacccggttttccccccgccctttacccgtacgttaaacgggaacccgtacccggttaaccggccgtaacggggtccgggggacccgggttacgaccgggaccggtaaacgggccgtaccgtaaaggcggngcgcgngacgngcncgacgcacgcgcncncgcgcncnnnnngnntnnnnnnn

SEQ ID NO: 131252 - DNA, 715 bp, Homo sapiens
  misc_feature: GYAE6OF01DNWU1.7.27.C05.1.454.CMB.1.raw
  modified_base (682)..(682): a, c, t, g, unknown or other
  misc_feature (682)..(682): n is a, c, g, or t
  modified_base (687)..(701): a, c, t, g, unknown or other
  misc_feature (687)..(701): n is a, c, g, or t
  modified_base (703)..(715): a, c, t, g, unknown or other
  misc_feature (703)..(715): n is a, c, g, or t
tcagcgtgtctctacacgaccggtgctcgatttagacgcgatcgaagggtttggggcccccagggcagagggtcaccatctcctgcactgggaacgcctccaacatcgggactttttatgatgcacactggtaccagcgccttccaggaacacgccccccaccctcctcattcaataaataataacattcggcccctcgacggggtcccctgacccgtcttctcgtggcctaccaagtctggcctcctcacgtccctccctggcccatccacgttcgggcctccgagggtctaggacgagtagggagggtataaattatttaccgtcggacctaaggttctaattagtagaaccgtacggcgacgtcccgtggttaccggttttcggtttttcgggggttcggtttccgggggaaccggggtaacggggaaacccgaaacggtccgttaccggtaaccccggttacccgttaaccggtacccgaaccggacccccgtaaacgggtcccctacccccggtccccccgttacgggtacccctaccgtttccccggtttccccggtttcccccccgtccccctttacccgttaccgtaacggaaccgacccgtacccgggtacgtacggggaccgggtccgggtaccggtaccgggaccggaacgggtaccgacgtaagtacggnagcgnnnnnnnnnnnnnnngnnnnnnnnnnnnn

SEQ ID NO: 131253 - DNA, 875 bp, Homo sapiens
  misc_feature: GYAE6OF01C5VI4.7.27.C05.1.454.CMB.1.raw
tcagcgtgtctctacacgaccggtgctcgatttagacgcgatcgaagggtttggggcccagggcagagggtcaccatctcctgcacgtgggaacgcctccaacatcgggacttttatgatgcacactggtaccagcgccttccaggaacacgccccacctcctcattcataataataacattccggccctcgacgggggttccctcggaccgtcttctcgtggcctccgaagtcctggtcctcctcgacgtccctcccgtcggacctacgtccgtaccgttcggggaccttaccggagggccgtttacggaaccgtagtgggtaagggggttacgtaaaactttaacggtttaccgtacggtacccctaaggttaccaagtttaacttacgggaaccaagggacccgtaacggccccggtttaggtccggttttcgggtttttacgggggttacgggtttccggggacggggtaaccgggtaacccgaaaggtccgttaccggtaccccgttaccggtaaccggttaccgaacccgggtaccccgtaaacgggtcccgttcccgggtccccccccggttacgggggtttaccctaaccccggttttcccgttacccccggttttacccccccgtacccccgttccccggtttaaccggttaaccgggtaaccgtaacccggtaaccccggggtcgtttaaccggggaacggggtcccggggtaccggtacggggtaacggaacccggggtaccgaccgttaagggttaacgcgtacgcgtaacgtccgaaggtcctacacgtcgtacgccgcgacgtacgtacgtcgcgtcgtcgcgtcgtacgtacgcgtactacgtacgtcgtcgtacgtacg

SEQ ID NO: 131254 - DNA, 571 bp, Homo sapiens
  misc_feature: GYAE6OF01BKXYR.7.27.C05.1.454.CMB.1.raw
  modified_base (310)..(310): a, c, t, g, unknown or other
  misc_feature (310)..(310): n is a, c, g, or t
  modified_base (548)..(571): a, c, t, g, unknown or other
  misc_feature (548)..(571): n is a, c, g, or t
tcagcgtgtctctacacgaccggtgctcgatttagacgcgatcgaagggtttggggcccccagggcagagggtcaccatctcctgcactgggaacgcctccaacatcgggactttttatgatgcacactggtaccagcgcccttccaggaacacgccccccaccctcctcattcataataaataacatttccggccctcgacggggtcccctgaccgcttctctggcctaccaagtctggctcctcacgccctcccgtggccatccacgtcgggcctcaggctgacgagtggagggtagtaattattacngcctagtcatactgaccagcagtccgtgtccggttgtttgggtcggttcgggcgggaacggtaccaagtccgtacgacccgtccgtacgtcgaccgacccgaacggtccctccggccccccgtcggtacctaccgttcccgttcccgttccccccgtcccttccgtaccgtacgaccgaccgaccggtaccgcgggcggaccgggtccgacgggtaccggaacgggcacgaacgtagnnnnnnnnnnnnnnnnnnnnnnnn

SEQ ID NO: 131255 - DNA, 513 bp, Homo sapiens
  misc_feature: GYAE6OF01D1F0F.7.27.C05.1.454.CMB.1.raw
  modified_base (449)..(449): a, c, t, g, unknown or other
  misc_feature (449)..(449): n is a, c, g, or t
  modified_base (484)..(484): a, c, t, g, unknown or other
  misc_feature (484)..(484): n is a, c, g, or t
  modified_base (486)..(513): a, c, t, g, unknown or other
  misc_feature (486)..(513): n is a, c, g, or t
tcagcgtgtctctacacgaccggtgctcgatttagacgcgatcgaagggtttggggccccagggcagagggtcaccatctcctgcactgggaacgcctccaaacatcgggactttttatgatgcacactggtaccagcgccttccaggaacagcccccaccctcctcattcaataaataataacatttcggccctcttgggggtcccctggaccgcttctctggctaccaagtctggctcctcacgcctcctggccatcactggactccaggctgacgagtgagggtagaattagttactgccagtcatatgacagcagtcctgacgtcgtttgggtcgttcgggcgggtaaggaccgaagtctcggaacccggttcctaacgtcacgcccgaaaggcctcgcccccctaggcctaccgtctccgttaccccaccctcctctagacacncgctgacgcgggcgtggacgaagggcactatacgnannnnnnnnnnnnnnnnnnnnnnnnnnnn

SEQ ID NO: 131256 - DNA, 473 bp, Homo sapiens
  misc_feature: GYAE6OF01EHO0Z.7.27.C05.1.454.CMB.1.raw
  modified_base (280)..(280): a, c, t, g, unknown or other
  misc_feature (280)..(280): n is a, c, g, or t
  modified_base (402)..(402): a, c, t, g, unknown or other
  misc_feature (402)..(402): n is a, c, g, or t
  modified_base (413)..(413): a, c, t, g, unknown or other
  misc_feature (413)..(413): n is a, c, g, or t
  modified_base (418)..(418): a, c, t, g, unknown or other
  misc_feature (418)..(418): n is a, c, g, or t
  modified_base (432)..(432): a, c, t, g, unknown or other
  misc_feature (432)..(432): n is a, c, g, or t
  modified_base (448)..(450): a, c, t, g, unknown or other
  misc_feature (448)..(450): n is a, c, g, or t
  modified_base (452)..(473): a, c, t, g, unknown or other
  misc_feature (452)..(473): n is a, c, g, or t
tcagcgtgtctctacacgaccggtgctcgatttagacgcgatcgaagggtttggggccccagggcagagggtcaccatctcctgcactgggaacgcctccaacatcgggactttttatgatgcacactggtaccagcgccttccaggaacacgcccccacctcctcattcataataataacattcgccctcaggggtccctgaccgcttctctggctcaagtctggctcctcacgcctccctggccatcactggctccaggctgacgatggaggtgaatnttactgccagtcatatgacagcagcctagcgttcgtttgggtgttcgggcggaggaccaagcctaggacccgtctacgtcacgcccgaaggcctcgcccccgtggtccactctcgttccccnccctcctctancgacncgctgagacggcgnggcgacgcgacagacnnncnnnnnnnnnnnnnnnnnnnnnn

SEQ ID NO: 131257 - DNA, 453 bp, Homo sapiens
  misc_feature: GYAE6OF01D1GMH.7.27.C05.1.454.CMB.1.raw
  modified_base (276)..(276): a, c, t, g, unknown or other
  misc_feature (276)..(276): n is a, c, g, or t
  modified_base (442)..(453): a, c, t, g, unknown or other
  misc_feature (442)..(453): n is a, c, g, or t
tcagcgtgtctctacacgaccggtgctcgatttagacgcgatcgaagggtttggggccccagggcagagggtcaccatctcctgcactgggaacgcctccaacatcgggactttttatgatgcacactggtaccagcgccttccaggacagcccccacctcctcattcataataataacattcggccctcaggggtccctgaccgcttctctggctccaagtctggctcctcagcctccctggccatccactgggctcaggctgacgatgagggtnaattatactgccagtcatatgacagcagcctgcgttctttgggtgttcgggcggagggaccaaggctcgaccgtcgtaacgtcacgccaaggcctcgcccctggtcactctcgttcccacctctctagacacgacgtctgacgcgggctgggacaggcacgatcgnnnnnnnnnnnn

SEQ ID NO: 131258 - DNA, 505 bp, Homo sapiens
  misc_feature: GYAE6OF01AOHU5.7.27.C05.1.454.CMB.1.raw
  modified_base (244)..(244): a, c, t, g, unknown or other
  misc_feature (244)..(244): n is a, c, g, or t
  modified_base (298)..(298): a, c, t, g, unknown or other
  misc_feature (298)..(298): n is a, c, g, or t
  modified_base (448)..(448): a, c, t, g, unknown or other
  misc_feature (448)..(448): n is a, c, g, or t
  modified_base (478)..(478): a, c, t, g, unknown or other
  misc_feature (478)..(478): n is a, c, g, or t
  modified_base (485)..(505): a, c, t, g, unknown or other
  misc_feature (485)..(505): n is a, c, g, or t
tcagcgtgtctctacacgaccggtgctcgatttagacgcgatcgaagggtttggggcccccagggcagagggtcaccatctcctgcactgggaacgccctccaacatcgggacttttttatgatgcacactggtaccagcgccttccaggaacacgccccccaccctcctcattcataaataataacattcggcccctcaggggtccctgaccgcttctctggctccaagtctggctcctcacncctccctggccatcacgtgggctccaggctgacgatggagggtgaattattacngccagtccaatatgacagtcacgcctgcgttcgttttggggtcgtttcggcgggaaggaccaaggctacggaccgtcctacgtcgacgcccaaggcctccggccccctggtccaccttctccgttaccccaccctcctactacgacgacnccgtctggacgcggtctggacgtaacgcgnagtagcnnnnnnnnnnnnnnnnnnnnn

SEQ ID NO: 131259 - DNA, 734 bp, Homo sapiens
  misc_feature: GYAE6OF01CYN90.7.27.C05.1.454.CMB.1.raw
  modified_base (661)..(661): a, c, t, g, unknown or other
  misc_feature (661)..(661): n is a, c, g, or t
  modified_base (691)..(691): a, c, t, g, unknown or other
  misc_feature (691)..(691): n is a, c, g, or t
  modified_base (694)..(694): a, c, t, g, unknown or other
  misc_feature (694)..(694): n is a, c, g, or t
  modified_base (706)..(706): a, c, t, g, unknown or other
  misc_feature (706)..(706): n is a, c, g, or t
  modified_base (714)..(714): a, c, t, g, unknown or other
  misc_feature (714)..(714): n is a, c, g, or t
  modified_base (723)..(723): a, c, t, g, unknown or other
  misc_feature (723)..(723): n is a, c, g, or t
  modified_base (728)..(728): a, c, t, g, unknown or other
  misc_feature (728)..(728): n is a, c, g, or t
  modified_base (730)..(730): a, c, t, g, unknown or other
  misc_feature (730)..(730): n is a, c, g, or t
tcagcgtgtctctacacgaccggtgctcgatttagacgcgatcgaagggtttgggccccagggcagagggtcaccatctcctgcactgggaacgcctccaacatcgggtactttttatgatgcacactggtaccagcgtccttccgaaggaaccaccgccccccaccctcctctattcaattaaataaataactacgtttccggccctcgacggggtccctggacccgtcttctcgtcggcctaccaagtcctgcctcctctacgccctccgtcgaccatccgacgtcggcctccgacggtctagacgtagtgggtaaggttagtaaacttagttacctcgaccctagtacctaagttaacgtacggaacacgtaccgacgtcccgttcgggtccggtttttcgggttttcggggttaccgggttccggggaacggggaaccggtaaccgtacggtcgttaccggtacccgttaccgtaccggtacacccggtacccgacggtccctcccggtacccccgtcgtccctcgttcccgttccccgtaccccctccgttcccgtaacgtacggaaccgtaccgtccggtaacggtcgggaaccggggtccgggtaccgttaccggggaacggtaacccgggtccgtaaacgttaacgtcggtcngacgtcgacgtgcgtgacgcgacgcgcgcncgngcgtcgtcgtanactcgcgncgtacgtanagacngngtcg

SEQ ID NO: 131260 - DNA, 655 bp, Homo sapiens
  misc_feature: GYAE6OF01ETLCU.7.27.C05.1.454.CMB.1.raw
  modified_base (314)..(314): a, c, t, g, unknown or other
  misc_feature (314)..(314): n is a, c, g, or t
  modified_base (622)..(622): a, c, t, g, unknown or other
  misc_feature (622)..(622): n is a, c, g, or t
  modified_base (625)..(625): a, c, t, g, unknown or other
  misc_feature (625)..(625): n is a, c, g, or t
  modified_base (628)..(655): a, c, t, g, unknown or other
  misc_feature (628)..(655): n is a, c, g, or t
tcagcgtgtctctacacgaccggtgctcgatttagacgcgatcgaagggtttggggccccagggcagagggtcaccatctcctgcactgggaacgcctccaacattcgggacttttttatgatgcacactggtaccagccgccttccaggaaccacgcccccacctcctcattcaataataatacattcgccctgacggggtccctgaccgtcttctcgtcggcctcgaagtcgtcggccttccgtacacgtccctccctcggcctaatccgacgtcgggctccgaggtcctaggacgtagtggaacgggttanaaagttcgtactcgaccctaagtctaattagacgtacacgtacacgtcccgtggtcgtttcggttttagggtcggttaccggggacgggtaaccggaacctaaggtcccgtacggtaaccccgtttaccgtaacggacccgaaccggacccgtaacggtcccttcccggacccccgtttccgtactaccccgttcccgttccccggttacccccgccccttttaggacccttaaacgggaccgtccccgtaagtccggttaacggcggggtacgggccgtaacggggacccggaagccgtactaaggngcngcnnnnnnnnnnnnnnnnnnnnnnnnnnnn

SEQ ID NO: 131261 - DNA, 753 bp, Homo sapiens
  misc_feature: GYAE6OF01CNQ5U.7.27.C05.1.454.CMB.1.raw
  modified_base (119)..(119): a, c, t, g, unknown or other
  misc_feature (119)..(119): n is a, c, g, or t
  modified_base (247)..(247): a, c, t, g, unknown or other
  misc_feature (247)..(247): n is a, c, g, or t
  modified_base (312)..(312): a, c, t, g, unknown or other
  misc_feature (312)..(312): n is a, c, g, or t
  modified_base (686)..(686): a, c, t, g, unknown or other
  misc_feature (686)..(686): n is a, c, g, or t
  modified_base (698)..(698): a, c, t, g, unknown or other
  misc_feature (698)..(698): n is a, c, g, or t
  modified_base (707)..(707): a, c, t, g, unknown or other
  misc_feature (707)..(707): n is a, c, g, or t
  modified_base (712)..(712): a, c, t, g, unknown or other
  misc_feature (712)..(712): n is a, c, g, or t
  modified_base (719)..(719): a, c, t, g, unknown or other
  misc_feature (719)..(719): n is a, c, g, or t
  modified_base (731)..(731): a, c, t, g, unknown or other
  misc_feature (731)..(731): n is a, c, g, or t
  modified_base (743)..(743): a, c, t, g, unknown or other
  misc_feature (743)..(743): n is a, c, g, or t
  modified_base (745)..(746): a, c, t, g, unknown or other
  misc_feature (745)..(746): n is a, c, g, or t
  modified_base (749)..(749): a, c, t, g, unknown or other
  misc_feature (749)..(749): n is a, c, g, or t
tcagcgtgtctctacacgaccggtgctcgatttagacgcgatcgaagggtttggggccccagggcagagggtcaccatctcctgcactgggaacgcctccaacatcgggacttttttangatgcacactggtaccagcgccttccaaggaacacgcccccacctcctcattcaataataaataacattccggccctcgacggggtccctgaccgtcttctcgtgctaccaagtctcggcctcctacncgtcctcccgtcggacctacgtaccgtacgtcgggcctccgacggctagacgatgggaaggttanaaacttacttacgtcgacctagttacaagttagtcgaactacgcctaaggtccctggtccggtttttccggtttttgggggttaccggttacggggaccggggtaaacgggaacccctaaagggtcccgttaaccgggtaaccccgtttacccggtaaacgttcccggaaacccgtaccccggtaacggtcccgttccccggtccccccgttacggtttccttaacccgttttccccggttttaacccctaacccccccttacccgttcccgttaacggttaacggaacccgaaccgtacccggacgttacgggaaccggggtaccgggcgttaccggggaaaccggtcgggaacccgtaacggtagttaacgngacgacgcgcgngcgtcgcgngacgngacgtangcgagagtagancgcgcgacgcgnanncgncgag

SEQ ID NO: 131262 - DNA, 572 bp, Homo sapiens
  misc_feature: GYAE6OF01DGJ0V.7.27.C05.1.454.CMB.1.raw
  modified_base (453)..(453): a, c, t, g, unknown or other
  misc_feature (453)..(453): n is a, c, g, or t
  modified_base (539)..(539): a, c, t, g, unknown or other
  misc_feature (539)..(539): n is a, c, g, or t
  modified_base (544)..(544): a, c, t, g, unknown or other
  misc_feature (544)..(544): n is a, c, g, or t
  modified_base (547)..(547): a, c, t, g, unknown or other
  misc_feature (547)..(547): n is a, c, g, or t
  modified_base (549)..(572): a, c, t, g, unknown or other
  misc_feature (549)..(572): n is a, c, g, or t
tcagcgtgtctctacacgaccggtgctcgatttagacgcgatcgaagggtttggggccccagggcagagggtcaccatctcctgcactgggaaccgcctccaacatcgggactttttatgatgcacactggtaccagcgccttcaggacacgcccccaccctcctcattcaataataataacattccggccctgaggggtccctgacccgtcttctctggcctccgaagtctggcctcctcacgccctcccgtgccatcacgtggctccgaggctgacgagtggaagggttgtaaattatttaccgcgacctagtcattagcgaacagcacgtccgttggtcgtttggttttggggtcggttacggggacgggtacggtaccaacggtctaccgtacccgtacgtacgtccgaccgacccggtagcccgtcccggtcccccgtacggtacccnccgtttccgtccccgtttacccccgtcccttcgttaccgacgaccgacaccgtgtcggaacggtccgggctacgggacgtacggcncgtancgncnnnnnnnnnnnnnnnnnnnnnnnn

SEQ ID NO: 131263 - DNA, 841 bp, Homo sapiens
  misc_feature: GYAE6OF01AKB9Q.7.27.C05.1.454.CMB.1.raw
  modified_base (117)..(117): a, c, t, g, unknown or other
  misc_feature (117)..(117): n is a, c, g, or t
  modified_base (154)..(154): a, c, t, g, unknown or other
  misc_feature (154)..(154): n is a, c, g, or t
  modified_base (221)..(221): a, c, t, g, unknown or other
  misc_feature (221)..(221): n is a, c, g, or t
  modified_base (401)..(401): a, c, t, g, unknown or other
  misc_feature (401)..(401): n is a, c, g, or t
  modified_base (814)..(814): a, c, t, g, unknown or other
  misc_feature (814)..(814): n is a, c, g, or t
tcagcgtgtctctacacgaccggtgctcgatttagacgcgatcgaagggtttgggccccagggcagagggtcaccatctcctgcactgggaacgcctccaacatcgggactttttangatgcactactggtaccagcgtccttccgaggaaccncgcccccacctacctcattcaataataataacacttccgccctagacggggtccctgaccgtcttcnctcggcctaccaagttcctggtcctcctacgcgtcccttacccgtcgcctactccgtaaccgttcgggtaccctacgacggttcgacggtaaccgtaggttcggaacgggtttaactaaacgttacgtttaccgtccgtaccgttaggtactaacgttaactcgggaaactaccggtacnccggttacccctgggttcccgtttaacggtttttggggtcgtttaccggggaacgggttaaccgggtaaccccgaaggtcccggttaacgtaccccgggtttaacctaacgggttccgaaccgtccccggtaaacgggtccgttccccggtacccccgtttaccgggacccttacggttcccttacccgggtttacccccaacctttccggtaccgttaacggaacccggtaaccgtacggttacccggtaagggtaccgggttacccggggttaccgacgggtaccgtaaacgggtccggtaccgtaacggtttaacgctacggtactcgaagtccgtagtaaccgattccggagttacctggaaaccgttgactcgttacgacgtggaacccgttgggctttaaacccggngtttaccgagtcaacgggtctcgtacg

SEQ ID NO: 131264 - DNA, 707 bp, Homo sapiens
  misc_feature: GYAE6OF01B1TQH.7.27.C05.1.454.CMB.1.raw
  modified_base (683)..(707): a, c, t, g, unknown or other
  misc_feature (683)..(707): n is a, c, g, or t
tcagcgtgtctctacacgaccggtgctcgatttagacgcgatcgaagggtttggggccccagggcagagggtcaccatctcctgcactgggaacgcctccaacatcgggactttttatgatgcacactcggtaccagcgccttccaggaacacgccccccaccctcctcattcaataaataataacattccggcccctcgacgggggtcccctgacccgtcttctctcggcctccaacgttctggccttccctcacgcccctcccgtcggcccactccgacgttcggggcctccgacggtcctggacggtagtgggtaaggggttagaaatttacttacgtcggaccctaaggttcctaagttaactcggaaccgaaggcccgaacggtcccgttggtccggttttccggtttttgggggttccgggtttcggggccggggtaaacggggacccgtaaaggtcccgttaccggggaccccgtttacccgtacccggtaccgaacccggtaccccgaacgggtcccctccccggtccccccgttaccgggtcccttacccgtccctttccccgggtttccccctcccccgttcccttacggtaccgtaccgaccgtccggtaccgtgggaaccgggtccgggtacggtacgggaacccggtaacgggcccgtactacggtagcnnnnnnnnnnnnnnnnnnnnnnnnn

SEQ ID NO: 131265 - DNA, 779 bp, Homo sapiens
  misc_feature: GYAE6OF01BB0UX.7.27.C05.1.454.CMB.1.raw
  modified_base (720)..(720): a, c, t, g, unknown or other
  misc_feature (720)..(720): n is a, c, g, or t
  modified_base (725)..(725): a, c, t, g, unknown or other
  misc_feature (725)..(725): n is a, c, g, or t
  modified_base (728)..(728): a, c, t, g, unknown or other
  misc_feature (728)..(728): n is a, c, g, or t
  modified_base (732)..(732): a, c, t, g, unknown or other
  misc_feature (732)..(732): n is a, c, g, or t
  modified_base (734)..(734): a, c, t, g, unknown or other
  misc_feature (734)..(734): n is a, c, g, or t
  modified_base (738)..(738): a, c, t, g, unknown or other
  misc_feature (738)..(738): n is a, c, g, or t
  modified_base (744)..(744): a, c, t, g, unknown or other
  misc_feature (744)..(744): n is a, c, g, or t
  modified_base (746)..(746): a, c, t, g, unknown or other
  misc_feature (746)..(746): n is a, c, g, or t
  modified_base (752)..(752): a, c, t, g, unknown or other
  misc_feature (752)..(752): n is a, c, g, or t
  modified_base (754)..(754): a, c, t, g, unknown or other
  misc_feature (754)..(754): n is a, c, g, or t
  modified_base (756)..(756): a, c, t, g, unknown or other
  misc_feature (756)..(756): n is a, c, g, or t
  modified_base (759)..(759): a, c, t, g, unknown or other
  misc_feature (759)..(759): n is a, c, g, or t
  modified_base (761)..(761): a, c, t, g, unknown or other
  misc_feature (761)..(761): n is a, c, g, or t
  modified_base (767)..(767): a, c, t, g, unknown or other
  misc_feature (767)..(767): n is a, c, g, or t
  modified_base (773)..(773): a, c, t, g, unknown or other
  misc_feature (773)..(773): n is a, c, g, or t
  modified_base (776)..(777): a, c, t, g, unknown or other
  misc_feature (776)..(777): n is a, c, g, or t
tcagcgtgtctctacacgaccggtgctcgatttagacgcgatcgaagggtttggggccccagggcagagggtcaccatctcctgcactgggaacgcctccaacatcgggactttttatgatgcacactggtaccagcgccctttccaggaacacgccccccaccctcctcattcaataataataacattcggccctcacggggtccctgacccgtcttctactggccttaccaagttcctggcctacctcacgccctccctggccatccacgtcgggcctccgacggtctagaccgaattggacgggtagaaattatttaacgtcggaccctaggtaccattaactggaaccacggaacctaccggtccgtcggtccgttttcgggtttttacggggttcggttaccgggggtaccgggtaacggggtaaaccctaaacgggtccttaccggggtaaccccgttcccttaaccggtacccgaccggaacccccgtaaaggtccccgtcccggtcccccccccggttaccgggttacccgtaacccgtttcccgttttacccgggtttccccccccgttaccccctttcccccggttaagttaaccgggaacccgtaacccccgtacccggttcccggttaacggggaccggggtacccgggggtacgtttaccgggggaacccggaaaccggggttcccgacgttaaaacgggttaccgngacgncanacgngntacncgtacnanctacancncnganancacacngatacnacnngc

SEQ ID NO: 131266 - DNA, 621 bp, Homo sapiens
  misc_feature: GYAE6OF01BE1LO.7.27.C05.1.454.CMB.1.raw
  modified_base (165)..(165): a, c, t, g, unknown or other
  misc_feature (165)..(165): n is a, c, g, or t
  modified_base (300)..(300): a, c, t, g, unknown or other
  misc_feature (300)..(300): n is a, c, g, or t
  modified_base (510)..(510): a, c, t, g, unknown or other
  misc_feature (510)..(510): n is a, c, g, or t
  modified_base (581)..(581): a, c, t, g, unknown or other
  misc_feature (581)..(581): n is a, c, g, or t
  modified_base (588)..(588): a, c, t, g, unknown or other
  misc_feature (588)..(588): n is a, c, g, or t
  modified_base (590)..(591): a, c, t, g, unknown or other
  misc_feature (590)..(591): n is a, c, g, or t
  modified_base (595)..(621): a, c, t, g, unknown or other
  misc_feature (595)..(621): n is a, c, g, or t
tcagcgtgtctctacacgaccggtgctcgatttagacgcgatcgaagggtttggggccccagggcagagggtcaccatctcctgcactgggaacgcctccaacatcgggacttttttatgatgcacactggtaccagcgccttcaggacacgcccccacctcctnattcaataataataacattccggccctgacggggtccctgaccgtcttctctggactccaagtctgcctcctcacgcccttccgtggcctactcacgtcgggcctaccgaggctagacgtagtagggtagggtanaaagtttacgttactcggaaccctagtacctaattacgtacggaactacggccgtaccgtccgttggttccggttttcggtttgggggtcggttaccgggacggggaacggaaccaaggtccgtaccggtacccgtccgtaacgccgaccgacccgtaggtccctccggtcccccgtaggtccctacggttcccgttccccggttccccncccttaccgtcgtacggaccgtaaccggaccgtcgacggacgggtccggacggtaccggaacgacgggacngacgtancnnacgnnnnnnnnnnnnnnnnnnnnnnnnnnn

SEQ ID NO: 131267 - DNA, 831 bp, Homo sapiens
  misc_feature: GYAE6OF02HX6IU.7.27.C05.1.454.CMB.1.raw
tcagcgtgtctctacacgaccggtgctcgatttagacgcgatcgaaagggttaggggcccgaggcagagggtcaccatctcctggacactacgggaacgccgtccaacgacctcgggacctttttatgacctcgcactactggtaccagcgccttccaggaacgacgcccccacctcctcattcataataataacacttcggccctcagggtcctcggaccgacgtctcgtgctccaagtctggcgtcctcagcctcctggcccaaattcactttgggcctccaggctagaccgaagtcgaaggggtccgtaaagttagtttaaccgttggaccctaacggttccaagttaagttacggaacgaagggacccgaaccggtccccggttggtccccgttcgtttttagggggtcgttttaccgggtccgggtaacgggggtacccgaaaggtcccttaggtaaccccggttacccggttaaccgggtttccgaacggtacccccgtaaaaggggccctttaccggcccccccgttacggggttccggaaccccgttcccggttacgggttttaccccccgaaacccccgtttcccggttacccgtttaacgggaaccgggtaacccctaacccgggtacccgtttagggttaaccgggcccgggggtaccttaccgggggaaccgtaaaacggggcccggaccgtaaagttttaacggggctaacgcgaggggtacacgttcggaggacggacgtacggtcgacgtcgtacgtcgacgaccgaacgcgcgtccgtccggtccgtcgtccgtccgtccgtcccgtcctcctcg

SEQ ID NO: 131268 - DNA, 446 bp, Homo sapiens
  misc_feature: GYAE6OF02HFN9C.7.27.C05.1.454.CMB.1.raw
  modified_base (438)..(446): a, c, t, g, unknown or other
  misc_feature (438)..(446): n is a, c, g, or t
tcagcgtgtctctacacgaccggtgctcgatttagacgcgatcgaagggtttggggccccagggcagagggtcaccatctcctgcactgggaacgcctccaacatcgggactttttatgatgcacactggtaccagcgccttccaggaacagcccccaccctcctcattcataataataacattcggccctcaggggtccctgaccgcttctctggctccaagtctggctcctcagcctccctggccatcactgggctccaggctgacgatgagggtgaatattactgccagtcatatgacagcagcctgcgtctttgggtgttcggcggagggaccaagctgaccgtcctacgtcagcccaaggctcgccccctcggtcactctcgtttcccgccctcctctagagacacgctgagcgggctggcaaggcgcatagnnnnnnnnn

SEQ ID NO: 131269 - DNA, 461 bp, Homo sapiens
  misc_feature: GYAE6OF02JD65M.7.27.C05.1.454.CMB.1.raw
  modified_base (301)..(301): a, c, t, g, unknown or other
  misc_feature (301)..(301): n is a, c, g, or t
  modified_base (312)..(312): a, c, t, g, unknown or other
  misc_feature (312)..(312): n is a, c, g, or t
  modified_base (319)..(319): a, c, t, g, unknown or other
  misc_feature (319)..(319): n is a, c, g, or t
  modified_base (326)..(326): a, c, t, g, unknown or other
  misc_feature (326)..(326): n is a, c, g, or t
  modified_base (439)..(461): a, c, t, g, unknown or other
  misc_feature (439)..(461): n is a, c, g, or t
tcagcgtgtctctacacgaccggtgctcgatttagacgcgatcgaagggtttggggccccgagggcagagggtcaccatctcctgcactgggaacgcctccaacatcgggactttttatgtatgcacactggtaccagcgccttccaggaacagcccccacctcctcattcataataataacattcggccctcacgggtccctgaccgcttctctggctcaagtctggctctcagcctcctggccatcactggctccgaggctgacgatggagggtgaatattactgccagtcatatgacngcagcctgctntttgggngttcggnggagggaccaaggctgaccgtcacgtcagcccaggcctgccccctggtcactctcgtcccacctctctagacgacacgctgacggccgggctggacaagggtccgacagtgannnnnnnnnnnnnnnnnnnnnnn

SEQ ID NO: 131270 - DNA, 449 bp, Homo sapiens
  misc_feature: GYAE6OF02HWBBF.7.27.C05.1.454.CMB.1.raw
  modified_base (192)..(192): a, c, t, g, unknown or other
  misc_feature (192)..(192): n is a, c, g, or t
  modified_base (440)..(449): a, c, t, g, unknown or other
  misc_feature (440)..(449): n is a, c, g, or t
tcagcgtgtctctacacgaccggtgctcgatttagacgcgatcgaagggtttggggccccagggcagagggtcaccatctcctgcactgggaacgcctccaacatcgggactttttatgatgcacactggtaccagcgccttccaggaacagcccccaccctcctcattcataataataacattcggccctnaggggtccctgaccgcttctctggctccaagtctggctcctcagcctcctggccatcactgggctccaggctgacgatgagggtgaatattactgccagtcatatgacagcagcctgcgtcttttgggtgttcggcggagggaccaagctgacccgtcctacgtcagcccaaggctcgccccctcggtccactctcgttccccaccctcctctagagacacgctgagcgggctggcaaggcgcatagnnnnnnnnnn

SEQ ID NO: 131271 - DNA, 444 bp, Homo sapiens
  misc_feature: GYAE6OF02HLBIW.7.27.C05.1.454.CMB.1.raw
  modified_base (321)..(321): a, c, t, g, unknown or other
  misc_feature (321)..(321): n is a, c, g, or t
  modified_base (430)..(430): a, c, t, g, unknown or other
  misc_feature (430)..(430): n is a, c, g, or t
  modified_base (436)..(444): a, c, t, g, unknown or other
  misc_feature (436)..(444): n is a, c, g, or t
tcagcgtgtctctacacgaccggtgctcgatttagacgcgatcgaagggtttggggccccagggcagagggtcaccatctcctgcactgggaacgcctccaacatcgggactttttatgatgcacactggtaccagcgccttccaggaacagcccccacctcctcattcataataataacattcggccctcaggggtccctgaccgcttctctggctccaagtctggctcctcagcctccctggccatcactgggctccaggctgacgatgagggtgaatattactgccagtcatatgacagcagcctgcgtctttgggtnttcggcggagggaccaagctgaccgtcctacgtcagcccaaggctcgcccctggtcactctgttccccaccctctctagacgaccacgctgacgcgggctggcaaggcncatagnnnnnnnnn

SEQ ID NO: 131272 - DNA, 445 bp, Homo sapiens
  misc_feature: GYAE6OF02JG8A8.7.27.C05.1.454.CMB.1.raw
  modified_base (318)..(318): a, c, t, g, unknown or other
  misc_feature (318)..(318): n is a, c, g, or t
  modified_base (396)..(396): a, c, t, g, unknown or other
  misc_feature (396)..(396): n is a, c, g, or t
  modified_base (424)..(424): a, c, t, g, unknown or other
  misc_feature (424)..(424): n is a, c, g, or t
  modified_base (430)..(445): a, c, t, g, unknown or other
  misc_feature (430)..(445): n is a, c, g, or t
tcagcgtgtctctacacgaccggtgctcgatttagacgcgatcgaagggtttggggccccagggcagagggtcaccatctcctgcactgggaacgcctccaacatcgggactttttatgatgcacactggtaccagcgccttccaggaacagccccaccctctcattcataataataacattcggccctcaggggtccctgaccgcttctctggctccaagtctggctctcagcctccctggccatcactgggctccaggctgacgatgagggtgaatattactgccagtcatatgacagcagcctgcgtctttgggngttcggcggagggaccaagctgaccgtctacgtcagcccaaggctgccccctggtcactctcgtcccacctctctagngacacggctgagcgggctgggcaaggcncatagnnnnnnnnnnnnnnnn

SEQ ID NO: 131273 - DNA, 441 bp, Homo sapiens
  misc_feature: GYAE6OF02HI6DJ.7.27.C05.1.454.CMB.1.raw
  modified_base (435)..(441): a, c, t, g, unknown or other
  misc_feature (435)..(441): n is a, c, g, or t
tcagcgtgtctctacacgaccggtgctcgatttagacgcgatcgaagggtttggggccccagggcagagggtcaccatctcctgcactgggaacgcctccaacatcgggactttttatgatgcacactggtaccagcgccttccaggaacagcccccaccctcctcattcataataataacattcggccctcaggggtccctgaccgcttctctggctccaagtctggctcctcagcctccctggccatcactgggctccaggctgacgatgagggtgaatattactgccagtcatatgacagcagcctgcgtctttgggtgttcggcggagggaccaagctgaccgtcctacgtcagcccaaggctgcccctcggtcactctcgttcccaccctcctctagacgacacgctgagcgggctggcaggcgcatagnnnnnnn

SEQ ID NO: 131274 - DNA, 445 bp, Homo sapiens
  misc_feature: GYAE6OF02F3VLE.7.27.C05.1.454.CMB.1.raw
  modified_base (436)..(445): a, c, t, g, unknown or other
  misc_feature (436)..(445): n is a, c, g, or t
tcagcgtgtctctacacgaccggtgctcgatttagacgcgatcgaagggtttggggccccagggcagagggtcaccatctcctgcactgggaacgcctccaacatcgggactttttatgatgcacactggtaccagcgccttccaggaacagcccccaccctcctcattcataataataacattcggccctcaggggtccctgaccgcttctctggctccaagtctggctcctcagcctccctggccatcactgggctccaggctgacgatgagggtgaatattactgccagtcatatgacagcagcctgcgtctttgggtgttcggcggagggaccaagctgaccgtcctacgtcacgcccaaggctgccccctggtcattctcgttcccaccctcctctagagacacgctgagcgggctggcaaggcgcatagnnnnnnnnnn

SEQ ID NO: 131275 - DNA, 446 bp, Homo sapiens
  misc_feature: GYAE6OF02G5EKY.7.27.C05.1.454.CMB.1.raw
  modified_base (438)..(446): a, c, t, g, unknown or other
  misc_feature (438)..(446): n is a, c, g, or t
tcagcgtgtctctacacgaccggtgctcgatttagacgcgatcgaagggtttggggccccagggcagagggtcaccatctcctgcactgggaacgcctccaacatcgggactttttatgatgcacactggtaccagcgccttccaggaacagcccccaccctcctcattcataataataacattcggccctcaggggtccctgaccgcttctctggctccaagtctggctcctcagcctccctggccatcactgggctccaggctgacgatgagggtgaatattactgccagtcatatgacagcagcctgcgtctttgggtgttcggcggagggaccaagctgaccgtcctacgtcagcccaaggctgccccctggtcactctcgttcccgccctcctctacgagaccacgctgagcgggctgggcaaggcgcatagnnnnnnnnn

SEQ ID NO: 131276 - DNA, 443 bp, Homo sapiens
  misc_feature: GYAE6OF02HAXX8.7.27.C05.1.454.CMB.1.raw
  modified_base (436)..(443): a, c, t, g, unknown or other
  misc_feature (436)..(443): n is a, c, g, or t
tcagcgtgtctctacacgaccggtgctcgatttagacgcgatcgaagggtttggggccccagggcagagggtcaccatctcctgcactgggaacgcctccaacatcgggactttttatgatgcacactggtaccagcgccttccaggaacagcccccaccctcctcattcataataataacattcggccctcaggggtccctgaccgcttctctggctccaagtctggctcctcagcctccctggccatcactgggctccaggctgacgatgagggtgaatattactgccagtcatatgacagcagcctgcgtctttgggtgttcggcggagggaccaagctgaccgtcctacgtcagcccaaggctgccccctcggtcactctcgttcccaccctcctctagagacacgctgagcgggctggcaaggcgcatagnnnnnnnn

SEQ ID NO: 131277 - DNA, 446 bp, Homo sapiens
  misc_feature: GYAE6OF02HZH1H.7.27.C05.1.454.CMB.1.raw
  modified_base (438)..(446): a, c, t, g, unknown or other
  misc_feature (438)..(446): n is a, c, g, or t
tcagcgtgtctctacacgaccggtgctcgatttagacgcgatcgaagggtttggggccccagggcagagggtcaccatctcctgcactgggaacgcctccaacatcgggactttttatgatgcacactggtaccagcgccttccaggaacagcccccaccctcctcattcataataataacattcggccctcaggggtccctgaccgcttctctggctccaagtctggctcctcagcctcctggccatcactgggctccaggctgacgatgagggtgaatattactgccagtcatatgacagcagcctgcgtctttgggtgttcggcggagggaccaagctgaccgtcctacgtcagcccaaggctcgccccctcggtcactctcgttcccgccctcctctagacgacacgctgacgcgggctggcaaggcgcatagnnnnnnnnn

SEQ ID NO: 131278 - DNA, 449 bp, Homo sapiens
  misc_feature: GYAE6OF02GBALB.7.27.C05.1.454.CMB.1.raw
  modified_base (440)..(449): a, c, t, g, unknown or other
  misc_feature (440)..(449): n is a, c, g, or t
tcagcgtgtctctacacgaccggtgctcgatttagacgcgatcgaagggtttggggccccagggcagagggtcaccatctcctgcactgggaacgcctccaacatcgggactttttatgatgcacactggtaccagcgccttccaggaacagcccccaccctcctcattcataataataacattcggccctcaggggtccctgaccgcttctctggctccaagtctggctcctcagcctccctggccatcactgggctccaggctgacgatgagggtgaatattactgccagtcatatgacagcagcctgcgtctttgggtgttcggcggagggaccaagctgaccgtcctacgtcagcccaaggctcgccccctggtcactctcgttccccgccctcctctagacgacacgctgacggcgggctggcaaggcgcatagnnnnnnnnnn

SEQ ID NO: 131279 - DNA, 467 bp, Homo sapiens
  misc_feature: GYAE6OF02HHZFW.7.27.C05.1.454.CMB.1.raw
  modified_base (394)..(394): a, c, t, g, unknown or other
  misc_feature (394)..(394): n is a, c, g, or t
  modified_base (444)..(467): a, c, t, g, unknown or other
  misc_feature (444)..(467): n is a, c, g, or t
tcagcgtgtctctacacgaccggtgctcgatttagacgcgatcgaagggtttggggcccccagggcagagggtcaccatctcctgcactgggaacgcctccaacatcgggactttttatgatgcacactggtaccagcgccttccaggaacagcccccacctcctcattcataataataacattcggccctcaggggtccctgaccgcttctctggctccaagtctggctcctcagcctccctggccatcactgggctccaggctgacgatgagggtgaatattactgccagtcatatgacagcagcctgcgttctttgggtgttcggcggtagggaccaaggctgaccgtctacgtcagcccaaggctgccccctggtcactctcgttccccncctcctctagagacacgctcggagccgggctgggcaaacggcacatagcnnnnnnnnnnnnnnnnnnnnnnnn

SEQ ID NO: 131280 - DNA, 456 bp, Homo sapiens
  misc_feature: GYAE6OF02HN954.7.27.C05.1.454.CMB.1.raw
  modified_base (404)..(404): a, c, t, g, unknown or other
  misc_feature (404)..(404): n is a, c, g, or t
  modified_base (443)..(443): a, c, t, g, unknown or other
  misc_feature (443)..(443): n is a, c, g, or t
  modified_base (448)..(456): a, c, t, g, unknown or other
  misc_feature (448)..(456): n is a, c, g, or t
tcagcgtgtctctacacgaccggtgctcgatttagacgcgatcgaagggtttggggccccagggcagagggtcaccatctcctgcactgggaacgcctccaacatcgggactttttatgatgcacactggtaccagcgccttccaggaacagcccccaccctcctcattcataataataacattcggccctcaggggtccctgaccgcttctctggctccaagtctggctcctcagcctcctggccatcactgggctccaggctgacgatggagggtgaatattactgccagtcatatgacagcagcctgccgttcgtttggggtgttccgggacgggagggacccaaggctgaccgtcctacgtcacgcccaaggctcgccccctcggtcactctcgtccccncctcctctagcgacacgctggacgcgggctggacaggcncatgnnnnnnnnn

SEQ ID NO: 131281 - DNA, 465 bp, Homo sapiens
  misc_feature: GYAE6OF02HLMKT.7.27.C05.1.454.CMB.1.raw
  modified_base (439)..(439): a, c, t, g, unknown or other
  misc_feature (439)..(439): n is a, c, g, or t
  modified_base (447)..(465): a, c, t, g, unknown or other
  misc_feature (447)..(465): n is a, c, g, or t
tcagcgtgtctctacacgaccggtgctcgatttagacgcgatcgaagggtttggggccccagggcagagggtcaccatctcctgcactgggaacgcctccaacatcgggactttttatgatgcacactggtaccagcgccttccaggaacagcccccacctcctcattcataataataacattcggccctcaggggtccctgaccgcttctctggctccaagtctggctcctcagcctccctggccatcactgggctccaggctgacgatgagggtgaatattactgccagtcatatgacagcagcctgcgtctttgggtgttcggcggagggaccaagctgaccgtcctacgtcacgcccaaggctgccccctcggtccactctcgtttccccacctccctctacgagacacgctgacgccggggctgggcaagggcncgataggnnnnnnnnnnnnnnnnnnn

SEQ ID NO: 131282 - DNA, 453 bp, Homo sapiens
  misc_feature: GYAE6OF02IL5AC.7.27.C05.1.454.CMB.1.raw
  modified_base (442)..(442): a, c, t, g, unknown or other
  misc_feature (442)..(442): n is a, c, g, or t
  modified_base (446)..(453): a, c, t, g, unknown or other
  misc_feature (446)..(453): n is a, c, g, or t
tcagcgtgtctctacacgaccggtgctcgatttagacgcgatcgaagggtttgggggccccagggcagagggtcaccatctcctgcactgggaacgcctccaacatcgggactttttatgatgcacactggtaccagcgccttccaggaacagcccccaccctcctcattcataataataacatttcggccctcaggggtccctgaccgcttctctggctccaagtctggctctcagcctccctggccatcactgggctccaggctgacgatgagggtgaatattactgccagtcatatgacagcagcctgcgtctttgggtgttcgggcggagggaccaagctcgaccgtcctacgtcacgcccaaggcctcgccccctcggtcactctcgttccccacccttccctctacgagaccacgctgacgcgggctggcaaggcncatnnnnnnnn

SEQ ID NO: 131283 - DNA, 484 bp, Homo sapiens
  misc_feature: GYAE6OF02HYHZZ.7.27.C05.1.454.CMB.1.raw
  modified_base (415)..(415): a, c, t, g, unknown or other
  misc_feature (415)..(415): n is a, c, g, or t
  modified_base (456)..(484): a, c, t, g, unknown or other
  misc_feature (456)..(484): n is a, c, g, or t
tcagcgtgtctctacacgaccggtgctcgatttagacgcgatcgaagggtttggggccccagggcagagggtcaccatctcctgcactgggaacgcctccaacatcggggacttttttatgatgcacactggtaccagcgccttccaggaacagcccccaccctcctcattcataataataacattcggccctcagggggtccctgaccgcttctctggctccaagtctggcctcctcagccctccctggccatcactgggctccaggctgacgatggaggtgaatattactgccagtcatatgacagcagcctgcgtcgtttgggtgttcggcggtaggaccagctgacccgtctacgcagccaaggctcgccccctggtccactctgttcctctaccctcctctagactaccncgctgacggcgggctgggaccgaagggccacgagtagcgannnnnnnnnnnnnnnnnnnnnnnnnnnnn

SEQ ID NO: 131284 - DNA, 461 bp, Homo sapiens
  misc_feature: GYAE6OF02H47I0.7.27.C05.1.454.CMB.1.raw
  modified_base (400)..(400): a, c, t, g, unknown or other
  misc_feature (400)..(400): n is a, c, g, or t
  modified_base (418)..(418): a, c, t, g, unknown or other
  misc_feature (418)..(418): n is a, c, g, or t
  modified_base (448)..(461): a, c, t, g, unknown or other
  misc_feature (448)..(461): n is a, c, g, or t
tcagcgtgtctctacacgaccggtgctcgatttagacgcgatcgaagggtttggggccccagggcagagggtcaccatctcctgcactgggaacgcctccaacatcgggactttttatgatgcacactggtaccagcgcctttccaggaacagcccccaccctcctcattcataataataacattcggccctcaggggtccctgaccgcttctctggctccaagtctggctcctcagcctcctggccatcactgggctccaggctgacgatgagggtgaatattactgccagtcatatgacagcagcctggcgtcttttggggtgttcgggcggagggaccaagctgaccgtcctacgtcagcccaaggcctcgccccctggtcacttctcgtttccccnccctcctctacgacgacncgctgacgcgggctggcaagggcacatagnnnnnnnnnnnnnn

SEQ ID NO: 131285 - DNA, 461 bp, Homo sapiens
  misc_feature: GYAE6OF02HO2HV.7.27.C05.1.454.CMB.1.raw
  modified_base (438)..(438): a, c, t, g, unknown or other
  misc_feature (438)..(438): n is a, c, g, or t
  modified_base (443)..(461): a, c, t, g, unknown or other
  misc_feature (443)..(461): n is a, c, g, or t
tcagcgtgtctctacacgaccggtgctcgatttagacgcgatcgaagggtttggggccccagggcagagggtcaccatctcctgcactgggaacgcctccaacatcgggactttttatgatgcacactggtaccagcgccttccaggaacagccccccacctcctcattcataataataacattcggccctcaggggtccctgaccgcttctctggctccaagtctggctcctcagccctccctggccatcactgggctccaggctgacgatgagggtgaatattactgccagtcatatgacagcagcctgcgtcgtttgggtgttcgggcgggagggaccaaggctcgaccgtcctagtcagcccaaggctcgccccctggtacactctcgttccccaccctcctctagacgacacgctgagcggctggacaggcgnatagnnnnnnnnnnnnnnnnnnn

SEQ ID NO: 131286 - DNA, 487 bp, Homo sapiens
  misc_feature: GYAE6OF02GR13H.7.27.C05.1.454.CMB.1.raw
  modified_base (278)..(278): a, c, t, g, unknown or other
  misc_feature (278)..(278): n is a, c, g, or t
  modified_base (314)..(314): a, c, t, g, unknown or other
  misc_feature (314)..(314): n is a, c, g, or t
  modified_base (454)..(455): a, c, t, g, unknown or other
  misc_feature (454)..(455): n is a, c, g, or t
  modified_base (457)..(457): a, c, t, g, unknown or other
  misc_feature (457)..(457): n is a, c, g, or t
  modified_base (460)..(460): a, c, t, g, unknown or other
  misc_feature (460)..(460): n is a, c, g, or t
  modified_base (462)..(487): a, c, t, g, unknown or other
  misc_feature (462)..(487): n is a, c, g, or t
tcagcgtgtctctacacgaccggtgctcgatttagacgcgatcgaagggtttggggccccagggcagagggtcaccatctcctgcactgggaacgcctccaacatcgggactttttatgatgcacactggtaccagcgccttccaggaacagcccccaccctcctcattcataataataacattcggccctcaggggtccctgaccgcttctctggctccaagtctggctcctcagcctccctggccatcactgggctccaggctgacgatgagggtnaatattactgccagtcatatgacagcagcctgcgtntttgggtgttcggcggagggaccaaggctcggaccgtcctacgtcacgcccaaggctcgccccctggtcactctcgttccccgccctctctagacgaccacgtctgacggccgggctgggccgaagggtccgacagtgcnngnacngnnnnnnnnnnnnnnnnnnnnnnnnnn

SEQ ID NO: 131287 - DNA, 466 bp, Homo sapiens
  misc_feature: GYAE6OF02HWZ6T.7.27.C05.1.454.CMB.1.raw
  modified_base (405)..(405): a, c, t, g, unknown or other
  misc_feature (405)..(405): n is a, c, g, or t
  modified_base (447)..(447): a, c, t, g, unknown or other
  misc_feature (447)..(447): n is a, c, g, or t
  modified_base (454)..(466): a, c, t, g, unknown or other
  misc_feature (454)..(466): n is a, c, g, or t
tcagcgtgtctctacacgaccggtgctcgatttagacgcgatcgaagggtttggggcccccagggcagagggtcaccatctcctgcactgggaacgcctccaacatcgggactttttatgatgcacactggtaccagcgccttccaggacagcccccaccctcctcattcataataataacatttcggccctcaggggtccctgaccgcttctctggctccaagtctggctcctcagcctcctggccatccacgtgggcctccgaggctgacgatgagggtgaatattactgccagtcatatgacagcagcctgcgttctttggggtgttcgggcggtacgggaccagctcgaccgtcctagtcagcccaaggcctcgcccccgtggtccacttctcgttccccnccctctctagacacacgctagacgcgggcgtggccaacggcncgatagnnnnnnnnnnnnn

SEQ ID NO: 131288 - DNA, 600 bp, Homo sapiens
  misc_feature: GYAE6OF02H6VXX.7.27.C05.1.454.CMB.1.raw
  modified_base (195)..(195): a, c, t, g, unknown or other
  misc_feature (195)..(195): n is a, c, g, or t
  modified_base (216)..(216): a, c, t, g, unknown or other
  misc_feature (216)..(216): n is a, c, g, or t
  modified_base (237)..(237): a, c, t, g, unknown or other
  misc_feature (237)..(237): n is a, c, g, or t
  modified_base (296)..(296): a, c, t, g, unknown or other
  misc_feature (296)..(296): n is a, c, g, or t
  modified_base (568)..(568): a, c, t, g, unknown or other
  misc_feature (568)..(568): n is a, c, g, or t
  modified_base (571)..(573): a, c, t, g, unknown or other
  misc_feature (571)..(573): n is a, c, g, or t
  modified_base (576)..(600): a, c, t, g, unknown or other
  misc_feature (576)..(600): n is a, c, g, or t
tcagcgtgtctctacacgaccggtgctcgatttagacgcgatcgaagggtttggggccccagggcagagggtcaccatctcctgcactgggaacgcctccaacatcgggacttttttatgatgcacactggtaccagcgccttccaggaacacgcccccaccctcctcattcaataataataacattcggccctnaggggtcccctgaccgcttcnctggctccaagtctgctcctnacgcctccctggccatcactgggcctcgaggctgacgatggagggtgaaattacttacngaccagttcaattatgacagcacgccttggtactttcggttttaggggttcggttaccggggcgggaaggggtaacccaaggtccgtaccgggtacccgtacctaccggtacgaacggtccccggaaaggtccctacccggtccccccgttagggtaccctaaccgtttcccgttacccggtttcccccccgcctttacccgtaccttaacggaacgtaccgaaccggtcgtcgggacggccgggtcgacgggtaccgaaggcacgaagtgnagnnngcnnnnnnnnnnnnnnnnnnnnnnnnn

SEQ ID NO: 131289 - DNA, 467 bp, Homo sapiens
  misc_feature: GYAE6OF02IL8ED.7.27.C05.1.454.CMB.1.raw
  modified_base (292)..(292): a, c, t, g, unknown or other
  misc_feature (292)..(292): n is a, c, g, or t
  modified_base (335)..(335): a, c, t, g, unknown or other
  misc_feature (335)..(335): n is a, c, g, or t
  modified_base (411)..(411): a, c, t, g, unknown or other
  misc_feature (411)..(411): n is a, c, g, or t
  modified_base (445)..(467): a, c, t, g, unknown or other
  misc_feature (445)..(467): n is a, c, g, or t
tcagcgtgtctctacacgaccggtgctcgatttagacgcgatcgaagggtttgggggcccccagggcagagggtcaccatctcctgcactgggaacgcctccaacatcgggactttttatgatgcacactggtaccagcgccttccaggaacagcccccaccctcctcattcataataataacattcggccctcaggggtccctgaccgcttctctggctccaagtctggctctcagcctccctggcccatccactgggctccaggctgacgatggaggggtgaatattacngccagtcatatgacagcagcctgcgttctttggggtgttcggnggagggccaagctgaccgtcacgtcagcccaaggctcgcccctgtcactctcgttcccgccctcctctagacgacncgctgacggcgggctgggcaacgggcacagtagnnnnnnnnnnnnnnnnnnnnnnn

SEQ ID NO: 131290 - DNA, 524 bp, Homo sapiens
  misc_feature: GYAE6OF02IYLBS.7.27.C05.1.454.CMB.1.raw
  modified_base (276)..(276): a, c, t, g, unknown or other
  misc_feature (276)..(276): n is a, c, g, or t
  modified_base (285)..(285): a, c, t, g, unknown or other
  misc_feature (285)..(285): n is a, c, g, or t
  modified_base (295)..(295): a, c, t, g, unknown or other
  misc_feature (295)..(295): n is a, c, g, or t
  modified_base (299)..(300): a, c, t, g, unknown or other
  misc_feature (299)..(300): n is a, c, g, or t
  modified_base (309)..(309): a, c, t, g, unknown or other
  misc_feature (309)..(309): n is a, c, g, or t
  modified_base (491)..(492): a, c, t, g, unknown or other
  misc_feature (491)..(492): n is a, c, g, or t
  modified_base (496)..(524): a, c, t, g, unknown or other
  misc_feature (496)..(524): n is a, c, g, or t
tcagcgtgtctctacacgaccggtgctcgatttagacgcgatcgaagggtttggggccccagggcagagggtcaccatctcctgcactgggaacgcctccaacatcgggactttttatgatgcacactggtaccagcgccttccaggaacacgcccccacctcctcattcataataataacattcggccctgaggggtccctgaccgcttctctggctccaagtctggctctcacgcctcctgccatcacgtggctccgaggctgacatgagggtnaatattacngcagtcatangacnncgacgtccngtcgttgtttgggtgttcgggacggaacggaccaaggctaggacccgtacctacggaccacgacccaaggtcctccggtacccccgtggttaccaccttcgttcccgtccccgaccctccgtacaaccggacacgccgtcgtaggacggtcgggctacgggacaacggcaaccgagtacgannacgnnnnnnnnnnnnnnnnnnnnnnnnnnnnn

SEQ ID NO: 131291 - DNA, 450 bp, Homo sapiens
  misc_feature: GYAE6OF02FIECD.7.27.C05.1.454.CMB.1.raw
  modified_base (441)..(450): a, c, t, g, unknown or other
  misc_feature (441)..(450): n is a, c, g, or t
tcagcgtgtctctacacgaccggtgctcgatttagacgcgatcgaagggtttggggccccagggcagagggtcaccatctcctgcactgggaacgcctccaacatcgggactttttatgatgcacactggtaccagcgccttccaggaacagcccccaccctcctcattcataataataacattcggccctcaggggtccctgaccgcttctctggctccaagtctggctcctcagcctcccctggcccatcactgggctccaggctgacgatgagggtgaatattactgccagtcatatgacagcagcctgcgtctttgggtgttcggcggagggaccaagctgaccgtcctacgtcagcccaaggcctgccccctggtcacgtctcgtttccccaccctcctctagcgacacgctgagcgggctggcaaggcgcatagnnnnnnnnnn

SEQ ID NO: 131292 - DNA, 494 bp, Homo sapiens
  misc_feature: GYAE6OF02HXUW3.7.27.C05.1.454.CMB.1.raw
  modified_base (306)..(306): a, c, t, g, unknown or other
  misc_feature (306)..(306): n is a, c, g, or t
  modified_base (319)..(319): a, c, t, g, unknown or other
  misc_feature (319)..(319): n is a, c, g, or t
  modified_base (461)..(461): a, c, t, g, unknown or other
  misc_feature (461)..(461): n is a, c, g, or t
  modified_base (463)..(463): a, c, t, g, unknown or other
  misc_feature (463)..(463): n is a, c, g, or t
  modified_base (465)..(469): a, c, t, g, unknown or other
  misc_feature (465)..(469): n is a, c, g, or t
  modified_base (471)..(494): a, c, t, g, unknown or other
  misc_feature (471)..(494): n is a, c, g, or t
tcagcgtgtctctacacgaccggtgctcgatttagacgcgatcgaagggtttggggccccagggcagagggtcaccatctcctgcactgggaacgccctccaacatcgggacttttttatgatgcacactggtaccagcgccttccaggaacagcccccaccctcctcattcataataataacattcggccctcaggggtccctgaccgcttctctggctccaagtctggcctcctcacgccctcctggccatcactgggctccaggctgacgatggaggtgaatattactgccagtcatatgacngcagcctgccgtnttttggggtgttcggcggagggaccagctggaccgtcctagtcagcccaaggcctcgccccctggtccacgttcctcgttccccgcccttcctctagacgtaccacgcgtagcggcggtcgtggcaacgggtcacgtagtgntncnnnnngnnnnnnnnnnnnnnnnnnnnnnnn

SEQ ID NO: 131293 - DNA, 566 bp, Homo sapiens
  misc_feature: GYAE6OF02I5C4E.7.27.C05.1.454.CMB.1.raw
  modified_base (308)..(308): a, c, t, g, unknown or other
  misc_feature (308)..(308): n is a, c, g, or t
  modified_base (319)..(319): a, c, t, g, unknown or other
  misc_feature (319)..(319): n is a, c, g, or t
  modified_base (529)..(529): a, c, t, g, unknown or other
  misc_feature (529)..(529): n is a, c, g, or t
  modified_base (536)..(536): a, c, t, g, unknown or other
  misc_feature (536)..(536): n is a, c, g, or t
  modified_base (538)..(543): a, c, t, g, unknown or other
  misc_feature (538)..(543): n is a, c, g, or t
  modified_base (545)..(566): a, c, t, g, unknown or other
  misc_feature (545)..(566): n is a, c, g, or t
tcagcgtgtctctacacgaccggtgctcgatttagacgcgatcgaagggtttgggggcccccagggcagagggtcaccatctcctgcactgggaacgcctccaacatcgggactttttatgatgcacactggtaccagcgccttccaggaacacgcccccacctcctcatcataataataacattcggccctcgaggggtccctgaccgtcttctctcggcctccaagtctcggccttcctcacgtccctcccgtggccactccacgtgggcctccgaggctgacgatggaagggtgaaatattaacngccagtcaatntagacagcagcctgcgttcgtttgggtgttcgggcgggacgggaaccaggcgtcggacccgtcgtaccgtcgacgcccgaaaggtctaccgcccccgtcggtcccaccgttcgttccggtttcccccgcccttcccgtaccaacggaacgaccccgacgtccgtacggacgggccgggggcttaccggggaccgtaagggtcccgacgtntacggangnnnnnngnnnnnnnnnnnnnnnnnnnnnn

SEQ ID NO: 131294 - DNA, 453 bp, Homo sapiens
  misc_feature: GYAE6OF02FSW8G.7.27.C05.1.454.CMB.1.raw
  modified_base (439)..(439): a, c, t, g, unknown or other
  misc_feature (439)..(439): n is a, c, g, or t
  modified_base (444)..(453): a, c, t, g, unknown or other
  misc_feature (444)..(453): n is a, c, g, or t
tcagcgtgtctctacacgaccggtgctcgatttagacgcgatcgaagggtttggggcccccagggcagagggtcaccatctcctgcactgggaacgcctccaacatcgggactttttatgatgcacactggtaccagcgccttccaggaacagcccccaccctcctcattcataataataacattcggccctcaggggtccctgaccgcttctctggctccaagtctggctcctcagcctccctggccatcactgggcctccaggctgacgatgagggtgaatattactgccagtcatatgacagcagcctgcgttctttgggtgttcggcggagggaccaaggctgaccgtcctacgtcacgcccaaggctcgccccctggtcactctcgtcccaccctcctcagacgacacgctgacgcgggcgtcggcaaggcganatagnnnnnnnnnn

SEQ ID NO: 131295 - DNA, 585 bp, Homo sapiens
  misc_feature: GYAE6OF02GZQBM.7.27.C05.1.454.CMB.1.raw
  modified_base (126)..(126): a, c, t, g, unknown or other
  misc_feature (126)..(126): n is a, c, g, or t
  modified_base (158)..(158): a, c, t, g, unknown or other
  misc_feature (158)..(158): n is a, c, g, or t
  modified_base (249)..(249): a, c, t, g, unknown or other
  misc_feature (249)..(249): n is a, c, g, or t
  modified_base (277)..(277): a, c, t, g, unknown or other
  misc_feature (277)..(277): n is a, c, g, or t
  modified_base (298)..(298): a, c, t, g, unknown or other
  misc_feature (298)..(298): n is a, c, g, or t
  modified_base (303)..(303): a, c, t, g, unknown or other
  misc_feature (303)..(303): n is a, c, g, or t
  modified_base (353)..(353): a, c, t, g, unknown or other
  misc_feature (353)..(353): n is a, c, g, or t
  modified_base (423)..(423): a, c, t, g, unknown or other
  misc_feature (423)..(423): n is a, c, g, or t
  modified_base (482)..(482): a, c, t, g, unknown or other
  misc_feature (482)..(482): n is a, c, g, or t
  modified_base (484)..(484): a, c, t, g, unknown or other
  misc_feature (484)..(484): n is a, c, g, or t
  modified_base (541)..(541): a, c, t, g, unknown or other
  misc_feature (541)..(541): n is a, c, g, or t
tcagcgtgtctctacacgaccggtgctcgatttagacgcgatcgaaggggtttggggccccagggcacgagggtccaccgattctcctgtcacttgggaacgcctccaacgatcgggactttttangatgcacactggtacctagcgccttcaggacngttccccacctcctcatttacgataactaatacattcggccctcaggggttccctggaccgcttcgcgtggctccaagtctcggcgtcctnacgtcctccctggccatcactggctccnggcttgacgatgaggtcaatnttacngccgagtcatactcgacgaggcaggcctggcttcgttgggtcgttcgggngacggtaccaagcgtacgacccgtctacgtcagacccgagctcgcccccgtaggtccactcctcgtcccncctcctactacgacgtaccacgctacgacgtcggcgtgacgaacgccgacacgtacgcngngcgagcgacgcactacgtctacgtgacgacgtacgtggactaacgacgtcgtaaccncggttacggacgtaccggaaccgttcgaacgtccgtctacccgg

SEQ ID NO: 131296 - DNA, 455 bp, Homo sapiens
  misc_feature: GYAE6OF02F4CLH.7.27.C05.1.454.CMB.1.raw
  modified_base (433)..(433): a, c, t, g, unknown or other
  misc_feature (433)..(433): n is a, c, g, or t
  modified_base (435)..(435): a, c, t, g, unknown or other
  misc_feature (435)..(435): n is a, c, g, or t
  modified_base (438)..(455): a, c, t, g, unknown or other
  misc_feature (438)..(455): n is a, c, g, or t
tcagcgtgtctctacacgaccggtgctcgatttagacgcgatcgaagggtttggggccccagggcagagggtcaccatctcctgcactgggaacgcctccaacatcgggactttttatgatgcacactggtaccagcgccttccaggaacagcccccaccctcctcattcataataataacattcggccctcaggggtccctgaccgcttctctggctccaagtctggctcctcacgcctccctggccatcactgggctccaggctgacgatgaggtgaatattactgccagtcatatgacagcagcctgcgtctttgggtgttcgggcggagggaccaagctgaccgtcctacgtcagcccaaggctcgccccctggtcactctcgttcccacctcctctacgacgacacgctgacgcgggctggcaaggcnanagnnnnnnnnnnnnnnnnnn

SEQ ID NO: 131297 - DNA, 473 bp, Homo sapiens
  misc_feature: GYAE6OF02HOB79.7.27.C05.1.454.CMB.1.raw
  modified_base (455)..(455): a, c, t, g, unknown or other
  misc_feature (455)..(455): n is a, c, g, or t
  modified_base (460)..(473): a, c, t, g, unknown or other
  misc_feature (460)..(473): n is a, c, g, or t
tcagcgtgtctctacacgaccggtgctcgatttagacgcgatcgaagggtttggggccccagggcagagggtcaccatctcctgcactgggaacgcctccaacatcgggactttttatgatgcacactggtaccagcgccttccaggaacagcccccaccctcctcattcataataataacattcggccctcaggggtccctgaccgcttctctggctccaagtctggctcctcacgcctccctggccatcactgggctccaggctgacgatggagggtgaatattactgccagtcatatgacagcagcctgcgttcgtttggggtcgttcggcggagggaccaaggctgaccgtcctacgtcacgcccaaggcctcgccccctcggtccacgttctcgttccccgccctcctcgtaggacgacacgtcgtcgacggcgggctgggacaagggcncatgnnnnnnnnnnnnnn

SEQ ID NO: 131298 - DNA, 479 bp, Homo sapiens
  misc_feature: GYAE6OF02JF6VY.7.27.C05.1.454.CMB.1.raw
  modified_base (278)..(278): a, c, t, g, unknown or other
  misc_feature (278)..(278): n is a, c, g, or t
  modified_base (382)..(382): a, c, t, g, unknown or other
  misc_feature (382)..(382): n is a, c, g, or t
  modified_base (447)..(447): a, c, t, g, unknown or other
  misc_feature (447)..(447): n is a, c, g, or t
  modified_base (450)..(479): a, c, t, g, unknown or other
  misc_feature (450)..(479): n is a, c, g, or t
tcagcgtgtctctacacgaccggtgctcgatttagacgcgatcgaagggtttggggccccagggcagagggtcaccatctcctgcactgggaacgcctccaacatcgggactttttatgatgcacactggtaccagcgccttccaggaacagcccccaccctcctcattcataataataacattcggccctcaggggtccctgaccgcttctctggctccaagtctggctcctcagcctccctggccatcactgggctccaggctgacgatgagggtnaatattactgccagtcatatgacagcagcctgcgttcttgggtgttcggcggagggaccaaggtctgaccgtcctacgtcacgccaaggcctcgccccctggcnctctcgttccccaccctctcctagcgtacacgctgacggcggtctcggacgaaggcctagatagncgnnnnnnnnnnnnnnnnnnnnnnnnnnnnnn

SEQ ID NO: 131299 - DNA, 449 bp, Homo sapiens
  misc_feature: GYAE6OF02H3JQ7.7.27.C05.1.454.CMB.1.raw
  modified_base (192)..(192): a, c, t, g, unknown or other
  misc_feature (192)..(192): n is a, c, g, or t
  modified_base (440)..(449): a, c, t, g, unknown or other
  misc_feature (440)..(449): n is a, c, g, or t
tcagcgtgtctctacacgaccggtgctcgatttagacgcgatcgaagggtttggggccccagggcagagggtcaccatctcctgcactgggaacgcctccaacatcgggactttttatgatgcacactggtaccagcgccttccaggaacagcccccaccctcctcattcataataataacattcggccctnaggggtccctgaccgcttctctggctccaagtctggctcctcacgcctccctggccatcactgggctccaggctgacgatgagggtgaatattactgccagtcatatgacagcagcctgcgtcttttgggtgttcggcgggagggaccaagctgaccgtcctacgtcagcccaaggctcgcccctggtcactctcgttcccacctcctctagacgacacgctgacgcgggctggcaaggcgcagtagnnnnnnnnnn

SEQ ID NO: 131300 - DNA, 452 bp, Homo sapiens
  misc_feature: GYAE6OF02HSSWQ.7.27.C05.1.454.CMB.1.raw
  modified_base (277)..(277): a, c, t, g, unknown or other
  misc_feature (277)..(277): n is a, c, g, or t
  modified_base (322)..(322): a, c, t, g, unknown or other
  misc_feature (322)..(322): n is a, c, g, or t
  modified_base (408)..(408): a, c, t, g, unknown or other
  misc_feature (408)..(408): n is a, c, g, or t
  modified_base (437)..(452): a, c, t, g, unknown or other
  misc_feature (437)..(452): n is a, c, g, or t
tcagcgtgtctctacacgaccggtgctcgatttagacgcgatcgaagggtttggggcccccagggcagagggtcaccatctcctgcactgggaacgcctccaacatcgggactttttatgatgcacactggtaccagcgccttccaggaacagcccccaccctcctcattcataataataacattcggccctcaggggtccctgaccgcttctctggctccaagtctggctcctcagcctcctggccatcactggctccaggctgacgatgagggtnaatattactgccagtcatatgacagcagcctgcgttctttgggtnttcggcggaggaccaagctgacctccagtcacgccaaggctcgccccctgtccactctcgttccccgcctcctctagacgacacgntgaggcggctcggacaaggcgacatacgnnnnnnnnnnnnnnnn

SEQ ID NO: 131301 - DNA, 547 bp, Homo sapiens
  misc_feature: GYAE6OF02GSG0C.7.27.C05.1.454.CMB.1.raw
  modified_base (305)..(305): a, c, t, g, unknown or other
  misc_feature (305)..(305): n is a, c, g, or t
  modified_base (506)..(506): a, c, t, g, unknown or other
  misc_feature (506)..(506): n is a, c, g, or t
  modified_base (514)..(514): a, c, t, g, unknown or other
  misc_feature (514)..(514): n is a, c, g, or t
  modified_base (518)..(521): a, c, t, g, unknown or other
  misc_feature (518)..(521): n is a, c, g, or t
  modified_base (524)..(526): a, c, t, g, unknown or other
  misc_feature (524)..(526): n is a, c, g, or t
  modified_base (528)..(531): a, c, t, g, unknown or other
  misc_feature (528)..(531): n is a, c, g, or t
  modified_base (533)..(542): a, c, t, g, unknown or other
  misc_feature (533)..(542): n is a, c, g, or t
  modified_base (544)..(546): a, c, t, g, unknown or other
  misc_feature (544)..(546): n is a, c, g, or t
tcagcgtgtctctacacgaccggtgctcgatttagacgcgatcgaagggtttggggcccccagggcagagggtcaccatctcctgcactgggaacgcctccaacatcgggactttttatgatgcacactggtaccagcgccttccaggaacagcccccaccctcctcattcaataataataacattcggccctcgaggggtcccctgaccgcttctctggctccaagtctggctcctcagcctcctggccatcactggctcaggctgacgatggaggtgaatattactcgcctagtcatatgacngcacgccgtgcgttcgtttgggtcgttcggacgggaggtaccaagtctcggaccgtcctacgtacacgacccgaaggctccggcccccttggccaccttcgttccgtttacccccgccccttcctaccgtacgtaacgaccacggtccgtaggacggccggggaccgttcgggacgaaacgggtaccgccgtaattacggntgacgtcncgannnngcnnncnnnngnnnnnnnnnncnnnc

SEQ ID NO: 131302 - DNA, 460 bp, Homo sapiens
  misc_feature: GYAE6OF02GQJNB.7.27.C05.1.454.CMB.1.raw
  modified_base (306)..(306): a, c, t, g, unknown or other
  misc_feature (306)..(306): n is a, c, g, or t
  modified_base (412)..(412): a, c, t, g, unknown or other
  misc_feature (412)..(412): n is a, c, g, or t
  modified_base (446)..(460): a, c, t, g, unknown or other
  misc_feature (446)..(460): n is a, c, g, or t
tcagcgtgtctctacacgaccggtgctcgatttagacgcgatcgaagggtttggggccccagggcagagggtcaccatctcctgcactgggaacgcctccaacatcgggactttttatgatgcacactggtaccagcgccttccaggaacagcccccaccctcctcattcataataataacattcggccctcaggggtccctgaccgcttctctggctccaagtctggctcctcagccctccctggccatcacgtgggctccgaggctgacgatggagggtgaatattactgccagtcatatgacngcacgcctgcgttcgtttggggtgttcgggcgggagggaccaagctgacccgtctacgtcacgccaggctcgcccctgtcactctcgtcccgcctctactgacacncgctggacgcgggctgggcgaacggcgacagtgnnnnnnnnnnnnnnn

SEQ ID NO: 131303 - DNA, 667 bp, Homo sapiens
  misc_feature: GYAE6OF02IA7UT.7.27.C05.1.454.CMB.1.raw
  modified_base (325)..(325): a, c, t, g, unknown or other
  misc_feature (325)..(325): n is a, c, g, or t
  modified_base (338)..(338): a, c, t, g, unknown or other
  misc_feature (338)..(338): n is a, c, g, or t
  modified_base (588)..(588): a, c, t, g, unknown or other
  misc_feature (588)..(588): n is a, c, g, or t
  modified_base (602)..(602): a, c, t, g, unknown or other
  misc_feature (602)..(602): n is a, c, g, or t
  modified_base (612)..(612): a, c, t, g, unknown or other
  misc_feature (612)..(612): n is a, c, g, or t
  modified_base (617)..(617): a, c, t, g, unknown or other
  misc_feature (617)..(617): n is a, c, g, or t
tcagcgtgtctctacacgaccggtgctcgatttagacgcgatcgaagggtttggggccccagggcagagggtcaccatctcctgcacgtgggaacgcctccaacagtcgggtactttttatgatgcacactggtaccagcgccttccgaaggaaccacgccccccaccctccctcattccaataaataaataacagttccggccctcgacggggtccctgaccgtcttccgtctacggcctaccgaaggtctcggcctcctacgacgcccttcccgtggacccatccacgtcgggctccgaggctcggacgtagcggaggggtanaacttacttacgngtaccctagtactagtaagtcgtacaaggtccagtccgtagtcggtttcgtttggggttcgtcggggtacgggacggaacctaggtcctacggacccgtaccttccgggtacacgggtacccagggtcctacccgccccccggttagtcccgtacgttcccgttacccgttccccgtaacccttccgtactacgacgaccgtacgcgtcgtcggccggtcgtcggacgtacgggacgtacgtacgtacgntacggctacgatcncgacgcgtcncgcgngtctcgactacgacgcgacgtcgctcgtcgcgtcgcgacgctactacgcg

SEQ ID NO: 131304 - DNA, 547 bp, Homo sapiens
  misc_feature: GYAE6OF02F5WOM.7.27.C05.1.454.CMB.1.raw
  modified_base (193)..(193): a, c, t, g, unknown or other
  misc_feature (193)..(193): n is a, c, g, or t
  modified_base (235)..(235): a, c, t, g, unknown or other
  misc_feature (235)..(235): n is a, c, g, or t
  modified_base (263)..(263): a, c, t, g, unknown or other
  misc_feature (263)..(263): n is a, c, g, or t
  modified_base (306)..(306): a, c, t, g, unknown or other
  misc_feature (306)..(306): n is a, c, g, or t
  modified_base (528)..(547): a, c, t, g, unknown or other
  misc_feature (528)..(547): n is a, c, g, or t
tcagcgtgtctctacacgaccggtgctcgatttagacgcgatcgaagggtttggggccccagggcagagggtcaccatctcctgcactgggaacgcctccaacatcgggactttttatgatgcacactggtaccagcgccttccaggaacacgcccccaccctcctcattcataataataacattcggccctnaggggtccctgaccgcttctctggctccaagtctggctcctnagccctcctggccatcacgtgggctccnggctgacgatggagggtgaattattactgccagtcatatgacngcagcctgcgttctttgggggtagtttcgggacgggacgggtaccaaggcctacggtaccgttcccgtacggtccaacggtaccccaagggtcctccggtcccccccttggggttacccacccgtttccgttcccgggtttcccccgcccctttcctaccgtacggtacgaccacgtcgttcggacggtccggggtctcgggaccgaacggcgactagtagnnnnnnnnnnnnnnnnnnnn

SEQ ID NO: 131305 - DNA, 525 bp, Homo sapiens
  misc_feature: GYAE6OF02H3CPB.7.27.C05.1.454.CMB.1.raw
  modified_base (307)..(307): a, c, t, g, unknown or other
  misc_feature (307)..(307): n is a, c, g, or t
  modified_base (492)..(492): a, c, t, g, unknown or other
  misc_feature (492)..(492): n is a, c, g, or t
  modified_base (494)..(515): a, c, t, g, unknown or other
  misc_feature (494)..(515): n is a, c, g, or t
  modified_base (517)..(525): a, c, t, g, unknown or other
  misc_feature (517)..(525): n is a, c, g, or t
tcagcgtgtctctacacgaccggtgctcgatttagacgcgatcgaagggtttggggccccagggcagagggtcaccatctcctgcactgggaacgcctccaaacatcgggacttttttatgatgcacactggtaccagcgccttccaggacagcccccaccctcctcattcataataataacattcggccctcaggggtccctgaccgcttctctggctccaagtctggctcctcagccctccctggccatcactcgggctcccaggctgaccgatggagggtgaaatattactgacctagtcatancgacacggcacgcctgcgttcgttttggggtcgtttcgggcggacgggaccaaggcgtgacccgtcctacgtcacgcccaaggcctcgcccccttggccacctcgtccgttccccaccctcccgtacgacgaccaccggctaggcggaccgggcgttcgggaccgaagggtccgcgtaagtagcncnnnnnnnnnnnnnnnnnnnnnncnnnnnnnnn

SEQ ID NO: 131306 - DNA, 478 bp, Homo sapiens
  misc_feature: GYAE6OF02I0GRT.7.27.C05.1.454.CMB.1.raw
  modified_base (191)..(191): a, c, t, g, unknown or other
  misc_feature (191)..(191): n is a, c, g, or t
  modified_base (260)..(260): a, c, t, g, unknown or other
  misc_feature (260)..(260): n is a, c, g, or t
  modified_base (289)..(289): a, c, t, g, unknown or other
  misc_feature (289)..(289): n is a, c, g, or t
  modified_base (298)..(298): a, c, t, g, unknown or other
  misc_feature (298)..(298): n is a, c, g, or t
  modified_base (330)..(330): a, c, t, g, unknown or other
  misc_feature (330)..(330): n is a, c, g, or t
  modified_base (419)..(419): a, c, t, g, unknown or other
  misc_feature (419)..(419): n is a, c, g, or t
  modified_base (437)..(437): a, c, t, g, unknown or other
  misc_feature (437)..(437): n is a, c, g, or t
  modified_base (454)..(455): a, c, t, g, unknown or other
  misc_feature (454)..(455): n is a, c, g, or t
  modified_base (457)..(478): a, c, t, g, unknown or other
  misc_feature (457)..(478): n is a, c, g, or t
tcagcgtgtctctacacgaccggtgctcgatttagacgcgatcgaagggtttggggccccagggcagagggtcaccatctcctgcactgggaacgcctccaacatcgggactttttatgatgcacactggtaccagcgccttccaggaacagcccccacctcctcattcataataataacattcggccctnaggggtccctgaccgcttctctgctccaagtctggctcctcagcctccctggccatcactgggctccgngctgacgatggaggtgaatatactgaccngtcatagtnacgagcagcctgcgttcgtttgggtgttcggngggacgggacagctcgacgtcctacgtcagcccaaggcctcgccccgtggtcacttcgtcccgtccccgcccttcctactacgagaccncgctggacggtccggcgnggacgaaggcgacatgnngnnnnnnnnnnnnnnnnnnnnnn

SEQ ID NO: 131307 - DNA, 497 bp, Homo sapiens
  misc_feature: GYAE6OF02IMAJ7.7.27.C05.1.454.CMB.1.raw
  modified_base (238)..(238): a, c, t, g, unknown or other
  misc_feature (238)..(238): n is a, c, g, or t
  modified_base (287)..(287): a, c, t, g, unknown or other
  misc_feature (287)..(287): n is a, c, g, or t
  modified_base (474)..(474): a, c, t, g, unknown or other
  misc_feature (474)..(474): n is a, c, g, or t
  modified_base (481)..(497): a, c, t, g, unknown or other
  misc_feature (481)..(497): n is a, c, g, or t
tcagcgtgtctctacacgaccggtgctcgatttagacgcgatcgaagggtttgggggcccccagggcagagggtcaccatctcctgcactgggaacgcctccaacatcgggacttttttatgatgcacactggtaccagcgccttccaggaacacgcccccaccctcctcattcataataataacattcggccctcaggggtccctgaccgcttctctggctccaagtctggctcctnacgcctccctggccatccacgtcgggctccaggctgacgatggagggtnaatattactgcccagtcaatatgacagcagccctgccgttgttttggggtcgttcgggcgggtacgggaccaaggcctaggtacccgtccctacgtcaccggcccaaggtcctccgcccccgtgtcctactttcccgtacccctccctctactagacgaccacgtctggcgcggctggacacggtcncatacgnnnnnnnnnnnnnnnnn

SEQ ID NO: 131308 - DNA, 502 bp, Homo sapiens
  misc_feature: GYAE6OF02HV3NW.7.27.C05.1.454.CMB.1.raw
  modified_base (271)..(271): a, c, t, g, unknown or other
  misc_feature (271)..(271): n is a, c, g, or t
  modified_base (298)..(298): a, c, t, g, unknown or other
  misc_feature (298)..(298): n is a, c, g, or t
  modified_base (305)..(305): a, c, t, g, unknown or other
  misc_feature (305)..(305): n is a, c, g, or t
  modified_base (464)..(464): a, c, t, g, unknown or other
  misc_feature (464)..(464): n is a, c, g, or t
  modified_base (472)..(473): a, c, t, g, unknown or other
  misc_feature (472)..(473): n is a, c, g, or t
  modified_base (475)..(476): a, c, t, g, unknown or other
  misc_feature (475)..(476): n is a, c, g, or t
  modified_base (478)..(502): a, c, t, g, unknown or other
  misc_feature (478)..(502): n is a, c, g, or t
tcagcgtgtctctacacgaccggtgctcgatttagacgcgatcgaagggtttgggccccagggcagagggtcaccatctcctgcactgggaacgcctccaacatcgggactttttatgatgcacactggtaccagcgccttccaggaacagccccccaccctcctcattcataataataacattcggccctcaggggtcccctgaccgcttctctggctccaagtctggcctcctcagcctcctggccatcactgggctccaggctgacgntgagggtgaatattactgccagtcatnagacagnagcctgctcgtttggtgttcggcggaggaccaggctcgtaccgtcctacgtacacgcccgtaaggcctacccggtccccctcgggtctacccgttcgttaccgtttcccaccccttcctacgtacgacgtacacgctgacggcgggcgtggcgtaggcngtagtagnngnngnnnnnnnnnnnnnnnnnnnnnnnnn

SEQ ID NO: 131309 - DNA, 580 bp, Homo sapiens
  misc_feature: GYAE6OF02GDYUP.7.27.C05.1.454.CMB.1.raw
  modified_base (278)..(278): a, c, t, g, unknown or other
  misc_feature (278)..(278): n is a, c, g, or t
  modified_base (548)..(548): a, c, t, g, unknown or other
  misc_feature (548)..(548): n is a, c, g, or t
  modified_base (550)..(553): a, c, t, g, unknown or other
  misc_feature (550)..(553): n is a, c, g, or t
  modified_base (555)..(558): a, c, t, g, unknown or other
  misc_feature (555)..(558): n is a, c, g, or t
  modified_base (560)..(580): a, c, t, g, unknown or other
  misc_feature (560)..(580): n is a, c, g, or t
tcagcgtgtctctacacgaccggtgctcgatttagacgcgatcgaagggtttggggcccccagggcagagggtcaccatctcctgcactgggaacgcctccaacatcgggactttttatgatgcacactggtaccagcgccttccaggaacacgcccccaccctcctcattcataataataacattcggccctcaggggtccctgaccgcttctctggctccaagtctgctcctcagcctcctgccatcacgtgggctccaggctgacgatgagggtnaattattacgtcgcctagtcaatatgacgagcagtccctggacgtttcgtttggggtcgttcgggacgggtacgggaaccaaggtcctacggacccgttccgtaacggtccgaaccggaccccgtaaaggtccgtacccggtcccccttggggttacccacgttcccgttcccgtttacccccgccccgttacctacgttacggaacgaccgaaccgtcgtaggacgggcgggtcgtcgggacggaaacggcggtacctaagtacgcgcngnnnngnnnngnnnnnnnnnnnnnnnnnnnnn

SEQ ID NO: 131310 - DNA, 464 bp, Homo sapiens
  misc_feature: GYAE6OF02FWRU6.7.27.C05.1.454.CMB.1.raw
  modified_base (448)..(448): a, c, t, g, unknown or other
  misc_feature (448)..(448): n is a, c, g, or t
  modified_base (450)..(464): a, c, t, g, unknown or other
  misc_feature (450)..(464): n is a, c, g, or t
tcagcgtgtctctacacgaccggtgctcgatttagacgcgatcgaagggtttggggccccagggcagagggtcaccatctcctgcactgggaacgcctccaacatcgggactttttatgatgcacactggtaccagcgccttccaggaacagcccccacctcctcattcataataataacattcggccctcaggggtccctgaccgcttctctggctccaagtctggctcctcagcctccctggccatcactggctccaggctgacgatggaggtgaatattactgccagtccatatgacagcagcctgcgttcgtttgggtgttcgggcggtgggaccaagctcggacccgtctacgtcacggcccaaggctcgccccctcggtcacgttctccgttccccgccctcctctacgacgacacgctgacgcgggctcggcaggcacgangnnnnnnnnnnnnnnn

SEQ ID NO: 131311 - DNA, 487 bp, Homo sapiens
  misc_feature: GYAE6OF02FVGXU.7.27.C05.1.454.CMB.1.raw
  modified_base (119)..(119): a, c, t, g, unknown or other
  misc_feature (119)..(119): n is a, c, g, or t
  modified_base (235)..(235): a, c, t, g, unknown or other
  misc_feature (235)..(235): n is a, c, g, or t
  modified_base (362)..(362): a, c, t, g, unknown or other
  misc_feature (362)..(362): n is a, c, g, or t
  modified_base (450)..(450): a, c, t, g, unknown or other
  misc_feature (450)..(450): n is a, c, g, or t
  modified_base (453)..(454): a, c, t, g, unknown or other
  misc_feature (453)..(454): n is a, c, g, or t
  modified_base (456)..(457): a, c, t, g, unknown or other
  misc_feature (456)..(457): n is a, c, g, or t
  modified_base (459)..(459): a, c, t, g, unknown or other
  misc_feature (459)..(459): n is a, c, g, or t
  modified_base (464)..(475): a, c, t, g, unknown or other
  misc_feature (464)..(475): n is a, c, g, or t
  modified_base (477)..(487): a, c, t, g, unknown or other
  misc_feature (477)..(487): n is a, c, g, or t
tcagcgtgtctctacacgaccggtgctcgatttagacgcgatcgaagggtttggggccccagggcagagggtcaccatctcctgcactgggaacgcctccaacatcgggacttttttangatgcacactggtaccagcgccttcaggaacagcccccaccctcctcattcataataataacattcggccctcaggggtcccctgaccgcttctctggctccaagtctggctcctnagcctccctggccatcactgggcctcaggctgacgatgagggtgaattattactgccagttcatatgacaggcagcctgccggttctttgggtcgttcggcggaggaccaagctcgacctcgtacgnacgccaaggctcgcccctggtccacgttcgtcgttccccgcctcctcgtagacgactacgctgacggcgggctggacaggtcgcagtncgnngnngntgctnnnnnnnnnnnncnnnnnnnnnnn

SEQ ID NO: 131312 - DNA, 552 bp, Homo sapiens
  misc_feature: GYAE6OF02F32CL.7.27.C05.1.454.CMB.1.raw
  modified_base (192)..(192): a, c, t, g, unknown or other
  misc_feature (192)..(192): n is a, c, g, or t
  modified_base (212)..(212): a, c, t, g, unknown or other
  misc_feature (212)..(212): n is a, c, g, or t
  modified_base (234)..(234): a, c, t, g, unknown or other
  misc_feature (234)..(234): n is a, c, g, or t
  modified_base (282)..(282): a, c, t, g, unknown or other
  misc_feature (282)..(282): n is a, c, g, or t
  modified_base (511)..(511): a, c, t, g, unknown or other
  misc_feature (511)..(511): n is a, c, g, or t
  modified_base (525)..(525): a, c, t, g, unknown or other
  misc_feature (525)..(525): n is a, c, g, or t
  modified_base (529)..(537): a, c, t, g, unknown or other
  misc_feature (529)..(537): n is a, c, g, or t
  modified_base (539)..(552): a, c, t, g, unknown or other
  misc_feature (539)..(552): n is a, c, g, or t
tcagcgtgtctctacacgaccggtgctcgatttagacgcgatcgaagggtttggggccccagggcagagggtcaccatctcctgcactgggaacgcctccaacatcgggactttttatgatgcacactggtaccagcgccttccaggaacagcccccaccctcctcattcataataataacattcggccctnaggggtccctgaccgcttcnctggctccaagtctggctcctnagcctccctggccatcacgtgggcctccgaggctgacgatggagggtnaattattactgcctagtcatatgactagcaggcctggcgttgtttgggtgttcgggacggagggaccaaggctacgtcccgttactacggtcacggacccgaaggccttaccggcccccgtggtccaccttccgttccgtttcccccgcccttcccgtacgtacgacgtaccgcgtcgtacggacggccgggtccgagggacccgaagggcccgttacgaacgttacgntacgctagcacgtncgtnnnnnnnnngnnnnnnnnnnnnnn

SEQ ID NO: 131313 - DNA, 704 bp, Homo sapiens
  misc_feature: GYAE6OF02F5LYU.7.27.C05.1.454.CMB.1.raw
  modified_base (288)..(288): a, c, t, g, unknown or other
  misc_feature (288)..(288): n is a, c, g, or t
  modified_base (343)..(343): a, c, t, g, unknown or other
  misc_feature (343)..(343): n is a, c, g, or t
  modified_base (629)..(629): a, c, t, g, unknown or other
  misc_feature (629)..(629): n is a, c, g, or t
  modified_base (634)..(634): a, c, t, g, unknown or other
  misc_feature (634)..(634): n is a, c, g, or t
  modified_base (642)..(642): a, c, t, g, unknown or other
  misc_feature (642)..(642): n is a, c, g, or t
  modified_base (644)..(644): a, c, t, g, unknown or other
  misc_feature (644)..(644): n is a, c, g, or t
  modified_base (653)..(653): a, c, t, g, unknown or other
  misc_feature (653)..(653): n is a, c, g, or t
tcagcgtgtctctacacgaccggtgctcgatttagacgcgatcgaagggtttggggccccagggcagagggtcaccatctcctgcactgggaacgcctccaacatcgggactttttatgatgcacactggtaccagcgccttccaggaacagcccccacctcctcattcataataataacattcgccctcaggggtccctgaccgcttctcctggctccaagtctggctccgtcacgccctcctggccatccacgtgggacctccgaggctgaacgtatggagggtanaattacgttactggacctaagtcctaagtatacgacgaaggtcaacggttcccgnggttaccggtttcggtttttaggggtcgggtttacccgggaccgggggtaacgggaaacccaagggtcccgtacgggtaacccccgtttacgtaccgggttacgacccggaaccccgtaagggtaccgtccccggaccccccgttaggggttaccctaacccgttcctttacccggtttacccccctacccctaccctttacgaaacggtaacgaccgtaccgtcgttacggaacgggtccggggtacgtacggacggtaaacggcgtaccaagttacgatgacgnacgangagcgtancncacgagtanagacgtcgagacgtagtacgtacgtacgtacgacgactgacgactacgtcg

SEQ ID NO: 131314 - DNA, 571 bp, Homo sapiens
  misc_feature: GYAE6OF02HPHA1.7.27.C05.1.454.CMB.1.raw
  modified_base (285)..(285): a, c, t, g, unknown or other
  misc_feature (285)..(285): n is a, c, g, or t
  modified_base (294)..(294): a, c, t, g, unknown or other
  misc_feature (294)..(294): n is a, c, g, or t
  modified_base (527)..(527): a, c, t, g, unknown or other
  misc_feature (527)..(527): n is a, c, g, or t
  modified_base (531)..(531): a, c, t, g, unknown or other
  misc_feature (531)..(531): n is a, c, g, or t
  modified_base (536)..(536): a, c, t, g, unknown or other
  misc_feature (536)..(536): n is a, c, g, or t
  modified_base (543)..(543): a, c, t, g, unknown or other
  misc_feature (543)..(543): n is a, c, g, or t
  modified_base (547)..(548): a, c, t, g, unknown or other
  misc_feature (547)..(548): n is a, c, g, or t
  modified_base (550)..(555): a, c, t, g, unknown or other
  misc_feature (550)..(555): n is a, c, g, or t
  modified_base (557)..(563): a, c, t, g, unknown or other
  misc_feature (557)..(563): n is a, c, g, or t
  modified_base (565)..(569): a, c, t, g, unknown or other
  misc_feature (565)..(569): n is a, c, g, or t
  modified_base (571)..(571): a, c, t, g, unknown or other
  misc_feature (571)..(571): n is a, c, g, or t
tcagcgtgtctctacacgaccggtgctcgatttagacgcgatcgaagggtttggggcccccagggcagagggtcaccatctcctgcactgggaacgcctccaacatcgggactttttatgatgcacactggtaccagcgccttccaggaacacgcccccacctcctcattcataataataacattcggccctcgaggggtccctgaccgcttctctggctccaagtctggctcctcacgccctccctggccatcacgtcggcctccgagctgacgatggagggtnaatattacngccagtcaatatgacagcacgcctgcgttcgtttggggtcgttcgggcgggacgggacccaaggtcgtacggtacccgtcctaacggtccacgtaccccgaaaggcctccgcccccgttcgtccaaccttcccgttccgttccccctaccctccctaccgttaacgaccgtaccaaccgtcgtacggacgggtccggggcgtaccgggacgtaacgggccgacgtacgtacgngtcncgagntcgacgncgcnncnnnnnngnnnnnnncnnnnngn

SEQ ID NO: 131315 - DNA, 517 bp, Homo sapiens
  misc_feature: GYAE6OF02G8SRX.7.27.C05.1.454.CMB.1.raw
  modified_base (285)..(285): a, c, t, g, unknown or other
  misc_feature (285)..(285): n is a, c, g, or t
  modified_base (294)..(294): a, c, t, g, unknown or other
  misc_feature (294)..(294): n is a, c, g, or t
  modified_base (481)..(481): a, c, t, g, unknown or other
  misc_feature (481)..(481): n is a, c, g, or t
  modified_base (490)..(497): a, c, t, g, unknown or other
  misc_feature (490)..(497): n is a, c, g, or t
  modified_base (499)..(501): a, c, t, g, unknown or other
  misc_feature (499)..(501): n is a, c, g, or t
  modified_base (503)..(512): a, c, t, g, unknown or other
  misc_feature (503)..(512): n is a, c, g, or t
  modified_base (515)..(517): a, c, t, g, unknown or other
  misc_feature (515)..(517): n is a, c, g, or t
tcagcgtgtctctacacgaccggtgctcgatttagacgcgatcgaagggtttggggccccagggcagagggtcaccatctcctgcatgggaacgcctccaacatcgggactttttatgatgcacactggtaccagcgccttccaggaacagcccccaccctcctcattcataataataacattccggccctcaggggtccctgaccgcttctctggctcaacgtctggcctcctcacgccctccctggccatcacgtgggcctccaggctgacgatggagggtanaatattacngccagtcatatgacagcagcctgcgttcggtttggtgtcggcggaggaccagcgtcgaccgttcacgtcagcccgaagcgtccgcccctcggtctacctccgtccgtttccccacccttccctacctaacggacgtaccgtccgtcttacggacggtcggtccgtcggtacgacggcgacgatagcnatcgcgtgnnnnnnnnannngnnnnnnnnnnctnnn

SEQ ID NO: 131316 - DNA, 493 bp, Homo sapiens
  misc_feature: GYAE6OF02G59I7.7.27.C05.1.454.CMB.1.raw
  modified_base (209)..(209): a, c, t, g, unknown or other
  misc_feature (209)..(209): n is a, c, g, or t
  modified_base (282)..(282): a, c, t, g, unknown or other
  misc_feature (282)..(282): n is a, c, g, or t
  modified_base (302)..(302): a, c, t, g, unknown or other
  misc_feature (302)..(302): n is a, c, g, or t
  modified_base (319)..(319): a, c, t, g, unknown or other
  misc_feature (319)..(319): n is a, c, g, or t
  modified_base (333)..(333): a, c, t, g, unknown or other
  misc_feature (333)..(333): n is a, c, g, or t
  modified_base (462)..(463): a, c, t, g, unknown or other
  misc_feature (462)..(463): n is a, c, g, or t
  modified_base (466)..(493): a, c, t, g, unknown or other
  misc_feature (466)..(493): n is a, c, g, or t
tcagcgtgtctctacacgaccggtgctcgatttagacgcgatcgaagggtttggggccccagggcagagggtcaccatctcctgcactgggaacgcctccaacatcgggacttttttatgatgcacactggtaccagcgccttccaggaacagcccccaccctcctcattcataataataacattcggccctcaggggtccctgaccgnttctctggcctccaagtctggctcctcagccctccctggccatcactgggctccaggctgacgatggagggtnaatattactgccagtcatangacagcagcctgcgttntttgggtgttcggnggacgggacagcctgaccgtcctacgtcacgccaaggctcgcccctgcactccttcgtccccaccctctacgtagacaccacgcgtgacggccgggtacgtcgggaccgaacgggccgtacgagtacgnngcnnnnnnnnnnnnnnnnnnnnnnnnnnnn

SEQ ID NO: 131317 - DNA, 529 bp, Homo sapiens
  misc_feature: GYAE6OF02H619K.7.27.C05.1.454.CMB.1.raw
  modified_base (196)..(196): a, c, t, g, unknown or other
  misc_feature (196)..(196): n is a, c, g, or t
  modified_base (238)..(238): a, c, t, g, unknown or other
  misc_feature (238)..(238): n is a, c, g, or t
  modified_base (496)..(496): a, c, t, g, unknown or other
  misc_feature (496)..(496): n is a, c, g, or t
  modified_base (498)..(499): a, c, t, g, unknown or other
  misc_feature (498)..(499): n is a, c, g, or t
  modified_base (501)..(501): a, c, t, g, unknown or other
  misc_feature (501)..(501): n is a, c, g, or t
  modified_base (503)..(503): a, c, t, g, unknown or other
  misc_feature (503)..(503): n is a, c, g, or t
  modified_base (506)..(529): a, c, t, g, unknown or other
  misc_feature (506)..(529): n is a, c, g, or t
tcagcgtgtctctacacgaccggtgctcgatttagacgcgatcgaagggtttggggcccccagggcagagggtcaccatctcctgcactgggaacgcctccaacatcgggacttttttatgatgcacactggtaccagcgccttccaggaacacgccccccaccctcctcattcataataataacattcggccctnaggggtccctgaccgtcttctctggctccagtctggctctcncgtcctcctggccatcatgggcctccaggctgacgatggagggtgaatattactgcctagtcatatgacagcagcctgtcgttcgtttggggtcgttcgggcgggtaggaccaagtcgtacggtacccgtccgtacgtcacgcccgaaggcctaccgtcccccgtggtccaccgttccgtccgtttaccccctacctcctaccgtacgacgactacgtacgtgacggtcgggcggtacggtcggaccgacgcagagtngnngntncgnnnnnnnnnnnnnnnnnnnnnnnn

SEQ ID NO: 131318 - DNA, 539 bp, Homo sapiens
  misc_feature: GYAE6OF02GR2BQ.7.27.C05.1.454.CMB.1.raw
  modified_base (288)..(288): a, c, t, g, unknown or other
  misc_feature (288)..(288): n is a, c, g, or t
  modified_base (509)..(539): a, c, t, g, unknown or other
  misc_feature (509)..(539): n is a, c, g, or t
tcagcgtgtctctacacgaccggtgctcgatttagacgcgatcgaagggtttggggcccccagggcagagggtcaccatctcctgcactgggaacgcctccaacatcgggactttttatgatgcacactggtaccagcgccttccaggaacagcccccaccctcctcattcataataataacatttcggccctcaggggtccctgaccgcttctctggctccaagtcctggctcctcacgccctcccgtggccatccacgtgggctccaggctgaccgatggagggtnaatattactgccagtcatatgacagcagcctgcgtcgttttggggtcgtttcgggcgggacgggaccgaaaggtctcggacccgttccttaaccggtcacgacccgaaggcctacgtccccccgtggtccaccttcctccgttcccctaccccgttcctcctaggacgacaccgcctcgggacggccgggcgtacgggacgaacgggccgactaagagtgnnnnnnnnnnnnnnnnnnnnnnnnnnnnnnn

SEQ ID NO: 131319 - DNA, 460 bp, Homo sapiens
  misc_feature: GYAE6OF02JEXV3.7.27.C05.1.454.CMB.1.raw
  modified_base (271)..(271): a, c, t, g, unknown or other
  misc_feature (271)..(271): n is a, c, g, or t
  modified_base (279)..(279): a, c, t, g, unknown or other
  misc_feature (279)..(279): n is a, c, g, or t
  modified_base (299)..(299): a, c, t, g, unknown or other
  misc_feature (299)..(299): n is a, c, g, or t
  modified_base (304)..(304): a, c, t, g, unknown or other
  misc_feature (304)..(304): n is a, c, g, or t
  modified_base (391)..(391): a, c, t, g, unknown or other
  misc_feature (391)..(391): n is a, c, g, or t
  modified_base (404)..(404): a, c, t, g, unknown or other
  misc_feature (404)..(404): n is a, c, g, or t
  modified_base (419)..(419): a, c, t, g, unknown or other
  misc_feature (419)..(419): n is a, c, g, or t
  modified_base (433)..(433): a, c, t, g, unknown or other
  misc_feature (433)..(433): n is a, c, g, or t
  modified_base (448)..(460): a, c, t, g, unknown or other
  misc_feature (448)..(460): n is a, c, g, or t
tcagcgtgtctctacacgaccggtgctcgatttagacgcgatcgaagggtttgggggccccagggcagagggtcaccatctcctgcactgggaacgcctccaacatcgggactttttatgatgcacactggtaccagcgccttccagggaacagcccccaccctcctcattcataataataacattcggccctcaggggtccctgaccgcttctctggctccaagtctggctcctcagcctccctggccatcactgggctcaggctgacgntgagggtnaatattactgccagtcatangaacngcagtccgtgcgttcgtttgggtgttcgggcgggtagggaccaagctcggaccgtctacgtcacggcccaaggcctcgcccctgtcnctctccgttcccnccctctctagcgacngctggacgcgggcnggacgaggctcatgnnnnnnnnnnnnn

SEQ ID NO: 131320 - DNA, 582 bp, Homo sapiens
  misc_feature: GYAE6OF02IJGB8.7.27.C05.1.454.CMB.1.raw
  modified_base (118)..(118): a, c, t, g, unknown or other
  misc_feature (118)..(118): n is a, c, g, or t
  modified_base (300)..(300): a, c, t, g, unknown or other
  misc_feature (300)..(300): n is a, c, g, or t
  modified_base (327)..(327): a, c, t, g, unknown or other
  misc_feature (327)..(327): n is a, c, g, or t
  modified_base (473)..(473): a, c, t, g, unknown or other
  misc_feature (473)..(473): n is a, c, g, or t
  modified_base (554)..(555): a, c, t, g, unknown or other
  misc_feature (554)..(555): n is a, c, g, or t
  modified_base (557)..(582): a, c, t, g, unknown or other
  misc_feature (557)..(582): n is a, c, g, or t
tcagcgtgtctctacacgaccggtgctcgatttagacgcgatcgaagggtttggggccccagggcagagggtcaccatctcctgcactgggaacgcctccaacatcgggactttttangatgcacactggtaccagcgcccttccaggaacacgcccccaccctcctcattcataataataacatttcggccctcaggggttcccctgaccgctttctcgtggctccaagtcctggcctccgtcacgccctcccgtggccatccacgtgggcctccgaggtctagacgtatggacgggtnaaacttattactcgcagtcatatgacngcacgccgttgtcggttggtttgggtcggttccgggacgggtacgggaacctaggtccgtacggtacccgttccgtaacgtccgaccggacccgaacggtcccgtccgtcccccgttgtccctacgttcccgttccgttacccccncccttccgtacgtaacgacgacccgtcgtacgtcgacggggtccggtcgacggtaccggacggtccactacgagcagtgcnncnnnnnnnnnnnnnnnnnnnnnnnnnn

SEQ ID NO: 131321 - DNA, 608 bp, Homo sapiens
  misc_feature: GYAE6OF02HO0ID.7.27.C05.1.454.CMB.1.raw
  modified_base (573)..(574): a, c, t, g, unknown or other
  misc_feature (573)..(574): n is a, c, g, or t
  modified_base (577)..(577): a, c, t, g, unknown or other
  misc_feature (577)..(577): n is a, c, g, or t
  modified_base (582)..(583): a, c, t, g, unknown or other
  misc_feature (582)..(583): n is a, c, g, or t
  modified_base (585)..(589): a, c, t, g, unknown or other
  misc_feature (585)..(589): n is a, c, g, or t
  modified_base (591)..(608): a, c, t, g, unknown or other
  misc_feature (591)..(608): n is a, c, g, or t
tcagcgtgtctctacacgaccggtgctcgatttagacgcgatcgaagggtttggggcccccagggcagagggtcaccatctcctgcactgggaacgcctccaacatcgggacttttttatgatgcacactggtaccagcgccttccaggaacacgcccccaccctcctcattcataataataacattcggccctcgacggggtccctgaccgctttctcgtcggctccaaggtctggctcctcagcccttcccgtggccatcacgtcgggctccgaggtctaggacgatggacgggtgaattattactgacctaggtctaatatcgacagccagcctgtcgttcgttttgggtcgtttcgggagggtaacggacccgtaagcgtacggaccgttccgtaccgtcgacggtacccgaaggtccgtaccggtcccccctcgggtacctaccggtttcccttccgggttttccccccgtcccgtttaccccgttccgtaaccggtaaccgaaccctacccgggacgttcggacgggtaccggggccgttacgggaccgacgggtccgacgatacgnngantcagnngnnnnncnnnnnnnnnnnnnnnnnn

SEQ ID NO: 131322 - DNA, 561 bp, Homo sapiens
  misc_feature: GYAE6OF02H8T9Q.7.27.C05.1.454.CMB.1.raw
  modified_base (346)..(346): a, c, t, g, unknown or other
  misc_feature (346)..(346): n is a, c, g, or t
  modified_base (359)..(359): a, c, t, g, unknown or other
  misc_feature (359)..(359): n is a, c, g, or t
  modified_base (400)..(400): a, c, t, g, unknown or other
  misc_feature (400)..(400): n is a, c, g, or t
  modified_base (508)..(508): a, c, t, g, unknown or other
  misc_feature (508)..(508): n is a, c, g, or t
  modified_base (532)..(532): a, c, t, g, unknown or other
  misc_feature (532)..(532): n is a, c, g, or t
  modified_base (534)..(561): a, c, t, g, unknown or other
  misc_feature (534)..(561): n is a, c, g, or t
tcagcgtgtctctacacgaccggtgctcgatttagacgcgatcgaagggtttggggcccccagggcagagggtcaccatctcctgcactgggaacgcctccaacagtcgggacttttttatgatgcacactggtaccagcgccttccaggaacacgcccccaccctcctcattcaataataataacattcggccctacgacggggtccctgaccgcttctcgtcggctaccaagtctggcctcctcaagtccctcctgccatcagtcggcttaccgcgctacgacgtaagtggaggggttagtaaattacgttaacgttcggaccttacggtacattacgtagaanacggacacgtccncggttcgttcgtttcgggtgtacgggcgggaaggaccgaancgtacggacccttcgtacgtcgaccgaccgaagtccgtcccggtccccttacggtcaaccgttccttccgtcccccggtacctcccgttagtaccgacgacctccggngtcggcgcggcgagacgacgcganannnnnnnnnnnnnnnnnnnnnnnnnnnn

SEQ ID NO: 131323 - DNA, 636 bp, Homo sapiens
  misc_feature: GYAE6OF02IN1OW.7.27.C05.1.454.CMB.1.raw
  modified_base (187)..(187): a, c, t, g, unknown or other
  misc_feature (187)..(187): n is a, c, g, or t
  modified_base (597)..(597): a, c, t, g, unknown or other
  misc_feature (597)..(597): n is a, c, g, or t
  modified_base (600)..(605): a, c, t, g, unknown or other
  misc_feature (600)..(605): n is a, c, g, or t
  modified_base (607)..(607): a, c, t, g, unknown or other
  misc_feature (607)..(607): n is a, c, g, or t
  modified_base (611)..(611): a, c, t, g, unknown or other
  misc_feature (611)..(611): n is a, c, g, or t
  modified_base (615)..(620): a, c, t, g, unknown or other
  misc_feature (615)..(620): n is a, c, g, or t
  modified_base (622)..(624): a, c, t, g, unknown or other
  misc_feature (622)..(624): n is a, c, g, or t
  modified_base (626)..(629): a, c, t, g, unknown or other
  misc_feature (626)..(629): n is a, c, g, or t
  modified_base (631)..(636): a, c, t, g, unknown or other
  misc_feature (631)..(636): n is a, c, g, or t
tcagcgtgtctctacacgaccggtgctcgatttagacgcgatcgaagggtttggggcccccagggcagagggtcaccatctcctgcactgggaacgcctccaacatcgggacttttttagatgcacacgtcggtacagcgccttccgaagacaccgcccccacctccactattcataataataaacncgtttccggccctcgtacggggttcccctcggacccgcttacctcgtcggcctacctaacggtcttcggccttacctcgcgtcccctccgtggacctactcaccgtcggcttacgacgcgtacgtacggagtacggaggtagaattaagttctcgacgtagtccaattacgtacggaactacggtcggacttctagttccggtttcgttttcgggggtaccgttgggggtaccgggaacgggtaacccacggtccgtcggaacccgttcccgttagaccccgacggtacccgaggaccctccggtccccccttggaccctaccgtttccctacccgtccccctacctcccgtactacggaactcacgtcgtcggaacgggtgccggtacgacggacgcgtacagtaccgnacnnnnnncnctcncgcnnnnnngnnncnnnncnnnnnn

SEQ ID NO: 131324 - DNA, 740 bp, Homo sapiens
  misc_feature: GYAE6OF02JEETN.7.27.C05.1.454.CMB.1.raw
  modified_base (306)..(306): a, c, t, g, unknown or other
  misc_feature (306)..(306): n is a, c, g, or t
  modified_base (676)..(676): a, c, t, g, unknown or other
  misc_feature (676)..(676): n is a, c, g, or t
  modified_base (683)..(683): a, c, t, g, unknown or other
  misc_feature (683)..(683): n is a, c, g, or t
  modified_base (690)..(690): a, c, t, g, unknown or other
  misc_feature (690)..(690): n is a, c, g, or t
  modified_base (696)..(696): a, c, t, g, unknown or other
  misc_feature (696)..(696): n is a, c, g, or t
  modified_base (700)..(700): a, c, t, g, unknown or other
  misc_feature (700)..(700): n is a, c, g, or t
  modified_base (726)..(726): a, c, t, g, unknown or other
  misc_feature (726)..(726): n is a, c, g, or t
tcagcgtgtctctacacgaccggtgctcgatttagacgcgatcgaagggtttggggcccagggcagagggtcaccatctcctgcactgggaacgcctccaacatcgggactttttatgatgcacactggtaccagcgccttccgaggaacagccccacctctcagttcataataataacattcggaccttgacggggtccctgaccgcttctctaggctacctaagtcgtcggtctcctcagcctcccgtggccatccagtggctccgagctgaccgtagtcggaggtagtaacttactttaccgnggtacccacgggttactaaccttagtacgggtaacccaaggtcctaacggtcccgttcggtaccgtttcgggttttaccgggggttcggtttaccggggacgggtaaaccgggtaaccccgtaagggttcctaacgggtaccccgtttccggttaaccgggtactaaccgggtaccccgaaagggtccccttaacccgggccccccgttaacgggtttccttaaaccgtttcccggttacccccggtcccttaccgttacgttaaacggccggtaaaccgtaaccggtctacggggtaaaccggtccgggtacctagggtaccaaacggggttccgaacgtaactaggatcgactcggtatacggctcgntaacgcngtaaacngtaacngtcngtcgctctactactcgacgtacgacncgtcgctacgtagc

SEQ ID NO: 131325 - DNA, 769 bp, Homo sapiens
  misc_feature: GYAE6OF02I6VAV.7.27.C05.1.454.CMB.1.raw
  modified_base (117)..(117): a, c, t, g, unknown or other
  misc_feature (117)..(117): n is a, c, g, or t
  modified_base (152)..(152): a, c, t, g, unknown or other
  misc_feature (152)..(152): n is a, c, g, or t
  modified_base (724)..(724): a, c, t, g, unknown or other
  misc_feature (724)..(724): n is a, c, g, or t
  modified_base (732)..(732): a, c, t, g, unknown or other
  misc_feature (732)..(732): n is a, c, g, or t
  modified_base (737)..(737): a, c, t, g, unknown or other
  misc_feature (737)..(737): n is a, c, g, or t
  modified_base (739)..(739): a, c, t, g, unknown or other
  misc_feature (739)..(739): n is a, c, g, or t
  modified_base (741)..(741): a, c, t, g, unknown or other
  misc_feature (741)..(741): n is a, c, g, or t
  modified_base (747)..(751): a, c, t, g, unknown or other
  misc_feature (747)..(751): n is a, c, g, or t
  modified_base (753)..(753): a, c, t, g, unknown or other
  misc_feature (753)..(753): n is a, c, g, or t
  modified_base (758)..(759): a, c, t, g, unknown or other
  misc_feature (758)..(759): n is a, c, g, or t
  modified_base (761)..(761): a, c, t, g, unknown or other
  misc_feature (761)..(761): n is a, c, g, or t
  modified_base (763)..(764): a, c, t, g, unknown or other
  misc_feature (763)..(764): n is a, c, g, or t
  modified_base (767)..(767): a, c, t, g, unknown or other
  misc_feature (767)..(767): n is a, c, g, or t
  modified_base (769)..(769): a, c, t, g, unknown or other
  misc_feature (769)..(769): n is a, c, g, or t
tcagcgtgtctctacacgaccggtgctcgatttagacgcgatcgaagggtttggggccccagggcagagggtcaccatctcctgcatgggaacgcctccaacatcgggactttttangatgcacactggtaccagcgtcccttcgaggaacncgcccccaccctcctcattcaataataaataacattcggccctgacggggtcctggaccgtcttctcctggcctacctacgtctggactcctacagtccctccgtcggccaatccgacgtgggcctaccgaggccgtaggacctaagcggtaagggtcggtaaacttaattacgtcggtccgtaagtactaacttaactagaacgacgaaccacggtccgtaggttccgtttcgggtttttaggggttcgggttacccgggaacgggggtaacggtaacccgtaaacggctcccggtaacggtttccccgtaaccgttacggaccccgtaacggtaaaccgggtcttaccccgggtccccccgttaaggtacccgtaccgtttaccgttaccccgttttaacccccgtccccgtttaccccggtttaaccgtaacccggtaaaccccggtaacccggttaaacccgggttaacccgttcggggaaacccggggcccggggtttacccggggacccgggaacccggttaaacggggaccggttaaccgtaggttaagccgtgtacgctacggntccgagtntacgntnangagtcnnnnncngcgtnncntnncgngn

SEQ ID NO: 131326 - DNA, 703 bp, Homo sapiens
  misc_feature: GYAE6OF02I1GRH.7.27.C05.1.454.CMB.1.raw
  modified_base (120)..(120): a, c, t, g, unknown or other
  misc_feature (120)..(120): n is a, c, g, or t
  modified_base (139)..(139): a, c, t, g, unknown or other
  misc_feature (139)..(139): n is a, c, g, or t
  modified_base (194)..(194): a, c, t, g, unknown or other
  misc_feature (194)..(194): n is a, c, g, or t
  modified_base (645)..(645): a, c, t, g, unknown or other
  misc_feature (645)..(645): n is a, c, g, or t
  modified_base (652)..(652): a, c, t, g, unknown or other
  misc_feature (652)..(652): n is a, c, g, or t
  modified_base (674)..(674): a, c, t, g, unknown or other
  misc_feature (674)..(674): n is a, c, g, or t
tcagcgtgtctctacacgaccggtgctcgatttagacgcgatcgaagggtttggggccccagggcagagggtcaccatctcctgcactgggaaccgcctccgaacatcgggactttttangatgccaccactggtaccngcgccttcaaggaccagtccccccgaccttcctctacttacaactaataataacngttccggcccttacgacgggttccctacgccgtcttcgcgttcggtacctaccgtaaagtccgtagggcccttacctcctacggtcccttcccgtcggaccctacgtaccgtaccggttcgggacccttccggaaggtcctacggtaaccgagttcgggtaacggtacgtaagttaccgttacgtcggaccgtaatcggaaacttgacgacctagttccgacgtccgtggtccggtttcgttcggggtccgttcgggaccggtaacgggtacacggttacgtccggttaacttcccgtacgttaccgacgaccgttaggcccgtaccgtcccgtaggtccaccgttcgtacctcccgtactccgtacgacgtcgacgcgacgtcggcggtacccggtagtccgacggtacgtacctagtactaggccttgacgtctagcgactagctacgntaacgtntcgacgtgacgagcctgtacgngtacgtagactacactacgtcgtctgacg

SEQ ID NO: 131327 - DNA, 210 bp, Homo sapiens
  misc_feature: GYAE6OF01BM44C.49.12.B01.1.454.CMB.1.raw
  modified_base (210)..(210): a, c, t, g, unknown or other
  misc_feature (210)..(210): n is a, c, g, or t
tcagagtcgagagacacgaccggtgctcgatttagtagtgtagattccgcgggcacgaccggtgctcgatttagagagagtgtgttgggtttggggaagaggaagactgacggtccccaggagttcaggtgctgggcacagcggccctgggctgcctggtcaaggactacttcctctctcgactctgagcgggctggcaaggcgcatagn

SEQ ID NO: 131328 - DNA, 176 bp, Homo sapiens
  misc_feature: GYAE6OF01DY23R.49.12.B01.1.454.CMB.1.raw
  modified_base (165)..(176): a, c, t, g, unknown or other
  misc_feature (165)..(176): n is a, c, g, or t
tcagagtcgagagacacgaccggtgctcgatttagtagtgtagattccgcgggcacgaccggtgctcgatttagtcacgcgagaaagggaaaggggctggccctgacgtgttctgttcccaccctcctctctctcgactctgagcgggctggcaaggcgcatagnnnnnnnnnnnn

SEQ ID NO: 131329 - DNA, 162 bp, Homo sapiens
  misc_feature: GYAE6OF01C8X2U.49.12.B01.1.454.CMB.1.raw
  modified_base (162)..(162): a, c, t, g, unknown or other
  misc_feature (162)..(162): n is a, c, g, or t
tcagagtcgagagacacgaccggtgctcgatttagtagtgtagattccgcgggcacgaccggtgctcgatttagtcacgcgagaagggaagggctggccctgacgtgttctgttcccgccctcctctctctcgactctgagcgggctggcaaggcgcatagn

SEQ ID NO: 131330 - DNA, 164 bp, Homo sapiens
  misc_feature: GYAE6OF01BHF12.49.12.B01.1.454.CMB.1.raw
  modified_base (164)..(164): a, c, t, g, unknown or other
  misc_feature (164)..(164): n is a, c, g, or t
tcagagtcgagagacacgaccggtgctcgatttagtagtgtagattccgcgggcacgaccggtgctcgatttagtcacgcgagaaagggaaaggggctggccctgacgtgttctgttcccacctcctctctctcgactctgagcgggctggcaaggcgcatagn

SEQ ID NO: 131331 - DNA, 167 bp, Homo sapiens
  misc_feature: GYAE6OF01DIAT9.49.12.B01.1.454.CMB.1.raw
  modified_base (167)..(167): a, c, t, g, unknown or other
  misc_feature (167)..(167): n is a, c, g, or t
tcagagtcgagagacacgaccggtgctcgatttagtagtgtagattccgcgggcacgaccggtgctcgatttagtcacgcgagaaagggaaagggggctggccctgacgtgtttctgttcccaccctcctctctctcgactctgagcgggctggcaaggcgcatagn

SEQ ID NO: 131332 - DNA, 253 bp, Homo sapiens
  misc_feature: GYAE6OF01BS71G.49.12.B01.1.454.CMB.1.raw
  modified_base (252)..(253): a, c, t, g, unknown or other
  misc_feature (252)..(253): n is a, c, g, or t
tcagagtcgagagacacgaccggtgctcgatttagtagtgtagattccgcgggcacgaccggtgctcgatttagtagtgtagattccgcgggcgacgaccggtgctcgatttagagagagtgtgttgggtttgggggaagaggaagactgacggtcccccaggagttcaggtgctgggcacagcggccctgggctgcctggtcaaggactacttcctctctcgactctgagcgggctggcaaggcgcatagnn

SEQ ID NO: 131333 - DNA, 172 bp, Homo sapiens
  misc_feature: GYAE6OF01BYW66.49.12.B01.1.454.CMB.1.raw
  modified_base (171)..(172): a, c, t, g, unknown or other
  misc_feature (171)..(172): n is a, c, g, or t
tcagagtcgagagacacgaccggtgctcgatttagtagtgtagattccgcgggcacgaccggtgctcgatttagtcacgcgagaaagggaaaggggctggccctgacgtgtttctgttcccaccctcctctctctcgactctgaggcgggcgtggacgaaggcgcaatagnn

SEQ ID NO: 131334 - DNA, 212 bp, Homo sapiens
  misc_feature: GYAE6OF01BHGH6.49.12.B01.1.454.CMB.1.raw
  modified_base (211)..(212): a, c, t, g, unknown or other
  misc_feature (211)..(212): n is a, c, g, or t
tcagagtcgagagacacgaccggtgctcgatttagtagtgtagattccgcgggcacgaccggtgctcgatttagagagagtgtgttgggtttggggaagaggaagactgacggtcccccaggagttcaggtgctgggcacagcggccctgggctgcctggtcaaggactacttcctctctcgactctgagcgggctggcaaggcgcatagnn

SEQ ID NO: 131335 - DNA, 211 bp, Homo sapiens
  misc_feature: GYAE6OF01CC03E.49.12.B01.1.454.CMB.1.raw
  modified_base (211)..(211): a, c, t, g, unknown or other
  misc_feature (211)..(211): n is a, c, g, or t
tcagagtcgagagacacgaccggtgctcgatttagtagtgtagattccgcgggcacgaccggtgctcgatttagagagagtgtgttgggtttggggaagaggaagactgacggtcccccaggagttcaggtgctgggcacagcggccctgggctgcctggtcaaggactacttcctctctcgactctgagcgggctggcaaggcgcatagn

SEQ ID NO: 131336 - DNA, 167 bp, Homo sapiens
  misc_feature: GYAE6OF01BDWDE.49.12.B01.1.454.CMB.1.raw
  modified_base (166)..(167): a, c, t, g, unknown or other
  misc_feature (166)..(167): n is a, c, g, or t
tcagagtcgagagacacgaccggtgctcgatttagtagtgtagattccgcgggcacgaccggtgctcgatttagtcacgcgagaaagggaaaggggctggccctgacgtgtttctgttcccgccctcctctctctcgactctgagcgggctggcaaggcgcatagnn

SEQ ID NO: 131337 - DNA, 211 bp, Homo sapiens; identical to SEQ ID NO: 131335
  misc_feature: GYAE6OF01DIEUY.49.12.B01.1.454.CMB.1.raw
  modified_base (211)..(211): a, c, t, g, unknown or other
  misc_feature (211)..(211): n is a, c, g, or t

SEQ ID NO: 131338 - DNA, 211 bp, Homo sapiens
  misc_feature: GYAE6OF01B5HK6.49.12.B01.1.454.CMB.1.raw
  modified_base (211)..(211): a, c, t, g, unknown or other
  misc_feature (211)..(211): n is a, c, g, or t
tcagagtcgagagacacgaccggtgctcgatttagtagtgtagattccgcgggcacgaccggtgctcgatttagagagagtgtgttgggtttgggggaagaggaagactgacggtcccccaggagttcaggtgctgggcacagcggcctgggctgcctggtcaaggactacttcctctctcgactctgagcgggctggcaaggcgcatagn

SEQ ID NO: 131339 - DNA, 255 bp, Homo sapiens
  misc_feature: GYAE6OF01CNKRI.49.12.B01.1.454.CMB.1.raw
  modified_base (253)..(255): a, c, t, g, unknown or other
  misc_feature (253)..(255): n is a, c, g, or t
tcagagtcgagagacacgaccggtgctcgatttagtagtgtagattccgcgggcacgaccggtgctcgatttagtagtgtagattccgcgggcgacgaccggtgctcgatttacgagagagtgtgttgggtttgggggaagaggaagactgacggtcccccaggagttcaggtgctgggcacagcggccctgggctgcctggtcaaggactacttcctctctcgactctgagcgggctggcaaggcgcatagnnn

SEQ ID NO: 131340 - DNA, 210 bp, Homo sapiens
  misc_feature: GYAE6OF01CEEGK.49.12.B01.1.454.CMB.1.raw
  modified_base (209)..(210): a, c, t, g, unknown or other
  misc_feature (209)..(210): n is a, c, g, or t
tcagagtcgagagacacgaccggtgctcgatttagtagtgtagattccgcgggcacgaccggtgctcgatttagagagagtgtgttgggtttggggaagaggaagactgacggtccccaggagttcaggtgctgggcacagcggcctgggctgcctggtcaaggactacttcctctctcgactctgagcgggctggcaaggcgcatagnn

SEQ ID NO: 131341 - DNA, 211 bp, Homo sapiens
  misc_feature: GYAE6OF01DM5Z7.49.12.B01.1.454.CMB.1.raw
  modified_base (211)..(211): a, c, t, g, unknown or other
  misc_feature (211)..(211): n is a, c, g, or t
tcagagtcgagagacacgaccggtgctcgatttagtagtgtagattccgcgggcacgaccggtgctcgatttagagagagtgtgttgggttggggaaggaggaagactgacggtcccccacggagttcaggtgctgggcacagcggccctgggctgcctggtcaagactacttcctctctcgactctgagcgggctggcaaggcgcatagn

SEQ ID NO: 131342 - DNA, 214 bp, Homo sapiens
  misc_feature: GYAE6OF01DR3ZU.49.12.B01.1.454.CMB.1.raw
  modified_base (213)..(214): a, c, t, g, unknown or other
  misc_feature (213)..(214): n is a, c, g, or t
tcagagtcgagagacacgaccggtgctcgatttagtagtgtagattccgcgggcacgaccggtgctcgatttagagagagtgtgttgggtttgggggaagaggaagactgaccggtcccccaggagttcaggtgctgggcacagcggccctgggctgcctggtcaaggactacttcctctctcgactctgagcgggctggcaaggcgcatagnn

SEQ ID NO: 131343 - DNA, 253 bp, Homo sapiens
  misc_feature: GYAE6OF01CCXCM.49.12.B01.1.454.CMB.1.raw
  modified_base (251)..(253): a, c, t, g, unknown or other
  misc_feature (251)..(253): n is a, c, g, or t
tcagagtcgagagacacgaccggtgctcgatttagtagtgtagattccgcgggcacgaccggtgctcgatttagtagtgtagattccgcgggcgacgaccggtgctcgatttagagagagtgtgttgggttgggggaagaggaagactgacggtcccccaggagttcaggtgctgggcacagcggccctgggctgcctggtcaaggactacttcctctctcgactctgagcgggctggcaaggcgcatagnnn

SEQ ID NO: 131344 - DNA, 276 bp, Homo sapiens
  misc_feature: GYAE6OF01C4YWV.49.12.B01.1.454.CMB.1.raw
  modified_base (272)..(276): a, c, t, g, unknown or other
  misc_feature (272)..(276): n is a, c, g, or t
tcagagtcgagagacacgaccggtgctcgatttagtagtgtagattccgcgggcacgaccggtgctcgatttagtagtgtagattccgcgggcacgaccggtgctcatttagtagtgtagattccgcgggcacgaccggtgctcgatttagtcacgcgagaaagggaaaggggtgctcgatttagtcacgcgagaaagggaaggtggccctgacgtgtttctgttcccacctcctctctctcgactctgagcgggctggcaaggcgcatagnnnnn

SEQ ID NO: 131345 - DNA, 166 bp, Homo sapiens
  misc_feature: GYAE6OF01A7FF5.49.12.B01.1.454.CMB.1.raw
  modified_base (166)..(166): a, c, t, g, unknown or other
  misc_feature (166)..(166): n is a, c, g, or t
tcagagtcgagagacacgaccggtgctcgatttagtagtgtagattccgcgggcacgaccggtgctcgatttagtcacgcgagaaagggaaaggggctggccctgacgtgtttctgttcccgccctcctctctctcgactctgagcgggctggcaaggcgcatagn

SEQ ID NO: 131346 - DNA, 221 bp, Homo sapiens
  misc_feature: GYAE6OF01BVABZ.49.12.B01.1.454.CMB.1.raw
  modified_base (212)..(221): a, c, t, g, unknown or other
  misc_feature (212)..(221): n is a, c, g, or t
tcagagtcgagagacacgaccggtgctcgatttagtagtgtagattccgcgggcgacgaccggtgctcgatttagagagagtgtgttgggtttgggggaagaggaagactgacggtccccccaggagttcaggtgctgggcacagcggcctggctgcctggtcaaggactacttcctctctcgactctgagcgggctggcaaggcgcatagnnnnnnnnnn

SEQ ID NO: 131347 - DNA, 172 bp, Homo sapiens
  misc_feature: GYAE6OF01CFWJ1.49.12.B01.1.454.CMB.1.raw
  modified_base (167)..(172): a, c, t, g, unknown or other
  misc_feature (167)..(172): n is a, c, g, or t
tcagagtcgagagacacgaccggtgctcgatttagtagtgtagattccgcgggcacgaccggtgctcgatttagtcacgcgagaaagggaaagggggctggccctgacgtgtttctgttcccaccctcctctctctcgactctgagcgggctggcaaggcgcatagnnnnnn

SEQ ID NO: 131348 - DNA, 212 bp, Homo sapiens
  misc_feature: GYAE6OF01BMJGD.49.12.B01.1.454.CMB.1.raw
  modified_base (212)..(212): a, c, t, g, unknown or other
  misc_feature (212)..(212): n is a, c, g, or t
tcagagtcgagagacacgaccggtgctcgatttagtagtgtagattccgcgggcacgaccggtgctcgatttagagagagtgtgttgggtttgggggaagaggaagactgacggtcccccaggagttcaggtgctgggcacagcggccctgggctgcctggtcaaggactacttcctctctcgactctgagcgggctggcaaggcgcatagn

SEQ ID NO: 131349 - DNA, 252 bp, Homo sapiens
  misc_feature: GYAE6OF01BFGYS.49.12.B01.1.454.CMB.1.raw
  modified_base (252)..(252): a, c, t, g, unknown or other
  misc_feature (252)..(252): n is a, c, g, or t
tcagagtcgagagacacgaccggtgctcgatttagtagtgtagattccgcgggcacgaccggtgctcgatttagtagtttagattccgcgggcacgaccggtgctcgatttagagagagtgtgttgggtttgggggaagaggaagactgacggtccccccaggagttcaggtgctgggcacagcggccctgggctgcctggtcaaggactacttcctctctcgactctgagcgggctggcaaggcgcatagn

SEQ ID NO: 131350 - DNA, 211 bp, Homo sapiens; identical to SEQ ID NO: 131335
  misc_feature: GYAE6OF01C65V6.49.12.B01.1.454.CMB.1.raw
  modified_base (211)..(211): a, c, t, g, unknown or other
  misc_feature (211)..(211): n is a, c, g, or t

SEQ ID NO: 131351 - DNA, 214 bp, Homo sapiens
  misc_feature: GYAE6OF01D0GLI.49.12.B01.1.454.CMB.1.raw
  modified_base (212)..(214): a, c, t, g, unknown or other
  misc_feature (212)..(214): n is a, c, g, or t
tcagagtcgagagacacgaccggtgctcgatttagtagtgtagattccgcgggcacgaccggtgctcgatttagagagagtgtgttgggtttgggggaagaggaagactgacggtcccccaggagttcaggtgctgggcacagcggccctgggctgcctggtcaaggactacttcctctctcgactctgagcgggctggcaaggcgcatagnnn

SEQ ID NO: 131352 - DNA, 318 bp, Homo sapiens
  misc_feature: GYAE6OF01A22OZ.49.12.B01.1.454.CMB.1.raw
  modified_base (268)..(269): a, c, t, g, unknown or other
  misc_feature (268)..(269): n is a, c, g, or t
  modified_base (271)..(318): a, c, t, g, unknown or other
  misc_feature (271)..(318): n is a, c, g, or t
tcagagtcgagagacacgaccggtgctcgatttagtagtgtagattccgtcggggtcggacgaccggtagctcgatttacgagtgtagattccgcgggcgacgaccggtgctcgagtttaccgagagagtgtgttgggtttgggggaacgaggaagactgacggtccccccaggacgttcaggtgcgtgggcacagcggccctgggctgccctggtcaaggactacttccctctctcgactctgagcgggctggcaaggcgacatagnngnnnnnnnnnnnnnnnnnnnnnnnnnnnnnnnnnnnnnnnnnnnnnnnn

SEQ ID NO: 131353 - DNA, 272 bp, Homo sapiens
  misc_feature: GYAE6OF01AO474.49.12.B01.1.454.CMB.1.raw
  modified_base (270)..(272): a, c, t, g, unknown or other
  misc_feature (270)..(272): n is a, c, g, or t
tcagagtcgagagacacgaccggtgctcgatttagtagtgtagattccgcgggcacgaccggtgctcgatttagtagtgtagattccgcgggcacgaccggtgctcatttagtagtgtagattccgcgggcacgaccggtgctcgatttagtcacgcgagaaaggaaggggtgctcgatttagtcacgcgagaaagggaaggtggccctgacgtgtttctgttcccgcctcctctctctcgactctgagcgggctggcaaggcgcatagnnn

SEQ ID NO: 131354 - DNA, 165 bp, Homo sapiens
  misc_feature: GYAE6OF01A3AN9.49.12.B01.1.454.CMB.1.raw
tcagagtcgagagacacgaccggtgctcgatttagtagtgtagattccgcgggcacgaccggtgctcgatttagtcacgcgagaaagggaaaggggctggccctgacgtgtttctgttcccgccctcctctctctcgactctgagcgggctggcaaggcgcatag

SEQ ID NO: 131355 - DNA, 205 bp, Homo sapiens
  misc_feature: GYAE6OF01E03S4.49.12.B01.1.454.CMB.1.raw
  modified_base (177)..(205): a, c, t, g, unknown or other
  misc_feature (177)..(205): n is a, c, g, or t
tcagagtcgagagacacgaccggtgctcgatttagtagtgtagattaccggcgggcgacgaccggtgctcgatttagatcgtctgtgttgggtttgggcagcctaaggctgccccagcgtcactctgttcccgccctcctctctctcgactctgagcgggctggcaaggcgcatagnnnnnnnnnnnnnnnnnnnnnnnnnnnnn

SEQ ID NO: 131356 - DNA, 214 bp, Homo sapiens; identical to SEQ ID NO: 131351
  misc_feature: GYAE6OF01BN6EY.49.12.B01.1.454.CMB.1.raw
  modified_base (212)..(214): a, c, t, g, unknown or other
  misc_feature (212)..(214): n is a, c, g, or t

SEQ ID NO: 131357 - DNA, 166 bp, Homo sapiens
  misc_feature: GYAE6OF01BPSK3.49.12.B01.1.454.CMB.1.raw
  modified_base (165)..(166): a, c, t, g, unknown or other
  misc_feature (165)..(166): n is a, c, g, or t
tcagagtcgagagacacgaccggtgctcgatttagtagtgtagattccgcgggcacgaccggtgctcgatttagtcacgcgagaaagggaaagggctggccctgacgtgtttctgttcccaccctcctctctctcgactctgagcgggctggcaaggcgcatagnn

SEQ ID NO: 131358 - DNA, 742 bp, Homo sapiens
  misc_feature: GYAE6OF01BC6U2.49.12.B01.1.454.CMB.1.raw
  modified_base (258)..(258): a, c, t, g, unknown or other
  misc_feature (258)..(258): n is a, c, g, or t
  modified_base (278)..(278): a, c, t, g, unknown or other
  misc_feature (278)..(278): n is a, c, g, or t
tcagagtcgagagacacgaccggtgctcgatttagtagtgtagattcggcgggggagtcccaaccaggacacagcatggacatgagggtccctgctcagctcctggggctcctgctgctctggctctcaggtgccagatggtgacatccgggatcgacccagtctccatccctccctgtctgcatctgtaggagacagaatcaccatcacttgccaggcgactcgaggactattagactaacttatttaaatggtatnagcaagaaccagggaaaccncccctaactcctagactactacgatcgacataccgtaatttagggaaaacgttacggggtacccctaagttaccgtaaaggggtttcaaaggtaggggtaaagttgggaacgtttcggtacgggggttaaccttttaagtttttaaccctttaccgaaccttaagtttacccgaatttacccgaaaaccttcggaacctacggtacccgttaggaaacggttaattacgttacgaactaaaccgtatttaaactttaactggtaacccaaagtaaattagttactaaactttaactacccttaaccctaacttacccgttaaacggtttcccgggaacgggtaccgggtaaccttaaccgggggtgtaaaacggtaaccttaaacccggaaaacgtacccggtgggttacgaccgttaccggacctaaacccgtagttacccttggtttaccctcggttaaccc

SEQ ID NO: 131359 - DNA, 183 bp, Homo sapiens
  misc_feature: GYAE6OF01CPKXG.49.12.B01.1.454.CMB.1.raw
  modified_base (183)..(183): a, c, t, g, unknown or other
  misc_feature (183)..(183): n is a, c, g, or t
tcagagtcgagagacacgaccggtgctcgatttagtagtgtagattccgcggggtgctcgatttagtagtgtagattccgcgggcacgaccggtgctcgatttagctctacgctctaagggaaaggggttcctgttcccgccctcctctctctcgactcgagcgggctggcaaggcgcatagn

SEQ ID NO: 131360 - DNA, 172 bp, Homo sapiens
  misc_feature: GYAE6OF01AWWLY.49.12.B01.1.454.CMB.1.raw
  modified_base (166)..(172): a, c, t, g, unknown or other
  misc_feature (166)..(172): n is a, c, g, or t
tcagagtcgagagacacgaccggtgctcgatttagtagtgtagattccgcgggcacgaccggtgctcgatttagtcacgcgagaaagggaaggggctggccctgacgtgtttctgttcccaccctcctctctctcgactctggagcgggctggcaaggcgcatagnnnnnnn

SEQ ID NO: 131361 - DNA, 222 bp, Homo sapiens
  misc_feature: GYAE6OF01EVDZ6.49.12.B01.1.454.CMB.1.raw
  modified_base (213)..(222): a, c, t, g, unknown or other
  misc_feature (213)..(222): n is a, c, g, or t
tcagagtcgagagacacgaccggtgctcgatttagtagtgtagattccgcgggcacgaccggtgctcgatttagagagagtgtgttgggtttggggggaagaggaagactgaccggtccccccaggagttcaggtgctgggcacagcgccctgggctgcctggtcaaggctacttcctctctcgactctgagcgggctggcaaggcgcatagnnnnnnnnnn

SEQ ID NO: 131362 - DNA, 215 bp, Homo sapiens
  misc_feature: GYAE6OF01EH9XJ.49.12.B01.1.454.CMB.1.raw
  modified_base (213)..(215): a, c, t, g, unknown or other
  misc_feature (213)..(215): n is a, c, g, or t
tcagagtcgagagacacgaccggtgctcgatttagtagtgtagattccgcgggcacgaccggtgctcgatttagagagagtgtgttgggtttgggggaagaggaagactgaccggtcccccaggagttcaggtgctgggcacagcggccctgggctgcctggtcaaggactacttcctctctcgactctgagcgggctggcaaggcgcatagnnn

SEQ ID NO: 131363 - DNA, 255 bp, Homo sapiens
  misc_feature: GYAE6OF01B3ZZ8.49.12.B01.1.454.CMB.1.raw
  modified_base (252)..(255): a, c, t, g, unknown or other
  misc_feature (252)..(255): n is a, c, g, or t
tcagagtcgagagacacgaccggtgctcgatttagtagtgtagattccgcgggcacgaccggtgctcgatttagtagtgtagattccgcgggcgacgaccggtgctcgatttacgagagagtgtgttgggttgggggaagaggaagactgacggtcccccaggagttcaggtgctgggcacagcggccctgggctgcctggtcaaggactacttcctctctcgactctgagcgggctggcaaggcgcatagnnnn

SEQ ID NO: 131364 - DNA, 208 bp, Homo sapiens
  misc_feature: GYAE6OF01AZP2W.49.12.B01.1.454.CMB.1.raw
  modified_base (165)..(208): a, c, t, g, unknown or other
  misc_feature (165)..(208): n is a, c, g, or t
tcagagtcgagagacacgaccggtgctcgatttagtagtgtagattccgcgggcacgaccggtgtcgatttagtcacgcgagaaagggaagggctggccctggacgtgtttctgttcccgaccctcctctctctcgactctgagcgggctggcaaggcgcatagnnnnnnnnnnnnnnnnnnnnnnnnnnnnnnnnnnnnnnnnnnnn

SEQ ID NO: 131365 - DNA, 331 bp, Homo sapiens
  misc_feature: GYAE6OF01AWWM9.49.12.B01.1.454.CMB.1.raw
  modified_base (326)..(331): a, c, t, g, unknown or other
  misc_feature (326)..(331): n is a, c, g, or t
tcagagtcgagagacacgaccggtgctcgatttagtagtgtagattccgcgggcacgaccggtgctcgatttagcatactctacagggacaacgccaagaactcactgtatctgcaaatgaacagcctgagagccgaggacacggccgtatattactgtgcgagagttatccctcacggtgacaatcgctatttctacgacggtatggacgtctggggccaagggaccacggtcgccgtctcctcagcctccaccaagggcccatcggtcttccccctggcgccctcctctctctcgactctgagcgggctggcaaggcgcatagnnnnnn

SEQ ID NO: 131366 - DNA, 166 bp, Homo sapiens; identical to SEQ ID NO: 131345
  misc_feature: GYAE6OF01B7G8B.49.12.B01.1.454.CMB.1.raw
  modified_base (166)..(166): a, c, t, g, unknown or other
  misc_feature (166)..(166): n is a, c, g, or t

SEQ ID NO: 131367 - DNA, 166 bp, Homo sapiens
  misc_feature: GYAE6OF01CQI49.49.12.B01.1.454.CMB.1.raw
  modified_base (165)..(166): a, c, t, g, unknown or other
  misc_feature (165)..(166): n is a, c, g, or t
tcagagtcgagagacacgaccggtgctcgatttagtagtgtagattccgcgggcacgaccggtgctcgatttagtcacgcgagaaagggaaaggggctggccctgacgtgtttctgttcccgcctcctctctctcgactctgagcgggctggcaaggcgcatagnn

SEQ ID NO: 131368 - DNA, 168 bp, Homo sapiens
  misc_feature: GYAE6OF01C6CXI.49.12.B01.1.454.CMB.1.raw
  modified_base (164)..(168): a, c, t, g, unknown or other
  misc_feature (164)..(168): n is a, c, g, or t
tcagagtcgagagacacgaccggtgctcgatttagtagtgtagattccgcgggcacgaccggtgctcgatttagtcacgcgagaaagggaaggggctggccctgacgtgtttctgttcccacctcctctctctcgactctgagcgggctggcaaggcgcatagnnnnn

SEQ ID NO: 131369 - DNA, 255 bp, Homo sapiens
  misc_feature: GYAE6OF01C0CVQ.49.12.B01.1.454.CMB.1.raw
  modified_base (250)..(255): a, c, t, g, unknown or other
  misc_feature (250)..(255): n is a, c, g, or t
tcagagtcgagagacacgaccggtgctcgatttagtagtgtagattccgcgggcacgaccggtgctcgatttagtagtgtagattccgcgggcacgaccggtgctcgatttagagagagtgtgttgggttgggggaagaggaagactgacggtcccccaggagttcaggtgctgggcacagcggccctgggctgcctggtcaaggactacttcctctctcgactctgagcgggctggcaaggcgcatagnnnnnn

SEQ ID NO: 131370 - DNA, 834 bp, Homo sapiens
  misc_feature: GYAE6OF01C6OAL.49.12.B01.1.454.CMB.1.raw
tcagagtcgagagacacgaccggtgctcgatttagtagtgtagattcggcgggggggacaatcttcatcatgacctgctcccctctcctcctcacccttctcattcactgcacagggtcctgggcccagtctgtgttgacgcagcccgccctcagtgtctcgccggccccaggacaagaaagtcaccatctcctgcctctggaagcagcctaccaactagttaggggaaataattatgtatcggtaggtaccagcagttcccgaggaaccgccccagacctcctctattcatacgaactaaactaaacgaacggcggaacgtacccgaagaacgtactttccgacgtaaccgtactttcctacgttcggccttaacccgtaaggttccgtcggaccctacccgtcgaaccggccccaacccgttcgggacccaacgtaccggaaccccggtacctacccgaaggtaacccgggtacgggggaaccggtaacggggtacccgttaattttaaacggttaacccggttacggggaaccgggtaaaacgtaacgggttacgggtaacctttacccgacggttacccgttagggtaacggtttgggtacgttaccggggttaaggggggtttccggttccgggggaacgggtaaccgggggacccgtaaagggtcccgtaaccgggtaccccggttaccgtaacgggggttcccaaccgggaccccgtaaacgggtccccgttaacccggggcccccgtttacgggacccttacccgttcccgttccccgttaccccccgtaccccttccgtacccttcccgtccgttcccgtaccgg

SEQ ID NO: 131371 - DNA, 724 bp, Homo sapiens
  misc_feature: GYAE6OF01D1YGM.49.12.B01.1.454.CMB.1.raw
  modified_base (209)..(209): a, c, t, g, unknown or other
  misc_feature (209)..(209): n is a, c, g, or t
tcagagtcgagagacacgaccggtgctcgatttagtagtgtagattcggcgggggggacaatcttcatcatgacctgctcccctctcctcctcacccttctcattcactgcacagggtcctgggcccagtctgtgttgacgcagccgccctcagtgtctgcggcccaggacagaaagtcaccatctcctgctctggaagcagctccaanagttgggaaagaattatgtatcgtggtaccagcagttccaggaccgcccagactctcattcatgacaataacaagcgagtccagagacttccgtagacgtattctcgtcgcctaccaagtctggccacctcgacgcccacccgtgcctactccgaccggactccgacgacggtacggggacgacggaccgtaattacgtttaacgcgtaccggaaactaggtacgggtacttacccgagtcccgttaggacgggtttgggtcggttacggtaacgggggtttgggtttacgggggaccggggtaacggggaaccccgtaaacgggtcccggttaccggtaaccccgggtttaccgtaagggttaccccgaacgggtaccccggaaacggggttcccgttaccccggggcccccgtttcgggtacccgttaccccgttcccggtttaccccggtttacccccccttaccccgtttcccccgtttaccttccccgtttcccgtacccggttacccgg

SEQ ID NO: 131372 - DNA, 599 bp, Homo sapiens
  misc_feature: GYAE6OF01DJVA4.49.12.B01.1.454.CMB.1.raw
  modified_base (262)..(262): a, c, t, g, unknown or other
  misc_feature (262)..(262): n is a, c, g, or t
  modified_base (378)..(378): a, c, t, g, unknown or other
  misc_feature (378)..(378): n is a, c, g, or t
tcagagtcgagagacacgaccggtgctcgatttagtagtgtagattcggcgggggagtcccaaccaggacacagcatggacatgagggtccctgctcagctcctggggctcctgctgctctggctctcaggtgccagatgtgacatccggatcgacccagtctccatcctccctgtctgcatctgtaggagacagaatcaccatcacttgccgagcgactcgaggactattagactaacttaatttaaattggtaatcgaanacaaacgaaaccgacgggaaactccccctaaactcctgactcaacgatgcatcaagtttagaaagtcgggtaccatcgaagttcagtggaagtggatcgtaggtacttatttactnactatcatacgaactgacagcgtagagtactatacgactaactatacttaactagactaaactagtaatactaattaactacctaacctaacgttctaaccggtttcggacgggtaaccggtaccgtaacgggtaggaaactaagtaaacccgtaaacggtaacgttggtcggacctagaacctaaccgtattaccggtttacttacgttccttaaacccg

SEQ ID NO: 131373 - DNA, 261 bp, Homo sapiens
  misc_feature: GYAE6OF01DP3PT.49.12.B01.1.454.CMB.1.raw
  modified_base (141)..(141): a, c, t, g, unknown or other
  misc_feature (141)..(141): n is a, c, g, or t
  modified_base (253)..(261): a, c, t, g, unknown or other
  misc_feature (253)..(261): n is a, c, g, or t
tcagagtcgagagacacgaccggtgctcgatttagtagtgtagattccgcgggcacgaccggtgctcgatttagtagtgtagattccgcgggtcgacgaccggtgctcgatttacgagagagtgtgttgggttgggggaanaggaagactgacggtcccccaggagttcaggtgctgggcacagcggccctgggctgcctggtcaaggactacttcctctctcgactctgagcgggctggcaaggcgcatagnnnnnnnnn

SEQ ID NO: 131374 - DNA, 260 bp, Homo sapiens
  misc_feature: GYAE6OF01CBLUW.49.12.B01.1.454.CMB.1.raw
  modified_base (217)..(217): a, c, t, g, unknown or other
  misc_feature (217)..(217): n is a, c, g, or t
  modified_base (253)..(260): a, c, t, g, unknown or other
  misc_feature (253)..(260): n is a, c, g, or t
tcagagtcgagagacacgaccggtgctcgatttagtagtgtagattccgcgggcacgaccggtgctcgatttagtagtgtagattccgcgggcacgaccggtgctcgatttagagagagtgtgttgggtttgggggaagaggaagactgacggtcccccaggagttcaggtgctgggcacagcgccctgggctgcctggtcaaaggactacttcctntctcgactctgagcgggctggcaaaggcgacatagnnnnnnnn

SEQ ID NO: 131375 - DNA, 179 bp, Homo sapiens
  misc_feature: GYAE6OF01A2A25.49.12.B01.1.454.CMB.1.raw
  modified_base (173)..(179): a, c, t, g, unknown or other
  misc_feature (173)..(179): n is a, c, g, or t
tcagagtcgagagacacgaccggtgctcgatttagtagtgtagattccgcgggtagtgtagattccgcgggcacgaccggtgctcgatttagtagtgtagattccgcgggcacgaccggtgctcgatttagtagtgtagattcgaggcggtcgtggacgaaggcacaagtagnnnnnnn

SEQ ID NO: 131376 - DNA, 809 bp, Homo sapiens
  misc_feature: GYAE6OF01C109C.49.12.B01.1.454.CMB.1.raw
  modified_base (328)..(328): a, c, t, g, unknown or other
  misc_feature (328)..(328): n is a, c, g, or t
tcagagtcgagagacacgaccggtgctcgatttagtagtgtagattcggcgggggggacaatcttcatcatgacctgctcccctctcctcctcacccttctcattcactgcacagggtcctgggcccagtctgtgttgacgcagccgccctcagtgtctgccggcccaggacagaaagtcaccatctcctgctctggaagcagcctaccaacagttaggggaaataattatgtatcggtggtaccagcacgttcccgaaggaccggccccagacctcctcattcatagaacaataaacgaagaccgacgtacccaagacgtacttccngaaccgtattcgtcgtacggtcctaccgtaaggttccgtacggacctacctccgaaccgcccacccgtacggacccaacgtcccgaacccggtacctacccggaacggtacggtacgggggaaccgacgggtacccttaagttaacgttaaccgacgggtaaccggtaaacgtacggttacgggtaacttaccggaacggtcccgttagggtaacggttcgggttacgggttacgggttaacggggttcgggttaccggggtaacgggggtaacgggtaacccgtaacggggccggttaacccgggttaacccgttaccggttaccgggtaaccggtaaccgggtaccccgggtaaagggtccccgttaccccggggtacccccgttaccgggttaccctaccccgtttcccggttaccccgttaccccccgttaccccctttaccgttcccgttcccgttacccgtcccggtttacccgg

SEQ ID NO: 131377 - DNA, 548 bp, Homo sapiens
  misc_feature: GYAE6OF01CZNB0.49.12.B01.1.454.CMB.1.raw
  modified_base (270)..(270): a, c, t, g, unknown or other
  misc_feature (270)..(270): n is a, c, g, or t
  modified_base (342)..(342): a, c, t, g, unknown or other
  misc_feature (342)..(342): n is a, c, g, or t
  modified_base (407)..(407): a, c, t, g, unknown or other
  misc_feature (407)..(407): n is a, c, g, or t
  modified_base (432)..(432): a, c, t, g, unknown or other
  misc_feature (432)..(432): n is a, c, g, or t
  modified_base (523)..(523): a, c, t, g, unknown or other
  misc_feature (523)..(523): n is a, c, g, or t
  modified_base (546)..(546): a, c, t, g, unknown or other
  misc_feature (546)..(546): n is a, c, g, or t
tcagagtcgagagacacgaccggtgctcgatttagtagtgtagattcggcgggggggacaatcttcatcatgacctgctcccctctcctcctcacccttctcattcactgcacagggtcctgggcccagtctggtgttgacgcagccgccctcagtgtctgcggccccaggacagaaagtcaccatctcctgctcgtggaagcagcctccaaacagttgggaaagaattatgtaatcgtggtaccagcagtcccaggacgcccagactcnattcatgacaataacaagcgacgtccagagtatcctgaaccgattctctggctaccgaagtctaggcacctnacgccaccgtgccatcaccggactccaagaccgtaggggacaggccgtattaatactgcggaaancgtagggattccaagtctgagtggntcgaggtgttcgagggacggacaagcgtagacgttccaggtcacgccgtaaaggcgtcggacccgtcggtacgaccgttcctgtttccccnccccgtctccgtctcgttacccncg

SEQ ID NO: 131378 - DNA, 250 bp, Homo sapiens
  misc_feature: GYAE6OF01C2UMJ.49.12.B01.1.454.CMB.1.raw
  modified_base (235)..(235): a, c, t, g, unknown or other
  misc_feature (235)..(235): n is a, c, g, or t
  modified_base (241)..(250): a, c, t, g, unknown or other
  misc_feature (241)..(250): n is a, c, g, or t
tcagagtcgagagacacgaccggtgctcgatttagtagtgtagattccgcgggcacgaccggtgctcgatttagtagtgtagattccgcgggcacgaccggtgctcgtatttagtacgtcgtagattaccgcgggcacgaccgtgctcgtattagtcacgcgagaaaggaaggggctgcctgacgtgttctgttcccgcctcctctctctcgactctgagcgggctggcaaggcncatagnnnnnnnnnn

SEQ ID NO: 131379 - DNA, 108 bp, Homo sapiens
  misc_feature: GYAE6OF01AJTMF.49.12.B01.1.454.CMB.1.raw
tcagagtcgagagacacgaccggtgctcgatttagtagtgtagattccgcgggcacgaccggtgctcgatttagtagtgtagattcagcgggctggcaaggcgcatag

SEQ ID NO: 131380 - DNA, 758 bp, Homo sapiens
  misc_feature: GYAE6OF01EAQFZ.49.12.B01.1.454.CMB.1.raw
tcagagtcgagagacacgaccggtgctcgatttagtagtgtagattcggcgggggggacaatcttcatcatgacctgctcccctctcctcctcacccttctcattcactgcacagggtcctgggcccagtctggtgttgacgcagcccgccctcagtgtctggccggcccaggacagaaagtcaccatctctgctctggaagcagcctaccaactagttagggaaataattatgtatcggtaggtaccagctacgtccgaacgggaacccggccccagacctcctctattcatagaacaaataacgaagcgacgtacccaaggtacgtacttccgagaccgtattcctcgtcgacctacgtaacgtccgtacggacctaccgtacgaccgtaccccaacccgtcggaccctaacgtacccggaacccgtacctacccgaacggaccgggtacggggaaccggacgggtaccgttaatttaacgttacgtacggaaccggtaaacgtaggttacgggtaaccttccgaacggttacccgtaggtacgggttcggtcgggttacgggtaacggggtttcgggtacggggaccgggaacgggtaccgaacggttcccggtacggttaccccggttacggtacggaccgaccggaacccggtacgggtaccgttcccgggtccccgttacggtacctacccgttcccggttccccgttacccccgtccctttcccgtaccgttcccttccggccgttaccgg

SEQ ID NO: 131381 - DNA, 741 bp, Homo sapiens
  misc_feature: GYAE6OF01DFAVN.49.12.B01.1.454.CMB.1.raw
  modified_base (207)..(207): a, c, t, g, unknown or other
  misc_feature (207)..(207): n is a, c, g, or t
tcagagtcgagagacacgaccggtgctcgatttagtagtgtagattcggcgggggggacaatcttcatcatgacctgctcccctctcctcctcacccttctcattcactgcacagggtcctgggcccagtctgtgttgacgcacgcccgccctcagtgtctcgccggccccaggacaagaaagtcaccatctcctgctcgtggaacncacgctaccaactagttagggaataattatgtatcgtacggtaccagcctacgttcccgaacgggaacccggcccccagtaccctcctactacttacatacgaaacaaactaacgaacggaccgtaacggtaccccaaggaacgtactttcccgtagacccgtatttccgtcgtcggtacctacctaacgtctacggccacctacgacgtcccaccgttcggacctacgcccgacccgtacctcccgaaggtacggtacggggtacgaacgggtccgttaatttacgttaccgtagacccggaatacggtaggtacttcccgagtccgtagggtacgttagggtcgtacgggtacggggttcggttcggggaacggtaaccgggaccgtaacggccgttaccggtacccgttaccggtaacggtccgaaccggacccggtacgggtccgttacccgggcccgttcggacccttccgtaccgttcccgttacccccgtacccttcccgtaccctttcccgtccgtccgttacccg

SEQ ID NO: 131382 - DNA, 777 bp, Homo sapiens
  misc_feature: GYAE6OF01C6XZZ.49.12.B01.1.454.CMB.1.raw
tcagagtcgagagacacgaccggtgctcgatttagtagtgtagattcggcgggggggacaatcttcatcatgacctgctcccctctcctcctcacccttctcattcactgcacagggtcctgggcccagtctgtgttgacgcagccgccctcagtgtctgccggcccaggacagaaagtcaccatctcctgctcgtaggaacgcagtcctaccaactagttaggggaaataattagtgtatcggtcggtaccagcacgttccgaaggaccggccccagacctcctctattcatgaacaaataaacgaagccgaacgtcccaagtacgtacttcccgtacgaccgtactttccgtcgtacgggccttaccgaaggttccgtggtacctacccgtcgaaccgcccctacccgtcggaccctacgtacccgaccggtacctccgaacggtacggtcgggggaaccgaacgggtacctaatttaagttaccgtacggacggtaaacaggttcggggaacctttcccgaacggtccgttggtaacgggttcgggtttacggtacgggtagggggtttccgttacggggggaacgggaaccgggtaaccggtaaccggtcgttaaccgggtacccggttaccggtacgggtacccgaaccggtacccggaacggggtcccgttaccccgggcccccgttaggggtaccctacccggtttccgttcccccggtttacccccggtccccttccgttaccctccggtttcccgtccggttacccgg

SEQ ID NO: 131383 - DNA, 868 bp, Homo sapiens
  misc_feature: GYAE6OF01CHA3Z.49.12.B01.1.454.CMB.1.raw
tcagagtcgagagacacgaccggtgctcgatttagtagtgtagattcggcgggggggacaatcttcatcatgacctgctcccctctcctcctcacccttctcattcactgcacagggtcctgggcccagtctgtgttgacgcacgccgccctcagtgtctgcggcccaggacagaaagtcaccatctcctgctctggaagcagcctaccaacagttagggaaagtaatttagtgtaatcggtaggtacccagcctacgttacccgaaggaacccgccccagacctcctactagttcagtacgaacaataacaggacgtacgtcccagacgtacttccgagaaccgttattccgtccgtggtaccctaccgtaacgtccgtggacctacctcgaccgacccacccgtcggacccaaccgttaccgaaccccgggttacctacccggaaacggaacccgggttacggggggaacccgtaacgggggtacccgtaaacgttttaacgttaccggtacgggtaaaccggtaaacgttacgggtaacggggttaacccttacccggtaacgggtaccccggttaggggtaaccgggtttggggttaccgggttacgggttacggggggttccggtttacccggggggaacggggtaaacccgggggtaacccgtaacggtaccccgggtttaccgggaaccccggtttaacccgggtacgggtacccgtaaaccggacccccggttaacgggccccgttaccccgggggtccccccgttacggtaccccttacccggtttcccggtttccccgtttacccccccggtcccctttacccggttcccccttccggttaccggtcccggttacccg

SEQ ID NO: 131384 - DNA, 244 bp, Homo sapiens
  misc_feature: GYAE6OF01BALOY.49.12.B01.1.454.CMB.1.raw
  modified_base (226)..(244): a, c, t, g, unknown or other
  misc_feature (226)..(244): n is a, c, g, or t
tcagagtcgagagacacgaccggtgctcgatttagtagtgtagattccgcgggcacgaccggtgctcgatttagagagagtgtgttgggtttggggggaagaggaagactgacggtcccccaggagttcaggtgctgggcacagcggccctgggctgcctggtcaaggactacttcccgtcgtagctactcgtgacggcggtcgtcggacgaacggcgacagtagnnnnnnnnnnnnnnnnnnn

SEQ ID NO: 131385 - DNA, 191 bp, Homo sapiens
  misc_feature: GYAE6OF01CT4S9.49.12.B01.1.454.CMB.1.raw
  modified_base (189)..(191): a, c, t, g, unknown or other
  misc_feature (189)..(191): n is a, c, g, or t
tcagagtcgagagacacgaccggtgctcgatttagtagtgtagattccgcgggatttagtagtgtagattccgcgggcacgaccggtgctcgatttagtcacgcgagaaagggaaaggggctggccctgacgtgtttctgttcccacctcctctctctcgactctgagcgggctggcaaggcgcatagnnn

SEQ ID NO: 131386 - DNA, 706 bp, Homo sapiens
  misc_feature: GYAE6OF01D5P58.49.12.B01.1.454.CMB.1.raw
  modified_base (337)..(337): a, c, t, g, unknown or other
  misc_feature (337)..(337): n is a, c, g, or t
tcagagtcgagagacacgaccggtgctcgatttagtagtgtagattcggcgggggggacaatcttcatcatgacctgctcccctctcctcctcacccttctcattcactgcacagggtcctgggcccagtctgtgttgacgcagccgccctcagtgtctcgccggccccaggacagaaagtcaccatctctgctcgtggaagcagcctaccaactagttagggaaagtaatttatgttactcggtcggtaccagctacgttccgaacggaccgccccagacctcctcattcatcgaacaataacagcgacgtccaagtactcttccgacgaaccttnttctcgtcgtcctacctaacggtctcggacctaccgtcacgtcccaccgtcgacctactccggaaccggacctccgacggtaccggtggggaaccgtacggtccgttaatttacgtacgtacggaaccggtaagacggttacgggtaacttccggacggtcgtagggtacggttgggttacggtcgggtaggggtttccgggtacggggaacggggtaacgggtaaccgaacgggttccggtaaccgtaacccgggttccgtaacgggtccgtaaccggacccggtacggcccgtcccgggtccccgtcggtaccttcccgttccgttccccgtccccgtccttcccgttctccctccgttccggtacg

SEQ ID NO: 131387 - DNA, 708 bp, Homo sapiens
  misc_feature: GYAE6OF01C6OO7.49.12.B01.1.454.CMB.1.raw
  modified_base (293)..(293): a, c, t, g, unknown or other
  misc_feature (293)..(293): n is a, c, g, or t
tcagagtcgagagacacgaccggtgctcgatttagtagtgtagattcggcgggggggacaatcttcatcatgacctgctcccctctcctcctcacccttctcattcactgcacagggtcctgggcccagtctgtgttgacgcagccgccctcagtgtctggccggcccaggacaagaaagtcaccatctcctgctcgtggaagcacgcctaccaaatagttaggggaaataaatttagtgtaatcggtaggtaaccagctacgttcccgaaggaaccggccccagacctcctnattcatagaacaataacaagcgacgtaccaagtagacttcctagaaccgtattcctcgtggcctaccgaagtcctgccaacctcacgtcccacccgtcggaccctacgtaccgaaccggtacctaccgaacggtaccggtacgggggaacgacggtaccgtaatttaacgttaccggtacgaacggtaaacctaggtacgggtacttccgaacgtccgttaggaggttggtacgtcggtagggttcggttacgggacgggtaacgggtaccaacgggtcgtacggtaccgttaccgtaggtaccgaccggaccgaaccgggtcgtacccggtaccccggttcggtacctaccggttcccgttacccggttccccccgtacccttccttccgtcccgttcccgtccggttaacccg

SEQ ID NO: 131388 - DNA, 170 bp, Homo sapiens
  misc_feature: GYAE6OF01BCXBN.49.12.B01.1.454.CMB.1.raw
  modified_base (165)..(170): a, c, t, g, unknown or other
  misc_feature (165)..(170): n is a, c, g, or t
tcagagtcgagagacacgaccggtgctcgatttagtagtgtagattccgcgggcacgaccggtgctcgatttagtcacgcgagaaagggaaggggctggccctgacgtgtttctgttcccaccctcctctctctcgactctgagcgggctggcaaggcgcatagnnnnnn

SEQ ID NO: 131389 - DNA, 167 bp, Homo sapiens; identical to SEQ ID NO: 131331
  misc_feature: GYAE6OF01CJ5KK.49.12.B01.1.454.CMB.1.raw
  modified_base (167)..(167): a, c, t, g, unknown or other
  misc_feature (167)..(167): n is a, c, g, or t

SEQ ID NO: 131390 - DNA, 771 bp, Homo sapiens
  misc_feature: GYAE6OF01D6Q5W.49.12.B01.1.454.CMB.1.raw
  modified_base (194)..(194): a, c, t, g, unknown or other
  misc_feature (194)..(194): n is a, c, g, or t
  modified_base (280)..(280): a, c, t, g, unknown or other
  misc_feature (280)..(280): n is a, c, g, or t
tcagagtcgagagacacgaccggtgctcgatttagtagtgtagattcggcgggggggacaatcttcatcatgacctgctcccctctcctcctcacccttctcattcactgcacagggtcctgggcccagtctgtgttgacgcagcccgccctcagtgtctgcggcccaggacagaaagtcacatctcctgctcnggaagcagcctaccaaactagttagggaataatttatgtatcggtggtaccagcacgttcccgaggacccggccccagacctcctnattcatagaacaactaacaagcgacgtaccagagtacttccagaccgtattcctactcggcctaccacgttcctcggcctaccgtccaccgaccctacccgtcggacccagtacccgaacccggtacctacccgaaggtaccgtacggggggaccgacggggtacccgtaacgtttaacgttacgttacgggaacggtaaacgtagtacggggtacttcccggacggtcccgtaggtacgttcgggtacggttacggtaggggttccggttacgggtaccggggaacgggaacccgaccgggtaccgttaccgggtacccggttacccggttacgggtacccgaaaccgggtacccggtaaccgggtcccggttacccggggtcccccggttaccggttcccggtaacccgtttcccgttacccggtttacccccccggtccccccgttaccggttaccccctttccggttcccgttcccggttaaccccg

SEQ ID NO: 131391 - DNA, 273 bp, Homo sapiens
  misc_feature: GYAE6OF01EII10.49.12.B01.1.454.CMB.1.raw
  modified_base (269)..(273): a, c, t, g, unknown or other
  misc_feature (269)..(273): n is a, c, g, or t
tcagagtcgagagacacgaccggtgctcgatttagtagtgtagattccgcgggcacgaccggtgctcgatttagtagtgtagattccgcgggcacgaccggtgctcatttagtagtgtagattccgcgggcacgaccggtgctcgatttagtcacgcgagaaagggaaggggtgctcgatttagcacgcgagaaagggaaggtgcctgacgtgtttctgttcccacctcctctctctcgactctgagcgggctggcaaggcgacatagnnnnn

SEQ ID NO: 131392 - DNA, 263 bp, Homo sapiens
  misc_feature: GYAE6OF01CJX1M.49.12.B01.1.454.CMB.1.raw
  modified_base (253)..(263): a, c, t, g, unknown or other
  misc_feature (253)..(263): n is a, c, g, or t
tcagagtcgagagacacgaccggtgctcgatttagtagtgtagattccgcgggcacgaccggtgctcgatttagtagtgtagattccgcgggcacgaccggtgctcgatttacgagagagtgtgttgggttgggggaagaggaagactgaccggtcccccaggagttcaggtgctgggcacagcggccctgggctgcctggcaaggaaatacttccagtactctatctgagcgggctggacaaggcgcatagnnnnnnnnnnn

SEQ ID NO: 131393 - DNA, 690 bp, Homo sapiens
  misc_feature: GYAE6OF01DYFDF.49.12.B01.1.454.CMB.1.raw
  modified_base (153)..(153): a, c, t, g, unknown or other
  misc_feature (153)..(153): n is a, c, g, or t
  modified_base (158)..(158): a, c, t, g, unknown or other
  misc_feature (158)..(158): n is a, c, g, or t
  modified_base (188)..(188): a, c, t, g, unknown or other
  misc_feature (188)..(188): n is a, c, g, or t
  modified_base (457)..(457): a, c, t, g, unknown or other
  misc_feature (457)..(457): n is a, c, g, or t
  modified_base (623)..(623): a, c, t, g, unknown or other
  misc_feature (623)..(623): n is a, c, g, or t
  modified_base (647)..(647): a, c, t, g, unknown or other
  misc_feature (647)..(647): n is a, c, g, or t
  modified_base (652)..(652): a, c, t, g, unknown or other
  misc_feature (652)..(652): n is a, c, g, or t
  modified_base (676)..(676): a, c, t, g, unknown or other
  misc_feature (676)..(676): n is a, c, g, or t
  modified_base (681)..(681): a, c, t, g, unknown or other
  misc_feature (681)..(681): n is a, c, g, or t
tcagagtcgagagacacgaccggtgctcgatttagtagtgtagattcggcgggggggacaatcttcatcatgacctgcctccccctctcctcctcacccttctcattcactgcacgtagggtcctgggcccagtctgtgttgacgcacgcccnccctnagtgtctgccggcccaggacagaaatcacntctctgctctggaagcagcctaccaagtagttagggaataattgtagtagtcgtacggaccagtccgtacgtacccgaacggaacccggccccagtaccctcctactacttccaatacgaacaaaactaacgaagtccgacgtccccgaagtacgtacttcccgtagaacccgttcttcgttcgtccgtacgtaccgtaagtcctacggaccctaccctacgacccgcccgtaacccgtcggacctaccgtacccgacccggtaacccnccggtaacggtaccgggtacggggtaccgacgggtaccttatttacgtacgcgacggtaagtagtcggtactacccgcggtaacttgggtagtcggtacggtggtacggggtcgtacggggaggttaggactacggtacgtccgttcggacccgttagcggtaacncggaccgtacggcgtccgcccggntaccncgtaccttcccgccctacccgttntcccngtcccttcg

SEQ ID NO: 131394 - DNA, 747 bp, Homo sapiens
  misc_feature: GYAE6OF01DW3GO.49.12.B01.1.454.CMB.1.raw
tcagagtcgagagacacgaccggtgctcgatttagtagtgtagattcggcgggggggacaatcttcatcatgacctgctcccctctcctcctcacccttctcattcactgcacagggtcctgggcccagtctgtgttgacgcacgcccgccctcagtgtctcggccggacccaggacaagaaacgtcaccatcctcctgctcgtggaagcagcctaccaatagttagggaaagtaattatgtatcggtcgtacagctacgttccgaggacccgcccagacctcctctactcatagaacaataacgaagccgagtaccaggtataccgttcgacgtaccgtattcctcgtacggtcctaccgtaacgtccggtaacggtcctaaccgtccaaccgccccgtaacccgtcggccctaaaccgtaccgaacccgggtacctacccgaacgggtaccgggtacggggaaccgggtacgggtacccttaacggttttaacgtccggtacgggaaccggtaaaacgtcggttaaccggggttactacccgagggtaccgttaggagggttcggttaacgggtcgggtaaggggtttcggaccggggcgggaaacgggtaccgacggtcgtaccggttaacccggtcggtacggaccggtaccggaccggtaaacggtcccgtacccgggtccccgtagtcctaccgttccgtccgttacccccctccttctacctttcccgtctcccgttacg

SEQ ID NO: 131395 - DNA, 742 bp, Homo sapiens
  misc_feature: GYAE6OF01C49LS.49.12.B01.1.454.CMB.1.raw
tcagagtcgagagacacgaccggtgctcgatttagtagtgtagattcggcgggggggacaatcttcatcatgacctgctcccctctcctcctcacccttctcattcactgcacgagggtcctgggcccagtctgtgttgacgcacgccgccctcagtgtctggccggcccaggaacaagaaacgtcaccatcctcctgctcgaggaacgcagacctaccaatagttaagggaaataagttagtgtaactcggtaggtaccagtacacgttcccgaacggaaccggccccagacctcctactattcatacgaaacaaactaacaagacgacgaccagagtacttccgcgaaccgtcttcctcgtcggacctaccgtaagtcgtacggcctaacccgtcaaccgcccaccgtcggacccacgtccgaaccggtacctaccgacggaccggtaggggaccgacggtacctaagtttacgttaccgacggacggtaaactggtacggacttaccgacggtccgtaggacgggttggtcgggtacggttaagggggttggtaacccggggacgggaaaccgggtaaccgaacggtccggtaaccggacccggtttacccgaaggggtcccaaaaccggtcccgggaacggtcccggttcccggccccccgttaggtccccttaccgggtccccttcccgggtttcccccccctcccttaccgttaccgtcccttaccggtccgtccg

SEQ ID NO: 131396 - DNA, 169 bp, Homo sapiens
  misc_feature: GYAE6OF01A7RUV.49.12.B01.1.454.CMB.1.raw
  modified_base (167)..(169): a, c, t, g, unknown or other
  misc_feature (167)..(169): n is a, c, g, or t
tcagagtcgagagacacgaccggtgctcgatttagtagtgtagattccgcgggcacgaccggtgctcgatttagtcacgcgagaaagggaaagggggctggccctgacgtgtttctgttcccgccctcctctctctcgactctgagcgggctggcaaggcgcatagnnn

SEQ ID NO: 131397 - DNA, 894 bp, Homo sapiens
  misc_feature: GYAE6OF01CT6FL.49.12.B01.1.454.CMB.1.raw
tcagagtcgagagacacgaccggtgctcgatttagtagtgtagattcggcgggggggacaatcttcatcatgacctgctcccctctcctcctcacccttctcattcactgcacagggtcctgggcccagtctgtgttgacgcagccgccctcagtgtctgccggccccaggacagaaagtcacatctcctgctctggaagcagcctaccaaactagttaggggaaataaactttatgtaattcggttaggtaacccagccagttcccgaaggaaccgccccagacctcctcattcatcgaacaaataacaagcgaagtacccaagacgtacttcccgtacgaaccgtatttcctcgtcgggtaccctacccgaaagttccgtacgggtaccctacccgttaccgaaccgtcccccgtaaaccccgtacgggtaccctaaccgtaccccggaaacccgggtaccttacccgaacgggtaaccggtacggggggaaacccgggtacggggtaaccccggttaagtttaaaccgttttaccgaacggggaaacccgggtaaacttaacgggtacgggggttaaaccttacccggaacgggtacccgtttacgggtaacgggtttcgggtttaccgggttacgggtaacggggggttttaaccgggtttccgggggaaccgggggaaccgggggtaaaccctaaacggggtccggttacccgggtaaaccccggttccggttaacggggttacccggaaccggaacccccggtaaagggtcccgggtttacgggaacccccccgtttcggggttacccctacccggtttcccgttacccccgggtttaacccctccccctttccccgttacccgtttccttcccgttacggtacccgg

SEQ ID NO: 131398 - DNA, 765 bp, Homo sapiens
  misc_feature: GYAE6OF01DAX08.49.12.B01.1.454.CMB.1.raw
  modified_base (154)..(154): a, c, t, g, unknown or other
  misc_feature (154)..(154): n is a, c, g, or t
tcagagtcgagagacacgaccggtgctcgatttagtagtgtagattcggcgggggggacaatcttcatcatgacctgctcccctctcctcctccacccttctcattcactgcacagggtcctgggcccagtctgtgttgacgcagcccgccctnagtgtctgccgcccaggacagaaagtcacctatcctcctgctctaggaagcagcctaccaaactagttaggggaaataatttatgttactcggtgtaaccagactacgttcccgaagggaacccggccccaagtacccttcctactatttacaagttacgaaacctaaaagtaaaccgaacgaccggtaaccgtaccccgaagtaaccggtactttcccgaacggtacccgtattttccgtacgttcggaccctacccgtaaggttccgttacgggacctacccgttacgacccggtacccctaccccggttcggaaccctaccgtacccggtaaccccgtaccgttacccaacgggtaacgggtacgggggaaccggtacgggacctttaagttacgttaaccgtacgggaacggtaacaggttacgggtaacttcccgagtcctgggtagtgggtcgtacgtggggttcgttcggggacgacgggacctaggtcgtcgaccgtacagggaccaccggtaccgacggttcgacccggtcccgttacggtctacccgtcgtttacccgtaccccgttacccttccgttacccttcgtacccgttcgtaccg

SEQ ID NO: 131399 - DNA, 295 bp, Homo sapiens
  misc_feature: GYAE6OF01DHD2K.49.12.B01.1.454.CMB.1.raw
  modified_base (256)..(256): a, c, t, g, unknown or other
  misc_feature (256)..(256): n is a, c, g, or t
  modified_base (265)..(295): a, c, t, g, unknown or other
  misc_feature (265)..(295): n is a, c, g, or t
tcagagtcgagagacacgaccggtgctcgatttagtagtgtagattccgcgggcacgaccggtgctcgatttagtagtgtagattccgcgggcacgaccggtgctcgatttagagagagtgtgttgggtttggggggaagaggaagactggaccggtccccccaggagttcaggtgctgggcacagcgccctgggctgccgtggtcaaaggactacttcctctctcgactcgtgaggcgggcgtaggacaagggcncaagtaggnnnnnnnnnnnnnnnnnnnnnnnnnnnnnnn

SEQ ID NO: 131400 - DNA, 881 bp, Homo sapiens
  misc_feature: GYAE6OF01DCJ7I.49.12.B01.1.454.CMB.1.raw
tcagagtcgagagacacgaccggtgctcgatttagtagtgtagattcggcgggggggacaatcttcatcatgacctgcctcccctctcctcctccacccttctctattcactgcacgacgggtccgtcgggcccagtctggtgtgaccgcacgcccgccctacgagttcgtcgtcggcccggaccccgaaggaacaaaggaaacgtccaaccctactcctcctgtcctacgtacggaacgcacgtacctaaccaaagtaggttaagggaaataattagtgttacgtcggtacgtaaccacggtacctaccggtaccggaaaccggaccccgtacccccgaagtacccttcctataacgttaccgaacgtaactaaactaaaccgtaaacgacggtacccgaaccgtaccgaaggtacgtaccttacccgtagaccttatccgtacgtacgtacctaacgtagtccgtacgtaccccaccgtaccgaaccgtccccgtaccggtccgtaccctaaccgacccggtaaccggtacccgtaacggtaaaccgggcgggggtaaccgggacggttacgtaaccttaagttaccgtacggggaacgtaacccggtaagtacggtacgggtacacgtaccggtcggtaaggtcggtcggtacggtacgggtaggtccggggacgggtaccgggaacgtaccgtacgggtcttaacccggtacgttaccgaacgggtcccggaacccgtccgggtaaacccggttcccggtccccgggttaacccccgtgggtttaaccccctcccccgggttttacccgtcccccccgtttccccccggtaaccctttcccgtttaacccctccggttccccggtaacgttcccggg

SEQ ID NO: 131401 - DNA, 712 bp, Homo sapiens
  misc_feature: GYAE6OF01ESI3A.49.12.B01.1.454.CMB.1.raw
  modified_base (302)..(302): a, c, t, g, unknown or other
  misc_feature (302)..(302): n is a, c, g, or t
  modified_base (317)..(317): a, c, t, g, unknown or other
  misc_feature (317)..(317): n is a, c, g, or t
  modified_base (679)..(679): a, c, t, g, unknown or other
  misc_feature (679)..(679): n is a, c, g, or t
tcagagtcgagagacacgaccggtgctcgatttagtagtgtagattcggcgggggggacaatcttcatcatgacctgctcccctctcctcctcacccttctcattcactgcacagggtcctgggcccagtctgtgttgacgcacgccgccctcagtgtctcggccggcccaggacaagaacgtcaccatctctgtctcgtggaagcagtcctaccaactagttaggggaaataatttagtgtacgttcggtacggtaccaggtactaccgtaccgaacggacccgccccaagtaccttcctntaactcgatacgaanaaactaacaggaccgtacgtaccgagtacgtacttccgaacgtaccgttattcgtccgtcggcctaacgtacgtccgtacgacctaccgtacgaccgtaccccgtaccggtcgaccctacgtaccccgaccgggttacctacccggaacggtacgggtaaccggggaccgtaccgggtaccgttaatttaaccgtacggtacggtaaaccggtaagtacggtaacgtacgttacccgacgggttccggtaggtacggtggtacggtcggtaggttcgggtcggacggtaacgacgacgtaccggtcgtaccgtacgtacgtacacggtccgtacgccgtccggtcccgtatccgtacgttcncccgttacccctccgtcctagtctccgcgtccg

SEQ ID NO: 131402 - DNA, 162 bp, Homo sapiens
  misc_feature: GYAE6OF01DBWA6.49.12.B01.1.454.CMB.1.raw
  modified_base (153)..(162): a, c, t, g, unknown or other
  misc_feature (153)..(162): n is a, c, g, or t
tcagagtcgagagacacgaccggtgctcgatttagtagtgtagattccgcgggcacgaccggtgctcgatttagtagtgtagattccgcgggcacgaccggtgctcgatttagtagtgtagattcgaggcggcgtggacgaaggcgacatagnnnnnnnnnn

SEQ ID NO: 131403 - DNA, 735 bp, Homo sapiens
  misc_feature: GYAE6OF01EQJXC.49.12.B01.1.454.CMB.1.raw
  modified_base (194)..(194): a, c, t, g, unknown or other
  misc_feature (194)..(194): n is a, c, g, or t
tcagagtcgagagacacgaccggtgctcgatttagtagtgtagattctcgggggggacaatcttcatcatgacctgctcccctctcctcctcacccttctcattcactgcacaggtcctgggcccagtctgtgttgacgcagccgccctcagtgtctgcggcccaggacagaagtcacatctctgctctggaancagcctaccaacgagttagggaaagtaatttagtagtatcggtcggtaccagctacgttaccgaacggaacccgccccagtacctcctactattacatacgaaacaataacgaagccgtacgtacccgaagtactacgttccgtacgaccgttactttccgtacgtcggtacctaccgtaacgttccgtacggaccctacccgtccgaacgtccccgaccgtcggaccctacgtacccgaacccggtacctacccgaacggtacggtacggggaccgtacgggtccgttaaactttacgtacggtcggaaccggtaatacgggtacggtaacttaccgacgtccgtaggtaggttcgtacggtcggtagggttccggtacgggacgggaacgggtaccaaggttccggaccgttacgtaccgtaaggtccgaccgacccgtacggtccgttacccggtccccggttggtacccgttacccgttccgttccccgttaacccccgtccctttccctccttcccggtccgttacccgtacccgg

SEQ ID NO: 131404 - DNA, 860 bp, Homo sapiens
  misc_feature: GYAE6OF01ALUUA.49.12.B01.1.454.CMB.1.raw
tcagagtcgagagacacgaccggtgctcgatttagtagtgtagattcggcgggggggacaatcttcatcatgacctgctccctctcctcctcacccttcctcattcactgcacgaggtcctgggcccagtctgtgttgacgcagcccgccctcagtgtctgcggcccaggacagaaagtcaccatctctgctctggaagcagcctacaacagttacgggaagtaattatgtatcgtaggtaccagctagttcccgaggaaccggccccagacctcctcacttcactcgaacaaactaaaccgaaagtcggaacgttacccaaggtacggaactttaccgtagtaacccggtactttccgtacgttccgggaccgttaccctaaacggttcctacgggtacctaacccgtttacgaacccggtacccctaaccccggttcgggtaccccctaaacgttaccccgtaaaccccggggtaaccctttacccggaaacgggtacccggttacgggggggaacccgtaaccggggtacccggttaacttttaacgtttaccgtacggacccggggtaaaacctagggttaccggggttaacctttacccggaaccggttccgtttaacgggaccggtttggggttaccggtttacggttaggggtttaccgggtttacggggaaccggggttaacgggaaccccgtaaagggtccgtttaacgggaccccggtttcgtaaaccgggtccgtaaaccggcccgtaaacgggtcccgttaccgggtcccccgttacgggtctacccgttacccggttccttacccccgtaccctttcccttaccgttcctacccgttccggtaaccg

SEQ ID NO: 131405 - DNA, 660 bp, Homo sapiens
  misc_feature: GYAE6OF01C2G8D.49.12.B01.1.454.CMB.1.raw
  modified_base (153)..(153): a, c, t, g, unknown or other
  misc_feature (153)..(153): n is a, c, g, or t
  modified_base (158)..(158): a, c, t, g, unknown or other
  misc_feature (158)..(158): n is a, c, g, or t
  modified_base (204)..(204): a, c, t, g, unknown or other
  misc_feature (204)..(204): n is a, c, g, or t
  modified_base (534)..(534): a, c, t, g, unknown or other
  misc_feature (534)..(534): n is a, c, g, or t
  modified_base (560)..(560): a, c, t, g, unknown or other
  misc_feature (560)..(560): n is a, c, g, or t
  modified_base (645)..(645): a, c, t, g, unknown or other
  misc_feature (645)..(645): n is a, c, g, or t
  modified_base (654)..(654): a, c, t, g, unknown or other
  misc_feature (654)..(654): n is a, c, g, or t
tcagagtcgagagacacgaccggtgctcgatttagtagtgtagattcggcgggggggacaatcttcatcatgacctgctcccctctcctcctcacccttctcattcactgcacagggtcctgggcccagtctgtgttgacgcagcccgccctnaggtntctgccggcccaggacagaaagtcaccatctcctgctcgtaggaancacgctaccaactagttaggggaaataattagtggtaattcggtaggtaccagctacgttacccgaagggaacccgccccctaagtaccctcctacgtactttacactacgaactaaacgtaacgaaacgccggtaacgtacccaagacgtacgttcccaggtaacccgtattcctagcgtcctacaaggttcctggaccacgttacaacggtccccaccgtaggaccctacgtcgaacccgtacgtccgaaggccggtacgggacgtacggacgttaattagttaccggcgaacgtactaagtcggaacttccgagtccgtagacggtntcggtacggagggtttccgtacgggnggaacgacgaacgtcgacggtacttccgtagggaccacggaccagggtccgcggtcccaggtcctacgtctcccgtccctcctancctctccgngtaccg

SEQ ID NO: 131406 - DNA, 744 bp, Homo sapiens
  misc_feature: GYAE6OF01BXKDS.49.12.B01.1.454.CMB.1.raw
  modified_base (226)..(226): a, c, t, g, unknown or other
  misc_feature (226)..(226): n is a, c, g, or t
  modified_base (247)..(247): a, c, t, g, unknown or other
  misc_feature (247)..(247): n is a, c, g, or t
tcagagtcgagagacacgaccggtgctcgatttagtagtgtagattcggcgggggggacaatcttcatcatgacctgctcccctctcctcctcacccttctcattcactgcacagggtcctgggcccagtctgtgttgacgcagccgcctcagtgtctgcgcccaggacagaaagtcaccatctcctaggcctacgtggaagcaagcctacgaacagttgggaaanaattatgtaatcggtgtaccngtcacgttccaaggaaccggtccccaagacctcctacaacttcgatacgacaaataacgaacgcgactaccgaagacgtaacttccgtaccgaaccggtatttccgtacgtcggtacccttaccgtaaacggttccgttcgggaccgacccttaggaacccgcccgtaaacccgttcgggacccttaaccgcccgtaacccgtaacgtcccccgaaaggacccgggttagggggacccgtaaggtacccgggtaactttaaagtttacctacgggacggtaaacccgtaaaggttcggggtaaacttaccgaacgtcccgttagtaacggttggtcggtacgtaggggtccgtggggtacggaacggggtaccgaacggtcgtaacggccgttacggacggtaccgaacggtcccgaaagttccgaccgggacccttccggtaactcttaccgtaccttacccgtaccctcccttaccgtcctcccgtcgttaaccg

SEQ ID NO: 131407 - DNA, 929 bp, Homo sapiens
  misc_feature: GYAE6OF01CFXAD.49.12.B01.1.454.CMB.1.raw
  modified_base (117)..(117): a, c, t, g, unknown or other
  misc_feature (117)..(117): n is a, c, g, or t
  modified_base (685)..(685): a, c, t, g, unknown or other
  misc_feature (685)..(685): n is a, c, g, or t
tcagagtcgagagacacgaccggtgctcgatttagtagtgtagattcggcgggggggacaatcttcatcatgacctgcctcccctctcctcctccacccttctcattcactgcacgnggtcctcgggcccagtctgtgttgacgcacgcccgccctcgagttcgtctcggcccggaccccaaggaacagtaaacgtccaacctactcctccgtgccgtcgtaggaacgcgacgtcctaacgaacgtaggttaagggaaacttaattacgttaggttacgttcggtacgtaaccgacgtaccgaccggttacccggaacgggtaaccccggtacccccagtacccttacccgtactacttaccgtaagtaaccggaaactaaacgtaaaccaaacggggttccgtaaaccggtccccgtaaaggtaacgttacccgttaccggaccggtaaacccgttctttaccggttccgttaaccgggtacccttacggttaaacggttccggtaccggttaccctacccgtacccgaaccgtcccccgtaacccggttaccggaaccccgtaaccggtaaccccggtaccgggtaaccccgttacccggaacgggtaacccggggttacgggggaaccggttacccgtaacggtttaccgtttaacgttaccgggacgtaccggttaaacgnggttaaccggtaccgttacgacgtccggttaggttaacgggttggtacgttacggggtagggtttacccggggtagggaaccggggtaacgacggaaccggttccggtacctcccgggttagtacccggcgacccggtaccgcgggttacccgtccccggtccgttacccgtacccttcggtacccccgttccccgtacccgtacccccgttcctacccgttccctcccgtcccggttacccgg

SEQ ID NO: 131408 - DNA, 758 bp, Homo sapiens
  misc_feature: GYAE6OF01B1UN2.49.12.B01.1.454.CMB.1.raw
  modified_base (150)..(150): a, c, t, g, unknown or other
  misc_feature (150)..(150): n is a, c, g, or t
  modified_base (201)..(201): a, c, t, g, unknown or other
  misc_feature (201)..(201): n is a, c, g, or t
  modified_base (212)..(212): a, c, t, g, unknown or other
  misc_feature (212)..(212): n is a, c, g, or t
  modified_base (351)..(351): a, c, t, g, unknown or other
  misc_feature (351)..(351): n is a, c, g, or t
tcagagtcgagagacacgaccggtgctcgatttagtagtgtagattcggcgggggggacaatcttcatcatgacctgctcccctctcctcctcacccttctcattcactgcacagggtcctgggccagtctgtgtgacgcagccgccctnagtgtctcgccggcccaggacaagaaagtcaccatctcctgctcgaggaancagctaccaanagtttagggaaataatttagtagtaacgttcggtacgggtaacccaggaccgtaaccggtttacccgaaacggggaaacccccgggacccccctaaagacccttaccctactaattacctaagttacgaaacttaaaanaaaccgaaggaccgtacgacccagtaagtacttaccgtagaccgttattcctcgtcgacctacgtaacgtcgtcggaccaccgtcaaccgtcccgaaccgtcggaccctaactacccggaacgtaccctacgtaacggtacggtacgggggaacgacggtacccgtaagtttaacgttacgcggaacgtaaacgagtacggtaacctcgacgtctaggtacgggtcggtagaccgggtggttacgggtacgggagggaacggtaaccaacgtcgtaccggaccgttacgacgggtacccgacgtaccggaccggtccggtacccggtacccgttacggacctcccggttccctccccgggttaccccctcccccggttacttacccgtccttcccgttcggtacccg

SEQ ID NO: 131409 - DNA, 693 bp, Homo sapiens
  misc_feature: GYAE6OF01D6C07.49.12.B01.1.454.CMB.1.raw
  modified_base (630)..(630): a, c, t, g, unknown or other
  misc_feature (630)..(630): n is a, c, g, or t
tcagagtcgagagacacgaccggtgctcgatttagtagtgtagattcggcgggggggacaatcttcatcatgacctgctcccctctcctcctcacccttctcattcactgcacagggtcctgggcccagtctgtgttgacgcagcccgccctcagtgtctcgccggccccaggacagaaagtcaccatctcctgctcgtggaagcagctaccaatagttagggaataattatgtatcgtgtaccagctacgtccaggaccgaccccagacctcctatacttcatacgaacaaataacagtcgacgtaccgagagtacttaccgacgtaccgtattctcgtcgacctactaacgtcgtcgacctcctacgacgacccaccgtcgacctacgtccgaccgtactaccgaggtaccggtcggggaacgtacggtaccgttaatttacgttacgacggtaccgtaaacgtggtacgggtaaccttcccggaacgtccgtaggtaggttcgggtacggttacgggtacggggttcgggtaccgggacgggggaaccggtaccggacgttcgtaacggtacccgttacgtacgggtacgaccggacccgtagggtcccgttaccgggtccccggtntccgtacccttcccgttaccccttcccgtaccccttacccttcctccttcccgtacgtacccg

SEQ ID NO: 131410 - DNA, 710 bp, Homo sapiens
  misc_feature: GYAE6OF01A0492.49.12.B01.1.454.CMB.1.raw
  modified_base (530)..(530): a, c, t, g, unknown or other
  misc_feature (530)..(530): n is a, c, g, or t
tcagagtcgagagacacgaccggtgctcgatttagtagtgtagatttcggcgggggagtcccaaccaggacacagcagtggacatgagggtccctgctcagctcctggggctcctgctgctctggctctcaggtgccagagtgtgacctagtccggatcgacccagttcctcactccctcctgtctgcctatcgtgtaggagactacgaactccaacctatccacgttcgccgacggcgaactcgtacggtactacgttacgactaaacttaatttaaacgttggtacttacgaacgtacaaaccgaaaaccggtaacggggtaaaccctacccccttaacgtccgtacgtaacttacgtaacgtaacgttcgtacctaacgttaccgttaaacggttaacggtaaacggttaccgggggttaccctaagttaaccgttaacggtttacgtaacgggtacggtaaacgggtcggtacgttacggtacgggttaacttttacgtttaaccgtcacctactactactacacncgtacacgtcctaagacgtagtactacgactaacattaacttactacgtactaactaagtactaatacttaacgttacctactaccgtacgtacgttcggacggtacggacgtacggtcgaagtactaccggtaaacacgtaggtcgctaccgtctacgtactcttcgtcttcctaaccg

SEQ ID NO: 131411 - DNA, 859 bp, Homo sapiens
  misc_feature: GYAE6OF01BO95J.49.12.B01.1.454.CMB.1.raw
  modified_base (246)..(246): a, c, t, g, unknown or other
  misc_feature (246)..(246): n is a, c, g, or t
tcagagtcgagagacacgaccggtgctcgatttagtagtgtagattcggcgggggggacaatcttcatcatgacctgctcccctctcctcctcacccttctcattcactgcacagggtcctgggcccagtctgtgttgacgcagcccgccctcagtgtctgccggcccaggacagaaagtcaccatctcctgctcgtggaagcagcctaccaatagttagggaaataattatgtatcggtgtaccngctacgttccgacggaacccggccccagacctcctctacttcgatcgaacaactaacgaagccgaacgtcccgagacgtacttccgtagacctactttccgtcgtcggtcctaccgaagttccgtacggtccaccgttcaccgtccctacccgtcggaccctaacgtcccgaccggtacctacccgtaagggtaccggtacggggtaccggacggggtacccgttaacgttttaaccggttaacggtacgggaaacccggtaaacggtaacggtttcggggtaacctttaccccggaacgggttcccgtagggtacggtttcggggtacgtttcccgggtaagggggtttcggtaacccgggggtacggggtaacgggtaacccggtaacggttccgttaccggggtaaccccggttacccgttaacggggtaccctaacccgggtaacccggttaaccggggttccccttacccccgggggttcccccggtttaccgggttaaccccttaccccgggtttaccccgtttacccccggttttaccccccgtaccccccttttacccccggttaccccgtttacccgtttcccgggttacccccggttaaccgg

SEQ ID NO: 131412 - DNA, 736 bp, Homo sapiens
  misc_feature: GYAE6OF01DFBXI.49.12.B01.1.454.CMB.1.raw
tcagagtcgagagacacgaccggtgctcgatttagtagtgtagattcggcgggggggacaatcttcatcatgacctgctcccctctcctcctcacccttctcattcactgcacagggtcctgggcccagtctgtgttgacgcagcccgccctcagtgtctgccggccccaggacaagaaagtcaccatctcctgctctaggaagcacgcctaccaaacagttaggaagtaattatgtagtcgtggtaccagcacgttaccgaggaacccgccccagacctcctctattcagtagaactaaagtaacaaggacgacgtacccgaagaagtactttccgacgtaaccgttactttctccgtcggtacctaccgaaacgttccgtcggacctaacccgtccgaacccgaccccgtaccccgtcggtacccaaccgtacccgacccggtacctaccgacggtaacggtacggggaaccgtacgggtacccttaagtttaacgttaccggtacgaacggtaactaggtacgggtaactcccgacgtcgtggtagttgggttagtcggtaggtttggttcgggtaccgggaacggggaaacggaaaccgaaccgttaccggtacccggttacccgtacgacgtacccggacccggacgttcccgccccggtaccccgttccgactcccgttccgtcccgttacccccgtcccttaccttacccggttcctccggtcgtaccg

SEQ ID NO: 131413 - DNA, 825 bp, Homo sapiens
  misc_feature: GYAE6OF01C105C.49.12.B01.1.454.CMB.1.raw
  modified_base (133)..(133): a, c, t, g, unknown or other
  misc_feature (133)..(133): n is a, c, g, or t
tcagagtcgagagacacgaccggtgctcgatttagtagtgtagattcggcggggagtcccaaccaggacacagcatggacatgagggtccctgctcagctcctggggctcctgctgctctggctctcaggtcnccaggatacgtagaaagttcccgggaatcggaaccctagtcctaccacttccctccctggtcctgactacgtcgtggtaacggacgaccaaggtactcccaaccaagttcctaacgttcggaccgaagggtccgacttaccgaagtacctaagttacgaaccttaaagttaagtttaaagttacgggtactaccgaaggtaacccgtaaacggaaacccggtaacggggtaaacctaccccctaacgtcccgtaggtacctacgtaccggtaatcgaactacgttaccgttaagttacgggtaacgtacgggtaaccctaggtaaccgtaacggtatacgggtaacggtacaggttacgacggtttacgggttaactttaacttttaccgtaccgtaacacgtttacaactttacccaacgttccgacgtacgtacggttacgtaacggtagtaaccgttacgtaaccgaaactaaacgttacgttaaccggtcaaacctaaaagttaaccttaggttaataacgttaaaccggtacctaacccgttacgtaaccgttacccgggttaaggacccgggtacgtaaccgggtacggtaaggttaccggaacgtaaccggtaacggtaaacgggttcaacgggtcgtactaacgccgttacgttacgtaccggttacctaacgtcccgttaccc

SEQ ID NO: 131414 - DNA, 770 bp, Homo sapiens
  misc_feature: GYAE6OF01EZXFP.49.12.B01.1.454.CMB.1.raw
  modified_base (155)..(155): a, c, t, g, unknown or other
  misc_feature (155)..(155): n is a, c, g, or t
  modified_base (718)..(718): a, c, t, g, unknown or other
  misc_feature (718)..(718): n is a, c, g, or t
tcagagtcgagagacacgaccggtgctcgatttagtagtgtagattcggcgggggggacaatcttcatcatgacctgctcccctctcctcctcacccttctcattcactgcacagggtcctgccgcccagtctgtgttgaccgcacgcccgcctnagtcgtctcggcccggcccaggacagtaactccaccatctcctgctcgtaggaccgacgtcctaccaagtaggttagggaataatttacgtaggttaagttccgggtaacgtaccgaggtacccgttaccggttccccggaacggtaacccccggccccaagtacccttcctactacttcaagtacgaaacctaaataacgaccggcggtaccgtcccgaaggtaccgtaccttccgacgtaccgttacttctacggtcgacccttacgaacgttcgtaccggtaacccaccgttaccgacccgacccccggtacctcgggtacccctaccggtaaccccggtacccgtaccgaacccggtaacgggtcggggtaaccggggacccgtacggtaccgtttaactacgttacggtaccgggaacggttaacgtacgggttacggtaccttccggaacgttcgtacgggtagttcgggtagttcggtcgggttacggcgggtaacggaccgtagcgtacggtacccgtcgtacggtcaccgccgtaccgacgtccgtccggtccncgttaccgccttcccggtccctccccgtacttcctcccgtccgttctaccgg

SEQ ID NO: 131415 - DNA, 806 bp, Homo sapiens
  misc_feature: GYAE6OF01DEFAY.49.12.B01.1.454.CMB.1.raw
  modified_base (116)..(116): a, c, t, g, unknown or other
  misc_feature (116)..(116): n is a, c, g, or t
  modified_base (155)..(155): a, c, t, g, unknown or other
  misc_feature (155)..(155): n is a, c, g, or t
  modified_base (201)..(201): a, c, t, g, unknown or other
  misc_feature (201)..(201): n is a, c, g, or t
  modified_base (223)..(223): a, c, t, g, unknown or other
  misc_feature (223)..(223): n is a, c, g, or t
  modified_base (611)..(611): a, c, t, g, unknown or other
  misc_feature (611)..(611): n is a, c, g, or t
tcagagtcgagagacacgaccggtgctcgatttagtagtgtagattcggcggggggacaatcttcatcatgacctgcctcccctctcctcctccacccttctcattcactgcacgngggtcctgggcccagtctgtgtgacgcacgcccgccctnagtgtccgtcggcccggaccccgaggaacaagaaacgtccaacctntcctccgtgcctcgtaggaacncagcctaccaaacgtagttaggggaaataatttagtcgttagtcggtacggtaccagccgtacggttacccgaacgggaaccccgccccagtacccttcctactattccatacgaaaccaaagtaacgacggccgaaccgtaccgagtacgtaccttccgacgtaaccgttcttccgtacgtccgtaccgtacctaaggttccgacgacctacccgtcgaacccgcccccgtacccgtggacccctacgtaccccggaccggtaccctccggaacgggtcgggtaacgggggaccgtaaccgggtccgtttaaacgtttacgtccgggtacggaacggtaaacgttcgggtacgggttaacccttccgaaccggttggttaaccgggnggtttcgggttacgggttacggggttaggggttcgggtaccgggggaacggtaaccggtaacccggtaggtcccgtacgggttacccgttaccggacggtaccgtaaccgccgggtacccggtccgaccccgggttcccgtacggtccctcggttccccttcccgtaccccctcctccctctcccttcgacctcg

SEQ ID NO: 131416 - DNA, 931 bp, Homo sapiens
  misc_feature: GYAE6OF01A3W8V.49.12.B01.1.454.CMB.1.raw
  modified_base (153)..(153): a, c, t, g, unknown or other
  misc_feature (153)..(153): n is a, c, g, or t
tcagagtcgagagacacgaccggtgctcgatttagtagtgtagattcggcgggggggacaatcttcatcatgacctgctcccctctcctcctcacccttctcattcactgcacgagggtcctggcccagtctgtgttgacgcacgccgccgtnagtgtctcgccggcccaggacagaaacgtcacctatcctcgtgcctcgtagggaacgctacgcctaccaaatagtttaggggaaattaagtttagttggtaacgttccggtacggttacctaggtccgttaacggttaccccgaagggaaccccgtccccaagtaccttcccgattactttccgaacgtagaaaacctaaacgtaaccgaacgggtaccgaaccggttacccgaaagtacggttacctttacccggtacgaaacccgtttcttttcctaccggttacggtacccgttaaccgtaaaggttcccttacggtaccctaacccgttaccgaaaccggtcccctacccgggacggtacccacgttaccccggaaaccggtccctacggaacggttacccgggaggggaaccggtacgtccgttaagtttacgtaaccggtacgggaacgtaaccggtaggttacggaacctttccggacgttaccggtagtacggggtttcggtacggttacgggtacgggtttacggggtccggggaaccgggtaaccgggtacccgtaagggttcccgggtaaccggttaccccggtacccgggttagtaaccccggaaccgggtaccccggttaaaccgggcccgggtttaaccccggtaccccggttacccggacccgttttaccccgggttaccccgttttacccccggttacccccttaaccccgtttccccggttaaaccttccccgttaaacccgggttcccgttaaaccccgg

SEQ ID NO: 131417 - DNA, 769 bp, Homo sapiens
  misc_feature: GYAE6OF01CSQC7.49.12.B01.1.454.CMB.1.raw
  modified_base (116)..(116): a, c, t, g, unknown or other
  misc_feature (116)..(116): n is a, c, g, or t
  modified_base (154)..(154): a, c, t, g, unknown or other
  misc_feature (154)..(154): n is a, c, g, or t
  modified_base (224)..(224): a, c, t, g, unknown or other
  misc_feature (224)..(224): n is a, c, g, or t
  modified_base (493)..(493): a, c, t, g, unknown or other
  misc_feature (493)..(493): n is a, c, g, or t
  modified_base (741)..(741): a, c, t, g, unknown or other
  misc_feature (741)..(741): n is a, c, g, or t
tcagagtcgagagacacgaccggtgctcgatttagtagtgtagattcggcgggggggacaatcttcatcatgacctgcctcccctctcctcctcacccttctcattcactgcacgngggtcctggcccagtctgtgtgacgcacgcccgccctngtgtctcggccggcccgaggaccaaggtaactccactactccttccgtcggtaccttcgtaggggaaccncgtaccgtaccctaaccgaagttagggttaaggaaattaatttacgtggttacgtccggtacgaccgacgtacgtaccggtacccggaaccggaaccccgtaccccgtagtacccttactccttaacttacaacgtaaccgtaaactaaaacgtaacgaaccggtaaccggtacgtaccgaacgtaccgtaccgtttacccgacggtaaccgttctttccgtaccgtcgtaccctaacggtacggtccgctacccgtcgtaccgacccncccgttacccgacgaccctaccgacccgaccgtaccgtacgacgggaggaccggacggtacgtacgttatacgtacgacggaacgtacgtgtacgtacgacgtcgtcgttacggtggtcggtggtacggtagggtcggacgggacggacggtaccgtcggttccgtaccggtcggttaccgcgggaccctacggccggtaccgtccggtcccgcccgttgacccgtccgttccctacccggttacccncccgttcctacctcctccggttcgtccg

SEQ ID NO: 131418 - DNA, 750 bp, Homo sapiens
  misc_feature: GYAE6OF01CMKVB.49.12.B01.1.454.CMB.1.raw
  modified_base (317)..(317): a, c, t, g, unknown or other
  misc_feature (317)..(317): n is a, c, g, or t
  modified_base (399)..(399): a, c, t, g, unknown or other
  misc_feature (399)..(399): n is a, c, g, or t
tcagagtcgagagacacgaccggtgctcgatttagtagtgtagattcggcgggggggacaatcttcatcatgacctgcctcccctctcctcctcacccttctcattccactgcacgacgggtcctcgggccagtctggtgtgacgcacgtcccgccctcagttgtcgtcgcccggccccaggaacagaacgtcaccatccgtcctgcctcgtaggaacgcagtacctcccgaaagtagtttaggggaataacttagtagtacgtcgtacggtaccagctagtcccgaagacccggccctagtacctctactacttanaggtcaaacaacgtaacgacgcgacgtaccaagtcctacgttccagtccgttatccgttacgcgtacctaccgtagttccgngtacccgacttcgacgtcccctacgcgaaccctcgtccccgaaccgggtccttacccggaaggtaccggaagggggcccgttaccgtaccgttaacgttaccggttaccgtacggtaaccggaacgttacggtggtaaccttccggtaccgtacggtggtcggtaggtcggttacggtcgggttacgggtcggggcggaaccgggtacggtaccgaggttaccggtacccgtacgttaccggaccgttaccggccggaaccggttccgtccccgggtacccgtcggtaccctccgttccccggtacccttccccggtacccttccgtacctttcgtacccgtcgtacccgg

SEQ ID NO: 131419 - DNA, 807 bp, Homo sapiens
  misc_feature: GYAE6OF01C0N5G.49.12.B01.1.454.CMB.1.raw
  modified_base (170)..(170): a, c, t, g, unknown or other
  misc_feature (170)..(170): n is a, c, g, or t
tcagagtcgagagacacgaccggtgctcgatttagtagtgtagattcggcggggagtcccaaccaggacacagcatggacatgagggtccctgctcagctcctggggctcctgctgctcgtcggctctcaggtcgcagatgtgacagtccggatcgacccagtcctaccncgttccctaccgtcgtctacgcgtattcgtaggtacggagaacgaagtaactaccaacctaattccgtacttacggccgtaggccgtactacgaaggtactagttacgactaaacgttttatttaaagtcggtattacgagacgtaaacgaaaccgaggaaaccctaccctaccgtactagtacctacgtaacgtatacgccgttaactaccgttaaggttaaacgtaacggtaccgggtacctaacgtcgtaacgggttcgagtaacggggagtcggtagttaccggtagggtttaactttagttttaactaccgtaaccgtaccttacgtaactaacccgtacgtactacgcgttacgtacggtattacgtaacggtactaaactacttacgttaactaacgttactaagtaacttaagtacttaacgtaactaccgtaaacccgttctaaccgttccgttaaccgggtttacggggaacccggttacgggaacccggttaacggggtaacaaccggggttaacctaaaacgggttaccgtaacggtttacgggacgttaaccccgggtgtacccgttaaaccccgttacggttttaacccgttcctttaaccggtttaaccccgttaacccccg

SEQ ID NO: 131420 - DNA, 803 bp, Homo sapiens
  misc_feature: GYAE6OF01BJPZW.49.12.B01.1.454.CMB.1.raw
  modified_base (493)..(493): a, c, t, g, unknown or other
  misc_feature (493)..(493): n is a, c, g, or t
  modified_base (503)..(503): a, c, t, g, unknown or other
  misc_feature (503)..(503): n is a, c, g, or t
tcagagtcgagagacacgaccggtgctcgatttagtagtgtagattcggcggggggggacaatcttcatcatgacctgctccctctcctcctcacccttctcattcactgcacgagggtcctgggcccagtctggtgttgacgcacgcccgcctcagtgtctacggccggcccaggacaagaacgtccacatctcctgctcgtaggaacgcagacctaccaaagtaggttagggaaattaatttagtacgttaacgtccgggttacgtaaccacgtaccgttaccggttaccccggaaaccgggaaccccgggaccccctaacggtacccttacccctattaaccgttaccgtaacgttacggaaaacctaaaacgtaaaccgaacggttacggaacccgtacccgaaggttaccgttacttaccgtacgtaaccgttacttccgtcgtccggtactaaccgtacggtcgtaccgtacctaccctacgacccnccctacccgnggacccacggtacccgaaccgtaccgacgtacggtacggacggggtacgacgttactaacgttccgttaacggacgaacttacggtaacggttcggtaactaccggtacggtacgttagggtcggttacggttccgggtaacggttcggggggtttaccggaacgggccgggtaacggtaacccggtaggtaacccggttcgtaccgggtacgtaccgacggacggtaaccgtcgggaccggtccgtcccgtgtacccgtcttccccgtaccctccctcctactcctccgtcgtctccgg

SEQ ID NO: 131421 - DNA, 269 bp, Homo sapiens
  misc_feature: GYAE6OF01BGWRN.49.12.B01.1.454.CMB.1.raw
  modified_base (253)..(269): a, c, t, g, unknown or other
  misc_feature (253)..(269): n is a, c, g, or t
tcagagtcgagagacacgaccggtgctcgatttagtagtgtagattccgcgggcacgaccggtgctcgatttagtagtgtagattccgcgggcgacgaccggtgctcgatttagagagagtgtgttgggttgggggaagaggaagactgacggtccccccaggagttcaggtgctgggcacagcggccctgggctgcctggtcaaaggactacttcctctctcgactctgagcgggctggcaaggcgcatagnnnnnnnnnnnnnnnnn

SEQ ID NO: 131422 - DNA, 751 bp, Homo sapiens
  misc_feature: GYAE6OF01AHBAJ.49.12.B01.1.454.CMB.1.raw
  modified_base (162)..(162): a, c, t, g, unknown or other
  misc_feature (162)..(162): n is a, c, g, or t
  modified_base (260)..(260): a, c, t, g, unknown or other
  misc_feature (260)..(260): n is a, c, g, or t
  modified_base (298)..(298): a, c, t, g, unknown or other
  misc_feature (298)..(298): n is a, c, g, or t
  modified_base (319)..(319): a, c, t, g, unknown or other
  misc_feature (319)..(319): n is a, c, g, or t
  modified_base (349)..(349): a, c, t, g, unknown or other
  misc_feature (349)..(349): n is a, c, g, or t
  modified_base (358)..(358): a, c, t, g, unknown or other
  misc_feature (358)..(358): n is a, c, g, or t
  modified_base (364)..(364): a, c, t, g, unknown or other
  misc_feature (364)..(364): n is a, c, g, or t
  modified_base (372)..(372): a, c, t, g, unknown or other
  misc_feature (372)..(372): n is a, c, g, or t
tcagagtcgagagacacgaccggtgctcgatttagtagtgtagattcggcgggggggacaatcttcatcatgacctgctcccctctccttcctcctacccttctcattcactcgcacacggttcctgggccctagtcctggttgtgacgcacgccgacctcngtgtctcggccgcccaggacagtaaagccactattcctctgctctggaaccgtacgctaccaacggttagtagggaattattgttgactcggtcgacncgtatacggttacccgacggacccgtcccatacctccntactgctagaactaactaacncgctacgcctaagcttactcgtacgacgtnttacccgtntaccgnttacgacncgtcgctacctacgccgcctacccgcgtaccactacccggacccgtaaccgttccggaacgttacgggggaaccgggtaccggtaacggtaccgttaactttaaccgttaccggtaacggtaccggtaaacgttacgggtaagtcccggtaacgttacgggtccgtggtttaaccggttgggtacggtcggggttacgggttcgggttacgggcgggaaccgtaccggtacggtaccgtacggtacccgtacgggtccgaaaccgggtcgttacccgtacgggtaccggttcccgtacccggttacggtccccgttcgttaccccgttacccgttccccgttaaccccttgtaccccctttgtcccgttcgttacccgg

SEQ ID NO: 131423 - DNA, 181 bp, Homo sapiens
  misc_feature: GYAE6OF01CVV7T.49.12.B01.1.454.CMB.1.raw
  modified_base (171)..(181): a, c, t, g, unknown or other
  misc_feature (171)..(181): n is a, c, g, or t
tcagagtcgagagacacgaccggtgctcgatttagtagtgtagattccgcgggcacgaccggtgctcgatttagtcacgcgagaaagggaaagggggctggccctgacgtgtttctgttccccgcctcctctctctcgactctggagcgggtctggacaaggcgacatagnnnnnnnnnnn

SEQ ID NO: 131424 - DNA, 597 bp, Homo sapiens
  misc_feature: GYAE6OF01CB4CW.49.12.B01.1.454.CMB.1.raw
  modified_base (136)..(136): a, c, t, g, unknown or other
  misc_feature (136)..(136): n is a, c, g, or t
  modified_base (197)..(197): a, c, t, g, unknown or other
  misc_feature (197)..(197): n is a, c, g, or t
  modified_base (202)..(202): a, c, t, g, unknown or other
  misc_feature (202)..(202): n is a, c, g, or t
  modified_base (204)..(204): a, c, t, g, unknown or other
  misc_feature (204)..(204): n is a, c, g, or t
  modified_base (268)..(268): a, c, t, g, unknown or other
  misc_feature (268)..(268): n is a, c, g, or t
  modified_base (277)..(277): a, c, t, g, unknown or other
  misc_feature (277)..(277): n is a, c, g, or t
  modified_base (290)..(290): a, c, t, g, unknown or other
  misc_feature (290)..(290): n is a, c, g, or t
  modified_base (292)..(292): a, c, t, g, unknown or other
  misc_feature (292)..(292): n is a, c, g, or t
  modified_base (316)..(316): a, c, t, g, unknown or other
  misc_feature (316)..(316): n is a, c, g, or t
  modified_base (360)..(360): a, c, t, g, unknown or other
  misc_feature (360)..(360): n is a, c, g, or t
  modified_base (363)..(363): a, c, t, g, unknown or other
  misc_feature (363)..(363): n is a, c, g, or t
  modified_base (372)..(372): a, c, t, g, unknown or other
  misc_feature (372)..(372): n is a, c, g, or t
  modified_base (398)..(398): a, c, t, g, unknown or other
  misc_feature (398)..(398): n is a, c, g, or t
  modified_base (419)..(419): a, c, t, g, unknown or other
  misc_feature (419)..(419): n is a, c, g, or t
  modified_base (439)..(439): a, c, t, g, unknown or other
  misc_feature (439)..(439): n is a, c, g, or t
  modified_base (459)..(459): a, c, t, g, unknown or other
  misc_feature (459)..(459): n is a, c, g, or t
tcagagtcgagagacacgaccggtgctcgatttagtagtgtagattcggcgggggagtcccaaccaggacacagcatggacatgagggtccctgctcagctcctggggctccgtgctgctctggcctctcgaggtnccagatgtgacatccggatcgacccagtcctccatccctccctgtctaaagcatctgaganacganancacatcatagcagcgactcagacatagactaatattaattgatacagacagaaaccgaggaacncccctaacncctagatacacgntnacatctaaattgaaagtcggctancagttcaggtgaatggatggtaggactttgtttactcgaacctntanctactaccngtcctaagctagtacggtatcgttanaacctaagattactttaacgnttaaccaaagtataaggtanaacttaataccccgttaacncgtacgtttaaccggttcgggaccgggaaggccccgtaaggggactaaacggtacgttaacccggtaaacctaaggtcgggtaacggaccttacggacccttaataacgttcccttaaagttcccttaaacggtaccc

SEQ ID NO: 131425 - DNA, 295 bp, Homo sapiens
  misc_feature: GYAE6OF01BMUKQ.49.12.B01.1.454.CMB.1.raw
  modified_base (246)..(246): a, c, t, g, unknown or other
  misc_feature (246)..(246): n is a, c, g, or t
  modified_base (257)..(257): a, c, t, g, unknown or other
  misc_feature (257)..(257): n is a, c, g, or t
  modified_base (263)..(295): a, c, t, g, unknown or other
  misc_feature (263)..(295): n is a, c, g, or t
tcagagtcgagagacacgaccggtgctcgatttagtagtgtagattccgcgggcgacgaccggtgctcgatttagtagtgtagattccgcgggcacgaccggtgctcgatttagagagagtgtggttggggttggggggaagaggaagctggaccggtccccccaggagttcgaggtcgcgtgggcacgagccggcccgtggctcgcctggtcaaggtactaccttctctctcgactctgagcggngtggacaggcngatagnnnnnnnnnnnnnnnnnnnnnnnnnnnnnnnnn

SEQ ID NO: 131426 - DNA, 856 bp, Homo sapiens
  misc_feature: GYAE6OF01AFXZA.49.12.B01.1.454.CMB.1.raw
  modified_base (387)..(387): a, c, t, g, unknown or other
  misc_feature (387)..(387): n is a, c, g, or t
  modified_base (510)..(510): a, c, t, g, unknown or other
  misc_feature (510)..(510): n is a, c, g, or t
  modified_base (517)..(517): a, c, t, g, unknown or other
  misc_feature (517)..(517): n is a, c, g, or t
  modified_base (527)..(527): a, c, t, g, unknown or other
  misc_feature (527)..(527): n is a, c, g, or t
tcagagtcgagagacacgaccggtgctcgatttagtagtgtagattcggcgggggggactaattttcatcatgacctgcctcccctctcctcctccacccttctcacttcactgccacgacgggtcctcgggcccagtctgtgttcggacgcgacgcccgcccgtctaggtcgtcgtcggcccggaccccgaaggaaccgtaaggtaaaccgtccaaccgtacgttccttaccgtcgtaccttacgggttaacggaacgtaccgtacgtacccttaacctaaacggtaggttagggggaaaacttagtttacggtagtacgttaccggtacggaacctcggtccgtaccggtacccgaaccgggaacccgaccctacgtaccttccncgtttaacgtctaacggtaaccgtaaataaacggttaaacggaccggtaccgtaaccgacggtataaccgttactccgtaacggttctactcttcggaccgttccgtaatcggtaccgttccncctaacncccggacccnccgtacccggtcgaacctcgtaaccaccggtacctagggaacggtacgcgggtaaccgtactagtacgtacggtacgtacgtacgtaacgagttacgtacgttacgtaccgtcggtacgttacgggtagtccgggtacggtcggggtaccgggtaccgggtaacgggtacgggacccgttaacggcgttaaccggtcccgtacgtaccgggtacaccggtacggtaccgtaccgggcccgttacccggtcgtaccgttaccctcccgttacccgttacccttacccgttcccgtacgttaacccggttcctacccgttaggtacccggg

SEQ ID NO: 131427 - DNA, 797 bp, Homo sapiens
  misc_feature: GYAE6OF01CNJZP.49.12.B01.1.454.CMB.1.raw
  modified_base (66)..(66): a, c, t, g, unknown or other
  misc_feature (66)..(66): n is a, c, g, or t
  modified_base (158)..(158): a, c, t, g, unknown or other
  misc_feature (158)..(158): n is a, c, g, or t
  modified_base (381)..(381): a, c, t, g, unknown or other
  misc_feature (381)..(381): n is a, c, g, or t
  modified_base (773)..(773): a, c, t, g, unknown or other
  misc_feature (773)..(773): n is a, c, g, or t
tcagagtcgagagacacgaccggtgctcgatttagtagtgtagattcggcgggggggacaatcttnatcatgacctgcctcccctctcctcctccacccttctcattcactgcacacggtccgtcgggccagtctggtgttgacgcacgcccgccctnagtgtcgcgccggcccaggacaagaaacgtcaaccatctccgtgctcgaggaaacgcacgcctaaccaaagtaggttaacggaaagtaaactttagttagtaagtccgtacggtaacgacgacttacggttacccgaaacgggtaacccggccccaagtaccgtactactacttacaataacggaaaactaaactaaacgaacgtcgaacgtacccgagtaanaccgtttaccacgtactattccgtacgtacgacttcccgaaggtccctaggaccactacgacgaccctaaccgcggacaacgtccgaaacccggtctaccggaaggtaaccggtacggggaacgtaacgggtacgttaagtttaacgtacggaacggaacgtaaaccgtaggttaacggtaaaccgtttccggaacgtacgggtacggtaacggttcgggagtttaccgggtaaggggtccggtaacggggtaacggtaacggaaccgtagttaccgtacccggtaacgttaccggacgggtacctaaccgtaccgggaaacggttccggtacccgggtaaccttcgggtcccaccggttaccgttacccctaccccgtacccgtttacccnctttacccggtcttccgtaaccgg

SEQ ID NO: 131428 - DNA, 852 bp, Homo sapiens
  misc_feature: GYAE6OF01A7B21.49.12.B01.1.454.CMB.1.raw
  modified_base (141)..(141): a, c, t, g, unknown or other
  misc_feature (141)..(141): n is a, c, g, or t
  modified_base (152)..(152): a, c, t, g, unknown or other
  misc_feature (152)..(152): n is a, c, g, or t
  modified_base (423)..(423): a, c, t, g, unknown or other
  misc_feature (423)..(423): n is a, c, g, or t
tcagagtcgagagacacgaccggtgctcgatttagtagtgtagattcggcgggggggacaatcttcatcatgacctgctccctctcctcctcacccttctcattcactgcacgagggtcctgggcccagtctgtgttgacncgagccgcctngtgtctgcggcccaggacagaagtcacatctctgctcgtagaagcacgtctaccgaacgtagttacgggaaagtaatttagtacgttagtcgggtacggtaaccacgtacgtaccgttacccgaacgggaccccgccccgaagtaccttcctactagttcagttacgaaacaagtaacgagtccggaacgtaccaaggtactccttcgacggtaccttacttcgtcgtacgaccttaaccgaacgttcgtacggtacccacgtacgaaccncccgtaacccgtcggcccctaacgtcccgaacccggtacctacccggaggtaaccggttacggggaacgtacgggtaccttaacgtttaacgttaccgacgggtaaacgtaacgtacggttacggttaacttaccggacggtacgttacgggtacggtttacgggtcgttacggggttaaggggtttccgggtacgggggttaacgggaaacgggttaacccgtacgggttaacccggtaccgggttaaccccggtttaccggtaccgggtaccccgtaacgggaaccccggtacgggttaccccgggttcccggtacccccggtttaccggggtacccttcccggtttaccccgggtttaccccggttccccccgtccccgttttaaccccgtcttaccccggtttaaccccgtcggtttaaccccgg

SEQ ID NO: 131429 - DNA, 833 bp, Homo sapiens
  misc_feature: GYAE6OF01CAQ1E.49.12.B01.1.454.CMB.1.raw
  modified_base (158)..(158): a, c, t, g, unknown or other
  misc_feature (158)..(158): n is a, c, g, or t
  modified_base (207)..(207): a, c, t, g, unknown or other
  misc_feature (207)..(207): n is a, c, g, or t
  modified_base (472)..(472): a, c, t, g, unknown or other
  misc_feature (472)..(472): n is a, c, g, or t
tcagagtcgagagacacgaccggtgctcgatttagtagtgtagattcggcgggggggacaatcttcatcatgacctgcctcccctctcctcctcacccttctcattccactgcacagggtcctgggcccagtctgtgttcgacgcacgcccgtccctnacgtgtcctcggaccggaccccgagggaacaaggaaagtccaaaccgtnttccgtcctgacctcgtacgggacgaccgagtacccctacgaaacgtaggttacggggaaataatttgtagtaacgtccggtacggtaccacggtcctaccggttaccgaacgggtaacccggcccccgaacgtaccttacctcgtaacttcgtaattaacggaaacttaaacgaaaccgaacggtacccgacgtacccgaaggtacgtacgttaccctacgacgtacttcgtcgtacggtcctaccgaagtccgtacgactccncgtaccgcccgccgtaccgacctaccgtaccgacccgacgtaccgacggacggtacggggaacggacgtaccgtaatttcgtaaccgtacgggtacgaacgttagtaacgggtactccgtaacggtccgtaggtacggtcggttacggtacggtacgggtttaccgcggggtaaccgggaacggtaaccgtacgtacggtaccgtacccgggttacgtaaacgggtccaacccgggtacccggacgggttccccgtacccgggttcccccgttagggtcccgttaaccggtcccctttaacccggtccccccgttaccccgtttcccgtacgttccccctcccgtacggtttaacccccgg

SEQ ID NO: 131430 - DNA, 762 bp, Homo sapiens
  misc_feature: GYAE6OF01B7TNB.49.12.B01.1.454.CMB.1.raw
  modified_base (199)..(199): a, c, t, g, unknown or other
  misc_feature (199)..(199): n is a, c, g, or t
tcagagtcgagagacacgaccggtgctcgatttagtagtgtagattcggcggggagtcccaaccaggacacagcatggacatgagggtccctgctcagctccgtggggctcctgctgctctggctctcaggtcgccagatgtgacagtccggatcgacccagtcctccactccctccctgtctgctatcgtggtagganacaagaactccaaccagtccacttcgccgagggcactacgaggactagttaacgacttaactttaattttaaagtgtaactacgaagaccgaaacggaaaccggaacgggaaccctaccccttaaacctccgtagactccgtacgatgacctacgtactaaggttaggaaacgtcgggtaccagtacgtaaggttcaggtacggaagtgagttcgtaggtaactttactttacttaccaactatcaactacctaacgtgactaggtccgtaaggaacgttaattacgtacgaaacctaacttaagtttaacgtttactaagaaacccttaaaataaccgttaaagttaattaaacccgttaacctaacccttaaccccgtaactttacccgggtttaaccgggttacggggaacccggggtaaacggtacccggtagggggttaaaccgaaaacgtaaccggttaaaaccggtaaaacccggttgggttcggtcccgggtaaaccttacgaacccctaaccgttacggtttcctttacccggttaaactttcctaaaccccgg

SEQ ID NO: 131431 - DNA, 254 bp, Homo sapiens
  misc_feature: GYAE6OF02I1T0O.49.12.B01.1.454.CMB.1.raw
  modified_base (252)..(254): a, c, t, g, unknown or other
  misc_feature (252)..(254): n is a, c, g, or t
tcagagtcgagagacacgaccggtgctcgatttagtagtgtagattccgcgggcacgaccggtgctcgatttagtagtgtagattccgcgggcacgaccggtgctcgatttagagagagtgtgttgggtttgggggaagaggaagactgacggtcccccaggagttcaggtgctgggcacagcggccctgggctgcctggtcaaaggactacttcctctctcgactctgagcgggctggcaaggcgcatagnnn

SEQ ID NO: 131432 - DNA, 164 bp, Homo sapiens
  misc_feature: GYAE6OF02IQ2PT.49.12.B01.1.454.CMB.1.raw
  modified_base (164)..(164): a, c, t, g, unknown or other
  misc_feature (164)..(164): n is a, c, g, or t
tcagagtcgagagacacgaccggtgctcgatttagtagtgtagattccgcgggcacgaccggtgctcgatttagtcacgcgagaagggaaaggggctggccctgacgtgttctgttcccgccctcctctctctcgactctgagcgggctggcaaggcgcatagn

SEQ ID NO: 131433 - DNA, 164 bp, Homo sapiens
  misc_feature: GYAE6OF02H2V1V.49.12.B01.1.454.CMB.1.raw
  modified_base (164)..(164): a, c, t, g, unknown or other
  misc_feature (164)..(164): n is a, c, g, or t
tcagagtcgagagacacgaccggtgctcgatttagtagtgtagattccgcgggcacgaccggtgctcgatttagtcacgcgagaaagggaaaggggctggccctgacgtgttctgttcccgcctcctctctctcgactctgagcgggctggcaaggcgcatagn

SEQ ID NO: 131434 - DNA, 192 bp, Homo sapiens
  misc_feature: GYAE6OF02IGOJS.49.12.B01.1.454.CMB.1.raw
  modified_base (192)..(192): a, c, t, g, unknown or other
  misc_feature (192)..(192): n is a, c, g, or t
tcagagtcgagagacacgaccggtgctcgatttagtagtgtagattccgcggggatttagtagtgtagattccgcgggcacgaccggtgctcgatttagtcacgcgagaaagggaaagggggctggccctgacgtgtttctgttcccgccctcctctctctcgactctgagcgggctggcaaggcgcatagn

SEQ ID NO: 131435 - DNA, 220 bp, Homo sapiens
  misc_feature: GYAE6OF02F3HG9.49.12.B01.1.454.CMB.1.raw
  modified_base (212)..(220): a, c, t, g, unknown or other
  misc_feature (212)..(220): n is a, c, g, or t
tcagagtcgagagacacgaccggtgctcgatttagtagtgtagattccgcgggcacgaccggtgctcgatttagagagagtgtgttgggtttgggggaagaggaagactgacggtcccccaggagttcaggtgctgggcacagcggccctgggctgcctggtcaaggactacttcctctctcgactctgagcgggctggcaaggcgcatagnnnnnnnnn

SEQ ID NO: 131436 - DNA, 163 bp, Homo sapiens
  misc_feature: GYAE6OF02FE3VN.49.12.B01.1.454.CMB.1.raw
tcagagtcgagagacacgaccggtgctcgatttagtagtgtagattccgcgggcacgaccggtgctcgatttagtcacgcgagaagggaaggggctggccctgacgtgtttctgttcccaccctcctctctctcgactctgagcgggctggcaaggcgcatag

SEQ ID NO: 131437 - DNA, 252 bp, Homo sapiens
  misc_feature: GYAE6OF02IBM58.49.12.B01.1.454.CMB.1.raw
  modified_base (250)..(252): a, c, t, g, unknown or other
  misc_feature (250)..(252): n is a, c, g, or t
tcagagtcgagagacacgaccggtgctcgatttagtagtgtagattccgcgggcgacgaccggtgctcgatttagtagtgtagattccgcgggcgacgaccggtgctcgatttagagagagtgtgttggtttggggaagaggaagactgacggtcccccaggagttcaggtgctgggcacagcggccctggctgcctggtcaaggactacttcctcgtagcactctgagcgggctggcaaggcgcatagnnn

SEQ ID NO: 131438 - DNA, 224 bp, Homo sapiens
  misc_feature: GYAE6OF02FFG1Q.49.12.B01.1.454.CMB.1.raw
  modified_base (210)..(224): a, c, t, g, unknown or other
  misc_feature (210)..(224): n is a, c, g, or t
tcagagtcgagagacacgaccggtgctcgatttagtagtgtagattccgcgggcacgaccggtgctcgatttagagagagtgtgttgggttgggggaagaggaagactgacggtcccccaggagttcaggtgctgggcacagcggccctgggctgcctggtcaaggactacttcctctctcgactctgagcggctggcaaggcgcatagnnnnnnnnnnnnnnn

SEQ ID NO: 131439 - DNA, 212 bp, Homo sapiens; identical to SEQ ID NO: 131348
  misc_feature: GYAE6OF02GUYQ2.49.12.B01.1.454.CMB.1.raw
  modified_base (212)..(212): a, c, t, g, unknown or other
  misc_feature (212)..(212): n is a, c, g, or t

SEQ ID NO: 131440 - DNA, 167 bp, Homo sapiens; identical to SEQ ID NO: 131331
  misc_feature: GYAE6OF02FLG0Y.49.12.B01.1.454.CMB.1.raw
  modified_base (167)..(167): a, c, t, g, unknown or other
  misc_feature (167)..(167): n is a, c, g, or t

SEQ ID NO: 131441 - DNA, 170 bp, Homo sapiens
  misc_feature: GYAE6OF02H987V.49.12.B01.1.454.CMB.1.raw
  modified_base (162)..(170): a, c, t, g, unknown or other
  misc_feature (162)..(170): n is a, c, g, or t
tcagagtcgagagacacgaccggtgctcgatttagtagtgtagattccgcgggcacgaccggtgctcgatttagtcacgcgagaaggaaggggctggccctgacgtgtttctgttcccacctcctctctctcgactctgagcgggctggcaaggcgcatagnnnnnnnnn

SEQ ID NO: 131442 - DNA, 330 bp, Homo sapiens
  misc_feature: GYAE6OF02G6I0Z.49.12.B01.1.454.CMB.1.raw
  modified_base (327)..(330): a, c, t, g, unknown or other
  misc_feature (327)..(330): n is a, c, g, or t
tcagagtcgagagacacgaccggtgctcgatttagtagtgtagattccgcgggcacgaccggtgctcgatttagcatactctacagggacaacgccaagaactcactgtatctgcaaatgaacagcctgagagccgaggacacggccgtatattactgtgcgagagttatccctcacggtgacaatcgctatttctacgacggtatggacgtctggggccaagggaccacggtcgccgtctcctcagcctccaccaagggcccatcggtcttccccctggcgcccctcctctctctcgactctgagcgggctggcaaggcgcatagnnnn

SEQ ID NO: 131443 - DNA, 214 bp, Homo sapiens; identical to SEQ ID NO: 131351
  misc_feature: GYAE6OF02JW5KN.49.12.B01.1.454.CMB.1.raw
  modified_base (212)..(214): a, c, t, g, unknown or other
  misc_feature (212)..(214): n is a, c, g, or t

SEQ ID NO: 131444 - DNA, 248 bp, Homo sapiens
  misc_feature: GYAE6OF02HQW3T.49.12.B01.1.454.CMB.1.raw
  modified_base (248)..(248): a, c, t, g, unknown or other
  misc_feature (248)..(248): n is a, c, g, or t
tcagagtcgagagacacgaccggtgctcgatttagtagtgtagattccgcgggcacgaccggtgctcgatttagctctacgctcagggcacgaccggtgctcgatttagagagagtgtgttgggtttgggggaagaggaagactgacggtccccccaggagttcaggtgctgggcacagcggccctgggctgcctggtcaaggactacttcctctctcgactctgagcgggctggcaaggcgcatagn

SEQ ID NO: 131445 - DNA, 165 bp, Homo sapiens; identical to SEQ ID NO: 131354
  misc_feature: GYAE6OF02IBESG.49.12.B01.1.454.CMB.1.raw

SEQ ID NO: 131446 - DNA, 276 bp, Homo sapiens
  misc_feature: GYAE6OF02GY9CO.49.12.B01.1.454.CMB.1.raw
  modified_base (266)..(276): a, c, t, g, unknown or other
  misc_feature (266)..(276): n is a, c, g, or t
tcagagtcgagagacacgaccggtgctcgatttagtagtgtagattccgcgggcacgaccggtgctcgatttagtagtgtagattccgcgggcacgaccggtgctcgatttagagagagtgtggttgggtttgggggaagaggaagactgacggtcccccaggagttcaggtgctgggcacagccggccgtgggctgccgtggtacaacggtacttacttcctctctcgactcgtggacggcgggctggacgaaggccgatagagnnnnnnnnnnn

SEQ ID NO: 131447 - DNA, 312 bp, Homo sapiens
  misc_feature: GYAE6OF02FVT11.49.12.B01.1.454.CMB.1.raw
  modified_base (276)..(312): a, c, t, g, unknown or other
  misc_feature (276)..(312): n is a, c, g, or t
tcagagtcgagagacacgaccggtgctcgatttagtagtgtagattccgcggggcacgaccggtgctcgagtttagtacgtgtacgagttccgttagggcgacgtaccggtgtcgtcgatttacgaggagagtagtgttgggtttggggggaagaggaagactggacggttccccccgaggagttcaggtgcttgggcacagcggtaccctgggcctgcctggtcaaggactacttcctctctcgactctggagcgggctggcaaggcggcatagnnnnnnnnnnnnnnnnnnnnnnnnnnnnnnnnnnnnn

SEQ ID NO: 131448 - DNA, 550 bp, Homo sapiens
  misc_feature: GYAE6OF02J1JJG.49.12.B01.1.454.CMB.1.raw
tcagagtcgagagacacgaccggtgctcgatttagtagtgtagatttcgtcggggagtcccaaccaggacacagcagtggacatgagggtccctgctcagctcctggggctccttgctgctctggctctcaggtgccagatgtgacatccggatgacccagttctccatccctccctgtctgcatcgtgtaggagaccagaatcaccatcacttcgccaggcgactctaggaccattacgacaactatttaaacttggtattcagcagaaacagggtaaagcccctaactcctgatctacgattgcatccaattagaaattacggggtccatcaaggttcagtggaagtggatcgtaggtacgttatttactttcacctatctatcaacctgctagcctgagtatattgcaacattaattactagttacaactaatactagtaactaatacttacctactctactttacggcggtaggacctacggtgagtatacgaaaacgtactaggtacggcttacgacaccgtaacttctacgttcttactaaccg

SEQ ID NO: 131449 - DNA, 166 bp, Homo sapiens; identical to SEQ ID NO: 131357
  misc_feature: GYAE6OF02GM2RX.49.12.B01.1.454.CMB.1.raw
  modified_base (165)..(166): a, c, t, g, unknown or other
  misc_feature (165)..(166): n is a, c, g, or t

SEQ ID NO: 131450 - DNA, 166 bp, Homo sapiens
  misc_feature: GYAE6OF02HDUUH.49.12.B01.1.454.CMB.1.raw
  modified_base (166)..(166): a, c, t, g, unknown or other
  misc_feature (166)..(166): n is a, c, g, or t
tcagagtcgagagacacgaccggtgctcgatttagtagtgtagattccgcgggcacgaccggtgctcgatttagtcacgcgagaaagggaaagggggctggccctgacgtgtttctgttcccgcctcctctctctcgactctgagcgggctggcaaggcgcatagn

SEQ ID NO: 131451 - DNA, 202 bp, Homo sapiens
  misc_feature: GYAE6OF02FZ9L0.49.12.B01.1.454.CMB.1.raw
  modified_base (173)..(202): a, c, t, g, unknown or other
  misc_feature (173)..(202): n is a, c, g, or t
tcagagtcgagagacacgaccggtgctcgatttagtagtgtagattccggcgggcacgaccggtgctcgatttagtcacgcgagtaaagggaaagggggcttggcccttgacgtgtttctgttcccaccctcctctctctcgactctgagcgggtctggcaaggcgcattagnnnnnnnnnnnnnnnnnnnnnnnnnnnnnn

SEQ ID NO: 131452 - DNA, 1025 bp, Homo sapiens
  misc_feature: GYAE6OF02G3116.49.12.B01.1.454.CMB.1.raw
tcagagtcgagagacacgaccggtgctcgatttagtagtgtagattcgtcgggggtagtcccgaaccaggacacaggcacttgggaccagtgacgggtacccgtgtcctctaggctcctggggctcctggctgctctgggcctacctcagggtagccgagtatggtgacgtacttccgggtatgtaccctaggtcgtccatcctccctgtcgtgcatcgtggtaggtagacgaggaatcaccgtacttcgacctttggaccaagggtcccgtacgttccgaacgggtacctacgttttaaggacctaaaccgttaattttaaaaccgtttgggttaagttacctaacggtaccttaaagggtaaaaaccccgttaagggggttaaaaaccggtacccccccttaaaaccgttcccgttacggtaacggttcccgttaacccggtaagttaccggacccgaaagggttaccccggtaaagtttttacgggggaaaaacggttttacgggggggttaccccctaaacgttaacccgtaaaagggttttaacccgtaaagggtttacggggtaaaaggggttaaggggtaaaacgtttaaccggtttagggggttaaaccggtttttaacgttttttaacccgttttaccgtaaacccggttaagttacccgggtaacgtttacccttaaaacccgttgggtaacccctaacgggtacccccgtttagggaaaccgggttaacgttaaacggtttaccggaaaccgtaaaccgttacttaaacgtttttaaccgtacggttaacctaaactaaagtttaaactaaggtaaactttaaacgtcccttaaaccgtaaccgtttacgtaacccgttttacggggacccggggtaacgggaacccgttacgggggttacggtaacgttacgttaaccggtaaaacggtaaccggtttagggtaacggaccgtttacggaacccgttaaccgttaacgtttcccggttacgtttttaccgttacttaccccgg

SEQ ID NO: 131453 - DNA, 213 bp, Homo sapiens
  misc_feature: GYAE6OF02JDGTA.49.12.B01.1.454.CMB.1.raw
  modified_base (212)..(213): a, c, t, g, unknown or other
  misc_feature (212)..(213): n is a, c, g, or t
tcagagtcgagagacacgaccggtgctcgatttagtagtgtagattccgcgggcacgaccggtgctcgatttagagagagtgtgttgggtttgggggaagaggaagactgatggtcccccaggagttcaggtgctgggcacagcggccctgggctgcctggtcaaggactacttcctctctcgactctgagcgggctggcaaggcgcatagnn

SEQ ID NO: 131454 - DNA, 213 bp, Homo sapiens
  misc_feature: GYAE6OF02FQVOP.49.12.B01.1.454.CMB.1.raw
  modified_base (212)..(213): a, c, t, g, unknown or other
  misc_feature (212)..(213): n is a, c, g, or t
tcagagtcgagagacacgaccggtgctcgatttagtagtgtagattccgcgggcacgaccggtgctcgatttagagagagtgtgttgggtttgggggaagaggaagactgacggtcccccaggagttcaggtgctgggcacagcggccctgggctgcctggtcaaggactacttcctctctcgactctgagcgggctggcaaggcgcatagnn

SEQ ID NO: 131455 - DNA, 164 bp, Homo sapiens
  misc_feature: GYAE6OF02FHL2R.49.12.B01.1.454.CMB.1.raw
  modified_base (164)..(164): a, c, t, g, unknown or other
  misc_feature (164)..(164): n is a, c, g, or t
tcagagtcgagagacacgaccggtgctcgatttagtagtgtagattccgcgggcacgaccggtgctcgatttagtcacgcgagaaaggaaggggctggccctgacgtgtttctgttcccaccctcctctctctcgactctgagcgggctggcaaggcgcatagn

SEQ ID NO: 131456 - DNA, 530 bp, Homo sapiens
  misc_feature: GYAE6OF02GZ4DL.49.12.B01.1.454.CMB.1.raw
  modified_base (223)..(223): a, c, t, g, unknown or other
  misc_feature (223)..(223): n is a, c, g, or t
  modified_base (308)..(308): a, c, t, g, unknown or other
  misc_feature (308)..(308): n is a, c, g, or t
tcagagtcgagagacacgaccggtgctcgatttagtagtgtagatttcggcgggggggacaatcttcatcatgacctgctcccctctcctcctcacccttctcattcactgcacagggtcctgggcccagtctgtgttgacgcagccgccctctagtgtctgcggtccctaggacagaaagtcaccatctcctgctctggaagcaggctccaacattgggaanaattatgtatcgtggtaccagcagttcccaggacgccccagactcctcattcatgacaataacaagcgagtcccagacgattccngaccgattctcgtggctaccgaagtcgtgcactcagccacctggccatcaccgactccagacgtggggacaggccgtaattacgttactgacggaacagtgggattccgagcctgacgtggtgtcgtagggtgttcggcggacgggaccagcgtgaccgttcgaggtcacgccgaggctcggccctggtcactcgtcgtcccgcctcctccgtctctcgtac

SEQ ID NO: 131457 - DNA, 612 bp, Homo sapiens
  misc_feature: GYAE6OF02IDY5A.49.12.B01.1.454.CMB.1.raw
  modified_base (200)..(200): a, c, t, g, unknown or other
  misc_feature (200)..(200): n is a, c, g, or t
  modified_base (326)..(326): a, c, t, g, unknown or other
  misc_feature (326)..(326): n is a, c, g, or t
  modified_base (422)..(422): a, c, t, g, unknown or other
  misc_feature (422)..(422): n is a, c, g, or t
tcagagtcgagagacacgaccggtgctcgatttagtagtgtagattcggcggggggacaatcttcatcatgacctgcctccctctcctcctccacccttctcattcactgcacagggtcctgggcccagtctgtgttgacgcagccgccctcagtgtctgccggccccaggacagaagtcaccatctcctgctctggaancagctaccaactagttagggaaataatttatgtaatcggtaggtaccagcacgttcccaaggaaccggcccccagacctactaattcatgaacaataacaagacgagtccccaagagtacttaccngaccgtattctctggtcctacaagtctggaccacctcacgccaccctggccatccaccggctccagacgtgggacgacggccgtatttacttacgngacggaacagtgggacttccagtcctgtagtggtgtcgtagggtcgtcgggcggacgggaccgagccgtacggaccgtccgtaggtcacgacccgaggtccgtccggtccccgttcggtaccaccgttcccgttcccggttccccctaccccgttcccgttaccttccctccgttacccgaccttaccgg

SEQ ID NO: 131458 - DNA, 166 bp, Homo sapiens
  misc_feature: GYAE6OF02I6VK2.49.12.B01.1.454.CMB.1.raw
tcagagtcgagagacacgaccggtgctcgatttagtagtgtagattccgcgggcacgaccggtgctcgatttagtcacgcgagaaagggaaagggggctggccctgacgtgtttctgttcccaccctcctctctctcgactctgagcgggctggcaaggcgcatag

SEQ ID NO: 131459 - DNA, 254 bp, Homo sapiens
  misc_feature: GYAE6OF02FHR29.49.12.B01.1.454.CMB.1.raw
  modified_base (251)..(254): a, c, t, g, unknown or other
  misc_feature (251)..(254): n is a, c, g, or t
tcagagtcgagagacacgaccggtgctcgatttagtagtgtagattccgcgggcgacgaccggtgctcgatttagtagtgtagattccgcgggcacgaccggtgctcgatttagatcgtctgtgttgggtttgggggaagaggaagactgacggtcccccaggagttcaggtgctgggcacagcggccctgggctgcctggtcaaggctacttcctctctcgactctgagcgggctggcaaggcgcatagnnnn

SEQ ID NO: 131460 - DNA, 185 bp, Homo sapiens
  misc_feature: GYAE6OF02JGVOC.49.12.B01.1.454.CMB.1.raw
  modified_base (169)..(185): a, c, t, g, unknown or other
  misc_feature (169)..(185): n is a, c, g, or t
tcagagtcgagagacacgaccggtgctcgatttagtagtgtagattccgcgggcgacgaccggtgctcgatttagtcacgcgagaaagggaaagggggctggccctgaccgtgtttctgttcccaccctcctctctctcgactctgagcgggctggcaaggcgcatagnnnnnnnnnnnnnnnnn

SEQ ID NO: 131461 - DNA, 681 bp, Homo sapiens
  misc_feature: GYAE6OF02HACHA.49.12.B01.1.454.CMB.1.raw
tcagagtcgagagacacgaccggtgctcgatttagtagtgtagattcggcgggggagtcccaaccaggacacagcatggacatgagggtccctgctcagctcctggggctcctgctgctctggctctcaggtgccagatgtgacatccggatcgaccctagtcctccactccctccctgtctgcatctggtaggagacagaactcacatctacttcgccgaggcgactacgaaggactagttaacgacctaaactttaatttaaagttaggtatacgaagacaaacgaaaccgaagggaaacctacccctaacctcctagactaccgtaacgatcgacctactacctaaagtttaggaaacgttacgggtacctagtacgtaaggttcgaaggtacggtaaggtgtagtcgtagggtacgttttacttttacgtacactatcacttacaactgtacacgtcgtaggtagtattagtacgaactaagtattaattaacgtactaacaaattaaacttataagttaactaaacttacccttaacctacctttaccgttaacggtttccgggaacggtaacgggtaccgtagggtacggaacgtaaccgaaccggtaaacggttacgtacggtacggacctccgaacctaccggtattcccgtttacttaccgttactacccgg

SEQ ID NO: 131462 - DNA, 775 bp, Homo sapiens
  misc_feature: GYAE6OF02HYGG2.49.12.B01.1.454.CMB.1.raw
tcagagtcgagagacacgaccggtgctcgatttagtagtgtagattcggtcggtagggggggaacaagtacttcatcgacctggaccttgcgtccctctccgtcctcacccttcgtccagttcacgtcgcgacaagggtccttcgggtcccagtctgttggttagacggcgacggccgcccgtcaggtgtctgccggcccaggacagaaagtcaccatctcctgctctggaagcagctccaacattgggaagaattatgtatcgtggtacagcagttccaggaaccggccccagacctctcattcatagacaataaacaagacgacgtacccagacgtattcctagaccgtattcttcgtcggccttaccaaggttccgtgggaccacccttcgacggcccaacccgtcggacccaagtccgaacccgggtacttaccccaggtaaccggtacgggggggaaccgacgggaccgtaagtttaacgtttacgtaggtacgggtaaacctaagggttacggggtactttaccggaacgtacccgttaggtacgggttgggttacgtccggtaagggggtttcggtttcgggggacggggttaacggggaccgaaagggtccgttaccggtaacccggttaccggtacggttaccgaccggtacccgtaacgggtccggtcccggtccccgttccgggccgttaacccgtttccggttcccgggtttacccccgtcccccgtttacccggttccctttccccgttacccgttacccgg

SEQ ID NO: 131463 - DNA, 687 bp, Homo sapiens
  misc_feature: GYAE6OF02FM9O8.49.12.B01.1.454.CMB.1.raw
tcagagtcgagagacacgaccggtgctcgatttagtagtgtagatttcggtcggggagtcccaaccaggacacagcactggacatacgagggtccctgctcagctcctgggctcctgctgctctggctctcaggttgccagatgtgacataccggatcgaccctacgtcgtccatcctccctgtctgcatcgtgtaggagacagaatccaccgatcacttgaccgtaggccgtactccaaggacctattaggactaacttaattttaaacttcggtaatacagaccaagtaaaccgagggaaacgcccccgtaaccgtccgtagtactactaacgactgacgacgtacctaaagttggaaagtacgggtacccctaagtactaaggttcagtaggtaagtggtacttcgtacgggtacgtttacgttttaccgtttaccacctacgttacctaagtaccaacctcgacctacgtacctagtaacggactaagtacgtacaactagttaacttacgtacggtaccaactaatactagtaacttaacgtacctaacctaaccgttacctaaccgtttaccgggaacggtaccgggtaaccgtacgggtaggacgtaacgtaccgaaaccggtacgtacggtacgtccgtacgacctaccggtactccgttcgtaccgtttcgtacccgg

SEQ ID NO: 131464 - DNA, 190 bp, Homo sapiens
  misc_feature: GYAE6OF02HKOYU.49.12.B01.1.454.CMB.1.raw
  modified_base (160)..(190): a, c, t, g, unknown or other
  misc_feature (160)..(190): n is a, c, g, or t
tcagagtcgagagacacgaccggtgctcgatttagtagtgtagattccgcgggcacgaccggtgctcgatttagtagtgtagattccgcgggcacgaccggtgctcgatttagtagtgtagattccgaggcggtgtcgacgaacgggccgactaagtagnnnnnnnnnnnnnnnnnnnnnnnnnnnnnnn

SEQ ID NO: 131465 - DNA, 168 bp, Homo sapiens
  misc_feature: GYAE6OF02GEVUB.49.12.B01.1.454.CMB.1.raw
  modified_base (167)..(168): a, c, t, g, unknown or other
  misc_feature (167)..(168): n is a, c, g, or t
tcagagtcgagagacacgaccggtgctcgatttagtagtgtagattccgcgggcacgaccggtgctcgatttagtcacgcgagaaagggaaagggggctggccctgacgtgtttctgttcccaccctcctctctctcgactctgagcgggctggcaaggcgcatagnn

SEQ ID NO: 131466 - DNA, 168 bp, Homo sapiens
  misc_feature: GYAE6OF02GRJ0O.49.12.B01.1.454.CMB.1.raw
  modified_base (167)..(168): a, c, t, g, unknown or other
  misc_feature (167)..(168): n is a, c, g, or t
tcagagtcgagagacacgaccggtgctcgatttagtagtgtagattccgcgggcacgaccggtgctcgatttagtctgatcgagaagggaaagggggctggccctgacgtgtttctgttcccaccctcctctctctcgactctgagcgggctggcaaggcgcatagnn

SEQ ID NO: 131467 - DNA, 665 bp, Homo sapiens
  misc_feature: GYAE6OF02HSIY4.49.12.B01.1.454.CMB.1.raw
  modified_base (127)..(127): a, c, t, g, unknown or other
  misc_feature (127)..(127): n is a, c, g, or t
  modified_base (428)..(428): a, c, t, g, unknown or other
  misc_feature (428)..(428): n is a, c, g, or t
tcagagtcgagagacacgaccggtgctcgatttagtagtgtagattcggtcgggggtaggtcccaaccaggacacagcatggacatgagggtccctgctcagctcctggggctctgctgctctgctntcaggtgccagatgtgacatccggatgaccagtctcatcctcctgtctagctatcgtgtaggatacgagaactcaccatcacgttgacctagggccgacgtcgacggtactagttagactaacttaatttaatgtatacagcaagaacgaggaacgtcccctaaccgtcctaggacttctaacgatcgcaacgtccgaagttttaggaaaacgttagggtcctaagtcgtaaggttcaaggttggaagtggtatcgtagggtactttcgtttacttcactatccgtatccaacttgcctanccgtaggtagacttagtacgactaataattacttacgttcgaactaaactaagtataacgtaacgttaacttaccgtaacctaccgttacgttaacccggtttacggggaacccggggtacggtaacccggtaacgggttagggaacgttaactaacccgggtaaaagaccgttacgggtacggtaactaccggtcctaaccggttacttacccggtttagttccttacgtaccccg

SEQ ID NO: 131468 - DNA, 219 bp, Homo sapiens
  misc_feature: GYAE6OF02FUP4F.49.12.B01.1.454.CMB.1.raw
  modified_base (214)..(219): a, c, t, g, unknown or other
  misc_feature (214)..(219): n is a, c, g, or t
tcagagtcgagagacacgaccggtgctcgatttagtagtgtagattccgcgggcacgaccggtgctcgatttagagagagtgtgttgggtttggggggaagaggaagactgacggtccccccaggagttcaggtgctgggcacagcggccctgggctgcctggtcaaggactacttcctctctcgactctgagcgggctggcaaggcgcatagnnnnnn

SEQ ID NO: 131469 - DNA, 253 bp, Homo sapiens
  misc_feature: GYAE6OF02F2W9J.49.12.B01.1.454.CMB.1.raw
  modified_base (252)..(253): a, c, t, g, unknown or other
  misc_feature (252)..(253): n is a, c, g, or t
tcagagtcgagagacacgaccggtgctcgatttagtagtgtagattccgcgggcacgaccggtgctcgatttagtagtgtagattccgcgggcacgaccggtgctcgatttagagagagtgtgttgggtttgggggaagaggaagactgacggtccccccaggagttcaggtgctgggcacagcggccctgggctgcctggtcaaggactacttcctctctcgactctgagcgggctggcaaggcgcatagnn

SEQ ID NO: 131470 - DNA, 166 bp, Homo sapiens; identical to SEQ ID NO: 131458
  misc_feature: GYAE6OF02F73UV.49.12.B01.1.454.CMB.1.raw

SEQ ID NO: 131471 - DNA, 216 bp, Homo sapiens
  misc_feature: GYAE6OF02JM6LH.49.12.B01.1.454.CMB.1.raw
  modified_base (152)..(152): a, c, t, g, unknown or other
  misc_feature (152)..(152): n is a, c, g, or t
  modified_base (201)..(202): a, c, t, g, unknown or other
  misc_feature (201)..(202): n is a, c, g, or t
  modified_base (204)..(216): a, c, t, g, unknown or other
  misc_feature (204)..(216): n is a, c, g, or t
tcagagtcgagagacacgaccggtgctcgatttagtagtgtagattccgcgggcacgaccggtgctcgatttagtagtgtagattccgcgggcacgaccggtgctcgatttagtcacgcgagaaaggaaggggctggccctgacgtgtttcngttcccgcctcctctctctcgactctgagcggctggcaaggcgcatagnncnnnnnnnnnnnnn

SEQ ID NO: 131472 - DNA, 264 bp, Homo sapiens
  misc_feature: GYAE6OF02JK1WL.49.12.B01.1.454.CMB.1.raw
  modified_base (252)..(264): a, c, t, g, unknown or other
  misc_feature (252)..(264): n is a, c, g, or t
tcagagtcgagagacacgaccggtgctcgatttagtagtgtagattccgcgggcaccgaccggtgctcgatttagtagtgtagattccgcgggcacgaccggtgctcgatttagagagagtgtgttgggtttgggggagaggaagactgacggtccccccaggagttcaggtgctgggcacagcggccctgggctgcctggtcaaggctacttcctctctcgactctgagtcgggctggcaaggcgcatagnnnnnnnnnnnnn

SEQ ID NO: 131473 - DNA, 209 bp, Homo sapiens
  misc_feature: GYAE6OF02HF5HS.49.12.B01.1.454.CMB.1.raw
  modified_base (206)..(209): a, c, t, g, unknown or other
  misc_feature (206)..(209): n is a, c, g, or t
tcagagtcgagagacacgaccggtgctcgatttagtagtgtagattccgcgggcacgaccggtgctcgatttagtcgagctcctcgcgggcacgaccggtgctcgatttagtacgtcatcagggaaagggcgcacactgcacatcgttggttgggcatcgaaccggacaacgctgaactggtgagcgggctggcaaggcgcatagnnnn

SEQ ID NO: 131474 - DNA, 686 bp, Homo sapiens
  misc_feature: GYAE6OF02H80IR.49.12.B01.1.454.CMB.1.raw
  modified_base (264)..(264): a, c, t, g, unknown or other
  misc_feature (264)..(264): n is a, c, g, or t
tcagagtcgagagacacgaccggtgctcgatttagtagtgtagattcggcgggggggggacaatcttcatcatgacctgcctcccctctcctcctcacccttctcattcactgcacgagggtcctgggcccagtctggtgtgacgcacgcccgccctgagtgtctcggccggcccaggacagaagtccaccatcctctgctcgtaggaagcagtcctaccaataggttagggaaataatttagtctaacgtcggacggtaaccngcctaacgtcccgaacgggaaccccggtcccctaagacccttctactaagttcgaatagaaaactaaactaacgagaccgtactaccgaagtacgtaccttccggacgaccttatccgttacgcgtacctacgaagttcgaccgaccacctcaccgtccctacgcgaccctacgacctaccgtacacgaggtacggggtacgggacgacggtacctattacgtacggaggtaccgaaagtcggtacggtactacggacctcgtaggtcggttagtcgggtagtagggtcggttacggggacgggaaccgtacgaacgtcgtaccgtaccgttcggacgtaccgacgaccggacgccggtccgtcccgtcggtctacgtccgttaccccgtccctcccggttcctccgtccgtcgtaccgtcg

SEQ ID NO: 131475 - DNA, 234 bp, Homo sapiens
  misc_feature: GYAE6OF02FH9LW.49.12.B01.1.454.CMB.1.raw
  modified_base (214)..(234): a, c, t, g, unknown or other
  misc_feature (214)..(234): n is a, c, g, or t
tcagagtcgagagacacgaccggtgctcgatttagtagtgtagattccgcgggcacgaccggtgctcgatttagagagagtgtgttgggtttggggggaagaggaagactgacggtccccccaggagttcaggtgctgggcacagcggccctgggctgcctggtcaaggactacttcctctctcgactctgagcgggctggcaaggcgcatagnnnnnnnnnnnnnnnnnnnnn

SEQ ID NO: 131476 - DNA, 169 bp, Homo sapiens
  misc_feature: GYAE6OF02IGNPA.49.12.B01.1.454.CMB.1.raw
  modified_base (165)..(169): a, c, t, g, unknown or other
  misc_feature (165)..(169): n is a, c, g, or t
tcagagtcgagagacacgaccggtgctcgatttagtagtgtagattccgcgggcacgaccggtgctcgatttagtcacgcgagaagggaaaggggctggccctgacgtgtttctgttcccaccctcctctctctcgactctgagcgggctggcaaggcgcatagnnnnn

SEQ ID NO: 131477 - DNA, 798 bp, Homo sapiens
  misc_feature: GYAE6OF02HT1B0.49.12.B01.1.454.CMB.1.raw
  modified_base (238)..(238): a, c, t, g, unknown or other
  misc_feature (238)..(238): n is a, c, g, or t
  modified_base (697)..(697): a, c, t, g, unknown or other
  misc_feature (697)..(697): n is a, c, g, or t
tcagagtcgagagacacgaccggtgctcgatttagtagtgtagattcggcggggggggacaatcttcatcatgacctgctcccctctcctcctcacccttctcattcactgcacagggtcctgggcccagtctgtgttgacgcagcccgccctcagtgtctgccggccccaggacagaaagtcaccatctcctgctcgagaagcagcctacaaactagttagggaagtaaatttagtntaagtcgtagtaccagctacgttaccgaaggtaacccggaccccagtaacctcctcaattcaacgtgaaactaaacaaacgaacgacgtacgtaacccgagtaacgtacttaccgtacgtaacccgtacttttaccgtccgttacggtaccttacccgtaaacgttcgtacggtacctaaccctcgaaccgtacccctaacccgttacggaacccctaacgttacccgaaacccggtaccgtacccgtaacggtaccggtacgggggaaccgaacggggtaccctaaaaacgttttcgttaaacgtcgggaaaccgtaaactagggttaccgggaactttaccgacggtacggttaaggtacgggttagttaccgtagggtaacggggtttcgggttacggggaccggtaaacggggaaccctaaggtccgcgtttaaacccgtcggtaaacggtaccnccgggtaaaccgacggttccgacccgggtaccccgtcggttaacctacgtcccgttcccgttcccgcccgttaccgtttcccaccctttcggacccttacg

SEQ ID NO: 131478 - DNA, 762 bp, Homo sapiens
  misc_feature: GYAE6OF02F7E4A.49.12.B01.1.454.CMB.1.raw
  modified_base (375)..(375): a, c, t, g, unknown or other
  misc_feature (375)..(375): n is a, c, g, or t
  modified_base (577)..(577): a, c, t, g, unknown or other
  misc_feature (577)..(577): n is a, c, g, or t
tcagagtcgagagacacgaccggtgctcgatttagtagtgtagattcggcggggggggacaatcttcatcatgacctgctcccctctcctcctcacccttctcattcactgcacagggtcctgggcccagtctgtgttgacgcagccgcctcagtgtctgccggcccaggacagaaagtcacatctcctgctctggaagcagctaccaactagttaggggaataattatgtactcggtaggtaccagctacgttcccgaacggaacccggcccccagtacctccctacgtaactttacacgtacgaaactaaaacgtaaaccaaacggtaccggtaaccgtaccccgaagaacgtaacttcccgtaggaaccgtntttccctcggtacggtaccgttacccgtaagttccggtacggccctaaccgtacgaccgaccctacccgtcgtacccgtaactacccggaacccggtaccctaccgaacggaccggtaacgggggacggaacgggtacccttaagtttacgtacgtacggacggtaaacgtggtaacgggtactccggacgttccggttagnggttacgggtgttcgggtacgggttcgggtcggacggggaggtaccgaggtccgtacggtaccgttccggtaacggtccgaccggaccgtacgggccggtccgggtccccgtgggttaccctaccgttcccgtttacccgtccccttacccgttccctacccgtttcctaccggtcccttaacgg

SEQ ID NO: 131479 - DNA, 333 bp, Homo sapiens
  misc_feature: GYAE6OF02H53HG.49.12.B01.1.454.CMB.1.raw
  modified_base (257)..(257): a, c, t, g, unknown or other
  misc_feature (257)..(257): n is a, c, g, or t
  modified_base (265)..(333): a, c, t, g, unknown or other
  misc_feature (265)..(333): n is a, c, g, or t
tcagagtcgagagacacgaccggtgctcgatttagtagtgtagattccgcgggcacgaccggtgctcgatttagtagtgtagattccgcgggcacgaccggtgctcgatttagagagagtgtgttgggtttggggggaagaggaagactgaccggtccccccaggagttcaggtgctgggcacagcggccctgggctgcctggtcgaaggactacttcctctcacgtactctgagcgggcgtggtacgaacggcganaacgtagnnnnnnnnnnnnnnnnnnnnnnnnnnnnnnnnnnnnnnnnnnnnnnnnnnnnnnnnnnnnnnnnnnnnn

SEQ ID NO: 131480 - DNA, 607 bp, Homo sapiens
  misc_feature: GYAE6OF02GAJHT.49.12.B01.1.454.CMB.1.raw
  modified_base (147)..(147): a, c, t, g, unknown or other
  misc_feature (147)..(147): n is a, c, g, or t
  modified_base (214)..(214): a, c, t, g, unknown or other
  misc_feature (214)..(214): n is a, c, g, or t
  modified_base (245)..(245): a, c, t, g, unknown or other
  misc_feature (245)..(245): n is a, c, g, or t
tcagagtcgagagacacgaccggtgctcgatttagtagtgtagattccgcgggcacgaccggtgctcgtttagagagagtgtgttgggtttgggggtgggtccaggaggcagaactctggggtgtctcaccatggcctggatccctntacttctcccctctcactctctgcacagactctgagcctctatgagctgacacagccacccgtggtntctgtgtcctcgaggacacgacggctagtancactgctcgtggagatgcattcgaccaaagcaatagtcgtacttacgtcggtaccagcaacgaagccgaggccacggccctgttctagacttatatttaataagtactttggaggtacggctacggaccggtaccctagacgtcgtattccgtcgtacgcctacgacgctacgacgaccgaactaacgtacgtaccgtaccggtacgaactactcgtaggtcggacgggtaccggacgacgggaacggagacggtcgacgtaacttagtacgtacgactagttcacgtacgtaacggtaatacgggttaagtacgacctttcgttaccgttggttacgtcggttacgggacgggtaaccggg

SEQ ID NO: 131481 - DNA, 311 bp, Homo sapiens
  misc_feature: GYAE6OF02J2TJ0.49.12.B01.1.454.CMB.1.raw
  modified_base (186)..(186): a, c, t, g, unknown or other
  misc_feature (186)..(186): n is a, c, g, or t
  modified_base (200)..(200): a, c, t, g, unknown or other
  misc_feature (200)..(200): n is a, c, g, or t
  modified_base (258)..(258): a, c, t, g, unknown or other
  misc_feature (258)..(258): n is a, c, g, or t
  modified_base (262)..(311): a, c, t, g, unknown or other
  misc_feature (262)..(311): n is a, c, g, or t
tcagagtcgagagacacgaccggtgctcgatttagtagtgtagattccgcgggcacgaccggtgctcgatttagtagtgtagattccgcgggcacgaccggtgctcgatttagagagagtgtgttgggtttggggggaagaggaagactgaccggtccccccaggagttcacggtgcgtgggcacngtcggccctgggcnggccctggtcaaggactacgtcctcgtagcactctgagcggctcggcctaaggcgtcntagnnnnnnnnnnnnnnnnnnnnnnnnnnnnnnnnnnnnnnnnnnnnnnnnnn

SEQ ID NO: 131482 - DNA, 685 bp, Homo sapiens
  misc_feature: GYAE6OF02IQU0X.49.12.B01.1.454.CMB.1.raw
  modified_base (155)..(155): a, c, t, g, unknown or other
  misc_feature (155)..(155): n is a, c, g, or t
  modified_base (186)..(186): a, c, t, g, unknown or other
  misc_feature (186)..(186): n is a, c, g, or t
  modified_base (196)..(196): a, c, t, g, unknown or other
  misc_feature (196)..(196): n is a, c, g, or t
  modified_base (203)..(203): a, c, t, g, unknown or other
  misc_feature (203)..(203): n is a, c, g, or t
  modified_base (513)..(513): a, c, t, g, unknown or other
  misc_feature (513)..(513): n is a, c, g, or t
tcagagtcgagagacacgaccggtgctcgatttagtagtgtagattcggcgggggggggacaatcttcatcatgacctgcctcccctctcctcctcacccttctcgattcactgcacagggtcctggcccagtctgtgttgacgcagcccgcctnagtgtctgaccggcccaggacagaagtcacntcctctgctntaggaancagtcctaccaacgtagttcgggaaataatttgtcgttaagtccggtacggtaccagtcgtaccgtttacccgaacggacccggtcccccaagtacccgttcctactacgttcaagttacgaactaaataaccgaacgcgtacgtacccgagtacgtactcgtacgtacgtcttcgtcgtacgtcctactaggttctaccggctacccgtcaaccggtccctaccgtcggacctacgtaccacccggtactacccggacgtacgggtacgggaccacggggtacctagttaaactcggacgaaccgtagngtacgacctcgacgtcgtagtagtcggtagtacggtggtcggtacggacggtacggacctaggccgttcgacgtaccgtaggccgtaaccgtcggtacgccggttaccggcccttacggtccacgttcccggtcctaccccgtcccgtacttccggtcttccgtactaccgg

SEQ ID NO: 131483 - DNA, 249 bp, Homo sapiens
  misc_feature: GYAE6OF02HJ5XQ.49.12.B01.1.454.CMB.1.raw
  modified_base (214)..(249): a, c, t, g, unknown or other
  misc_feature (214)..(249): n is a, c, g, or t
tcagagtcgagagacacgaccggtgctcgatttagtagtgtagattccgcgggcacgaccggtgctcgatttagagagagtgtgttgggtttggggggaagaggaagactgacggtccccccaggagttcaggtgctgggcacagcggccctgggctgcctggtcaaggactacttcctctctcgactctgagcgggctggcaaggcgcatagnnnnnnnnnnnnnnnnnnnnnnnnnnnnnnnnnnnn

SEQ ID NO: 131484 - DNA, 506 bp, Homo sapiens
  misc_feature: GYAE6OF01B19RM.41.36.D03.1.454.CMB.1.raw
  modified_base (396)..(396): a, c, t, g, unknown or other
  misc_feature (396)..(396): n is a, c, g, or t
  modified_base (469)..(469): a, c, t, g, unknown or other
  misc_feature (469)..(469): n is a, c, g, or t
  modified_base (482)..(482): a, c, t, g, unknown or other
  misc_feature (482)..(482): n is a, c, g, or t
tcagtctatactatcacgaccggtgctcgatttagctgcgtcacgatctctcttgggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtctgggggagagcggcccagcctgggaacctccctgagactctcctgtgcagcctctggattcatcttcaggacctatgccatgcacgtgggtccgccaggctccaggcaaggggctgggagtgggtggcaattatatcagaagatggaattgaagacactaggagactcgagaagggcgatcaccgtcncagagacattccagacacactgacatctgacaaatgtaacaacctcacaagtgagacgacggctgtactattnttgtgacgagacncccccgtcgacggcccggtccccg

SEQ ID NO: 131485 - DNA, 610 bp, Homo sapiens
  misc_feature: GYAE6OF01AJN10.41.36.D03.1.454.CMB.1.raw
  modified_base (313)..(313): a, c, t, g, unknown or other
  misc_feature (313)..(313): n is a, c, g, or t
  modified_base (391)..(391): a, c, t, g, unknown or other
  misc_feature (391)..(391): n is a, c, g, or t
tcagtctatactatcacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccaggcctcccaggctcctcatccatgatgcatccaacgngggtcccctggccgtcccagacctagggttccgtggctaggtcgggtctggggacaggagtttcacgtctccaccgtnagcacgccgtggagcctgattgtattttgcgttagtttactttctgtcagtcacgtcgttcccgccacgcccgtacgtccgtaccgtttccgggccggggggtacccgtacgggggtaggacggtacgtacgggacggtaaccgggtaacgttcgggtgggtccgttcggaccgtacccgtacgttccgttacggtttcctttccgtccgtttaccccg

SEQ ID NO: 131486 - DNA, 676 bp, Homo sapiens
  misc_feature: GYAE6OF01D4MIN.41.36.D03.1.454.CMB.1.raw
tcagtctatactatcacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgtttatttacaaggtgtcagagtgaagtgcagttggtggaggtccgggggagtacgttggtccaggccgtgggacgggtcccctggacgactctcctgtgtccgcctcgtggtattccacctatcagtacgacctactatagtcggacgttcggggtcccgccgaggccgtccggaagggggaaggggtcgtagggaggttgggcgttcgggcccgacgtaaacggtaaaaaaacctaaaggttcgacctaaggtaccttttaatccgaaacgaggtaacggtaacccgcccggtcgttcgtaggtacggaaacgtccaagtacttcccaaccctctaacaagatatacgaccttacgaagtaactatattgatttcagaacgtatacgaaccttaaccgtaacggaaaaccggaggaaccgacgggctaagtttaggttaatttaggtttgttagtttagttagttttaacagttaccgtaaggttaaaccgttgtaaccccgg

SEQ ID NO: 131487 - DNA, 600 bp, Homo sapiens
  misc_feature: GYAE6OF01C9WCF.41.36.D03.1.454.CMB.1.raw
  modified_base (203)..(203): a, c, t, g, unknown or other
  misc_feature (203)..(203): n is a, c, g, or t
  modified_base (265)..(265): a, c, t, g, unknown or other
  misc_feature (265)..(265): n is a, c, g, or t
  modified_base (295)..(295): a, c, t, g, unknown or other
  misc_feature (295)..(295): n is a, c, g, or t
  modified_base (355)..(355): a, c, t, g, unknown or other
  misc_feature (355)..(355): n is a, c, g, or t
tcagtctatactatcacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagccaccctctcctgcagggccagtaggagtgtcagtaagtacttaggctggtaaccaanagaaacctggccaggcctccgaggcctccncatccatgatgcatccaacgacgggtcccctaggccgtacccaggaccgacgggttccgnggctaggtggggtctggggacagagttcactctcaccgtcagcagcctggcgcctgattgtattttcgctagttttacttcttgtcagtctagtccgttccgccgaccgtcccgcgttccgtaccggtttcggggaccgggggtaccgtaggggtggacgtagtaggaacggtaccggtaacgttgggtacggtcgtcggtacccgtaaccgtacgttccgttagttccttcgtaccgttccccg

SEQ ID NO: 131488 - DNA, 722 bp, Homo sapiens
  misc_feature: GYAE6OF01BRKUE.41.36.D03.1.454.CMB.1.raw
  modified_base (207)..(207): a, c, t, g, unknown or other
  misc_feature (207)..(207): n is a, c, g, or t
tcagtctatactatcacgaccggtgctcgatttagctgcgtcacgatctctcgttgggggaggaactgctcagttaggaccagagggaccatggaagccccagctcagcttcttcttcctcctgctactctggcctccagactaccaaccggtaaaattgtgttgacacacgtctccgaggccacctgtctctgtctcgagggcacncgcccacctctcctgcgacggtccgagtacggagtcgtacgtaagtaagtacgtaggacgtacggtaaccaacgaacgaaccgtcggaccgacggcctacccgaggtctcctacactccgagtcgactcgaccgtactacccgaacggtccggtacccgtcgggtcccaccgaagtccggtacggttccggtacggcggtaggttgggtacggttaggaacgtgtacgtctcaccgttcgacgtcgagacctagtccgtagtcgccgttagtacgttagtactttaggacttagtcttaacgtgtactacgtaacgacggttctaacgtaacggttcgtaaccgtaccgcctttacggttaccgggttaccgggaccgggttaaacgggaaccgtaacgggggagtaaacccgtaaacggtaaaccgaaacgggtttaacgcggggttaccggaccttacccggaccgtttaaccctaccgggtttatacccgtttaacgtttaccggtaccccg

SEQ ID NO: 131489 - DNA, 890 bp, Homo sapiens
  misc_feature: GYAE6OF01BDE76.41.36.D03.1.454.CMB.1.raw
  modified_base (226)..(226): a, c, t, g, unknown or other
  misc_feature (226)..(226): n is a, c, g, or t
tcagtctatactatcacgaccggtgctcgatttagctgcgtcacgatctctcttggggagctctgagagcggacgccccagccccagaattccccaggttgttttcatttggtgatcagcactgaacacagaggactcaccagtgggagttcgggctggagtcgttgggttttcttgtttgtttattttacgaaggtgtccagtagtagaagtgcgtaggttgggngggtacgggtccgggggagtacgttcgggttccaggtccgtcgggacgggtccctaggacgtaccttccgtcctggtcgtcccgtccgttcgtaggtacttaccacctacgtcgaggttacgaaccctattaagtacggtacgggtaccggttcggggtccccgaccggacgggtaccgtaccgggaagggggtaacggggcgtagggggtagggtcgggtccggttaccgggacccgtaaacgtaaaaacggttaaaaaacgtaacggttaccgaccgttaacgttaccgttttaacgaccgtaaacggaaacgggtaaccggtacccggtacccggttaccggttacggttaacggtaaccggaaaaccggtaccgtaacggttaccctttaacccccgaaacccgtttaccgaaacgtaaacggtacgtaacgttaaccgttaaacgttaaccgtaaaccgtaacctttacgttaacgtttacgtaactttaccggtacgtaaaccgttaaccgtaaccggttaaacccgtaaccgtaaaacccgggaaaccggaagggaacccggtaacgggtacttaaaggtttacgttagttttaaggttcggtttaggtttagtttaagtttaatacgttaacggtacgttacgtacggtacccggg

SEQ ID NO: 131490 - DNA, 891 bp, Homo sapiens
  misc_feature: GYAE6OF01CCOYY.41.36.D03.1.454.CMB.1.raw
  modified_base (178)..(178): a, c, t, g, unknown or other
  misc_feature (178)..(178): n is a, c, g, or t
  modified_base (758)..(758): a, c, t, g, unknown or other
  misc_feature (758)..(758): n is a, c, g, or t
tcagtctatactatcacgaccggtgctcgatttagctgcgtcacgatctctcgttgggggaggaactgctcagttaggacccagagggaaccatggaacgccccagctcagcttcctccttcctctgctactcgtggcctcccagactaacccgaacggtaaaaattgtgttgacacngtcctccgaggccaccctgtctcgtgtccgtccggagggacgacacgccctacccttcctccgtgcgagggcctaggtaggagttcgacgtaaggttaacgtacgttacggaccgtaggtaaacccaaacggaaccggtaaacccgtccgggaccgtaccggtacccttacccgaacgtaacccgttcccttacgtttaaagttttgttttaccgggttttacccttaacccgtttacccgggaacgggggttccccgttaccggtttaccggttaacccgtccccgtaacgggtaccccggttagggtttacccgtaacgggtcgtacccggtacgggggttcgggttaccggtaagggggaactacggttacgtttacccgaacccgttcctacccgaacgtcgaacgtccgtaccgtccggtaacggtaccgtcgtaacggtcggttagtttacgtttcggttacgtttaaccgttttacgtcccgttaggtaccgaacgttaccgtaccgggtttccctccccggaccgttcccggccgttacccgtccggtttaaccggggtttccccggggggngggggttaacccgtagggggttacggaacgtaacggaaacccggttaacgtaaccgggttgtccggcgtacccgaacggttacctcccgttcgttcccgttactccgttaacccttcccttccgtcccttagg

SEQ ID NO: 131491 - DNA, 714 bp, Homo sapiens
  misc_feature: GYAE6OF01EG5OO.41.36.D03.1.454.CMB.1.raw
  modified_base (141)..(141): a, c, t, g, unknown or other
  misc_feature (141)..(141): n is a, c, g, or t
  modified_base (147)..(147): a, c, t, g, unknown or other
  misc_feature (147)..(147): n is a, c, g, or t
  modified_base (160)..(160): a, c, t, g, unknown or other
  misc_feature (160)..(160): n is a, c, g, or t
tcagtctatactatcacgaccggtgctcgatttagctgcgtcacgatctctcttggggatcacataacaaccacactcctcctctaaagaagcccctgggagcacagctcatcaccatgactggactggcgttcctcttgnggtgcngcagctacaggtntccagtcccgaggtcgcagtcgtggtacgcagtcgtggggctgaggtagaagacgtcgtacggtcctcggtagtaacggtcctccgtgacgtaaggtcttcgtagggacgtcctaccttcgtacagtccttaagttcgttactttttaggttcgggtacgaccggtaccgaccggtccccgtaggaaccgtaacgggtcttacggaggtcggacgttggggaacggtactctacccgttcccttagtttccggtttaggacgtacgtaacggtactaaacggttacgacgtaaacgtaacggtaaccgttaggaacggtaacgtacgtaccgtacctaaccgttacgtaccggacggtaacaacctccggaacgtaacgtaccgaacgtacctagtaggacggagtacgtgaacgaccggtagcggtaagtagtaacttacggaacgaacggaccgtacccacgttcgtttaaacctttggtacttaggacggtacggtacctaacccgttcccttaacgttacttaaccgttcttaacccgttccgtaacccg

SEQ ID NO: 131492 - DNA, 663 bp, Homo sapiens
  misc_feature: GYAE6OF02G4SA1.41.36.D03.1.454.CMB.1.raw
  modified_base (419)..(419): a, c, t, g, unknown or other
  misc_feature (419)..(419): n is a, c, g, or t
  modified_base (482)..(482): a, c, t, g, unknown or other
  misc_feature (482)..(482): n is a, c, g, or t
tcagtctatactatcacgaccggtgctcgatttagctgcgtcacgatctctcttggggagctctgagagcggacgccccacgccccagaacttcccaggttgttttcatttggtgatcagcactgaacacagaggactcaccatggagttcgggctgagcgttgggttttccttgtttgtttattttacaaggtgtccagagtgaagtgcaggttggtggaggtccgggggagtacgttggtccagccgtgggacggtccctggagactctcctgtgtccgcctctggacttccaccatcagtcgaccacttatatggacgtgggtcccgccgaggcctaccggagggggaacggggctgggaggtgggtcgttcggccgacgaaagtaaaaaacgtaagttcgacctagtacttttancaacgagtacgtaccgccgtcgtctggtagaaacgccaagtacttcccaccctctacgaaganattcgaacttacgaaagtaactctatttagtactttacgcgtacgtaagttacgaaacccttaaccgtaaacggaaaaacccggagaccggacgggactaagttaggttaatttaggtttaggtttggttttagtttaggttttaattaacgtacggtaacggttaaccttgtaaccccgg

SEQ ID NO: 131493 - DNA, 540 bp, Homo sapiens
  misc_feature: GYAE6OF02IJ6WL.41.36.D03.1.454.CMB.1.raw
  modified_base (351)..(351): a, c, t, g, unknown or other
  misc_feature (351)..(351): n is a, c, g, or t
tcagtctatactatcacgaccggtgctcgatttagctgcgtcacgatctctcttgggggggagacgagcccagcactggaagtcgccggtgtttccattcggtgatcatcactgaacacagaggactcaccatggactttgggctgagattgggttttcctcgttgcttcttttaagaggtggccagtgtcaggtgcagctagtggagtcgtgggggagagcggcccagcctgggaactccctgagactctcctgtgcagcctctggattcatcttcaggacctatgccatgcacgtggggtcccgccaggcctccgaggccgaaggggctgggaggtgggtggcaattanatcagaagataggaattgaaagaacacgtacggagactccgagaacgggccgatccacgtctcagagacaattccaaggaacacacgtgcatctagacaaatcgtaacaacctcaacaagtgacgacacggtctagtactattagttgtaggcgaacggtaccgcccccgtacggacgaccggtccccg

SEQ ID NO: 131494 - DNA, 610 bp, Homo sapiens
  misc_feature: GYAE6OF02HMQTR.41.36.D03.1.454.CMB.1.raw
  modified_base (202)..(202): a, c, t, g, unknown or other
  misc_feature (202)..(202): n is a, c, g, or t
  modified_base (294)..(294): a, c, t, g, unknown or other
  misc_feature (294)..(294): n is a, c, g, or t
  modified_base (325)..(325): a, c, t, g, unknown or other
  misc_feature (325)..(325): n is a, c, g, or t
tcagtctatactatcacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccgggcaccctgtctctgtctccagggganacagcccaccctctcctgcagggccagtaggagtgtcagtaagtacttaggctggtaccaacagaaacctggccaggctcccgaggcctccnatccatgatgacactccaacgacgggtcccnggccactcccaagaccaggttcaggtggcaggtgggtcgtgggacagtctctactctaccacctatccagacacgacgtggacgcgtagtaagtatttgacgtagtagttattacgtgtacaacgtagtaacgtcggtaccttaccgttacccgtttcgtaccgtttacccggtcccgttaccgggtaaacctaaaggttcgaaccgtacgtaaccgtaaaccggtaacgttcgtacggtctacgtccgaaccgttacgtaccttacgtccttactacttccccg

SEQ ID NO: 131495 - DNA, 611 bp, Homo sapiens
  misc_feature: GYAE6OF02IFOYJ.41.36.D03.1.454.CMB.1.raw
  modified_base (564)..(564): a, c, t, g, unknown or other
  misc_feature (564)..(564): n is a, c, g, or t
tcagtctatactatcacgaccggtgctcgatttagctgcgtcacgatctctcttggggatcacataacaaccacactcctcctctaaagaagcccctgggagcacagctcatcaccatggactggacctggcggttcctctttgtggtggcagcagctacaggtgtccagtcccaggtgcagctggtgcagtcgtggggctggaggtgaagagccgtggtcctggtagaggtctccgtgcgaaggtcgttcgtggaggcctaccgttcttcagtctatgtcttttagttgggtgcgacgacggccccgtggacgaggtcttggagtggcgtaggggaggtactcgacgtcccgtagttcgtttggcgactagttacgtaattaccggcaacgtaagttaacgtttcgaaggtacgaggtacgtaccaaccgtacgttacccggacggtaacgaacgtacccgaaggtacgtaacacgtaccgtaacagttagggacgtactggacgcggagtcgtagagtacttcgagaaacgacgacggtcctattcgttagtttcgtacggngtacgtactcccgttacgtacgtaactttcggacttccgtccctacg

SEQ ID NO: 131496 - DNA, 496 bp, Homo sapiens
  misc_feature: GYAE6OF02IAMSR.41.36.D03.1.454.CMB.1.raw
  modified_base (284)..(284): a, c, t, g, unknown or other
  misc_feature (284)..(284): n is a, c, g, or t
  modified_base (322)..(322): a, c, t, g, unknown or other
  misc_feature (322)..(322): n is a, c, g, or t
  modified_base (407)..(407): a, c, t, g, unknown or other
  misc_feature (407)..(407): n is a, c, g, or t
  modified_base (461)..(461): a, c, t, g, unknown or other
  misc_feature (461)..(461): n is a, c, g, or t
tcagtctatactatcacgaccggtgctcgatttagctgcgtcacgatctctcttggggatcacataacaaccacactcctcctctaaagaagcccctgggagcacagctcatcaccatggactggacctggcggttcctctttgtggtggcagcagctacaggtgtccagtcccaggtgcagctggtgcagtctggggctgaggtgaagaagcctgggtcctcggtgaaggtctcctgcaaggctttctggaggcaccttcttcagctatgcttttatttgggncgacaggcccctggacaaggcttgagtggctgggaggntcatccctatcttggtgcatcgaattacgcacagagtttcagacagatcaccattaccgcggacaatccaacgagtacagcctanagtggagctggacgcgagggctagagactctagaacgcacggcatctattctgngcgagacgtccctacgtcaacttttcactgtcccc

SEQ ID NO: 131497 - DNA, 786 bp, Homo sapiens
  misc_feature: GYAE6OF02HJV8G.41.36.D03.1.454.CMB.1.raw
tcagtctatactatcacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggccaccctgtctctgtcctccgaggggagacacgcccacccttcctcctcgccgacgggcccaggtaggagttcgtcaaggtaacgtacgttagggctacggtaacccaaacgaacggtaaaacccgttggacccgtaaggcccttccccgaaggtccctacctcactccatgattcgactactaccaaccggacgggttccccgtgggaccgtacccagacccgtacgggttccggtggaccgtagggtcgggtccgtaggggactaggtacgttccggtaactccgttaccgacccggttcacggtcgacggtcccgttgggactccgttagacgttgtattttcgactttaggttttcctcgttgtccagactaccggtcccgttccgaccccgtccggttacccgtccgtttaccggtacccggggtttacccgggggacccggggggttaaccgtagggggtagggtaacgtttaccgggccgggtaaaggtacccgggttaaggttaccggggttcgggtaccgtaccggggtaacctccccgggttaacgtttaccccgttagggttttaccccttttacccggtaaccggttttcccccccg

SEQ ID NO: 131498 - DNA, 780 bp, Homo sapiens
  misc_feature: GYAE6OF02G5QM1.41.36.D03.1.454.CMB.1.raw
  modified_base (220)..(220): a, c, t, g, unknown or other
  misc_feature (220)..(220): n is a, c, g, or t
tcagtctatactatcacgaccggtgctcgatttagctgcgtcacgatctctcttggggcagagctctggggaggaactgctcagttaggacccagacggaaccatggaagccccagcgcagcttctcttcctcctgctactctggctcccagactaccactggagaaatagtgatgacgcagtctccagccacccgtgtctgtgtctccgaagggggaanacgcccaccctctcctgcacgggcctagtcaggtagttcgttaccacgactaacgttacgtaccgtcggtaccccacgaacgaaaccggtggggaccacggccgtaccccgacggtcccttaccctcaaccgttccgtaacgtacggtaacctacgtaccccgaacccggacgggacccctaacggttacggtaacccgtaccccaacccggtagggttacctacgggtcggaacggtacggggttaccggggggtaacccgggacgtaaggttaccggtttacccaccgttaccctacgtaaccctacgtccggtacggtccccggtcgtacggtacgtaaccgttcggtagggttaacgggtttacttttacgggactttagttttacctacggttctacggtacgtacgttaagtttaacgtaacgtttacggttccgtcccttacgttcccgtttaacggggttccggggggaacgggggttaaccgtaaggggtacggtaacgtacgtaaccgtaacggttcgttaggccggtacgtaccggaccttacctacgg

SEQ ID NO: 131499 - DNA, 835 bp, Homo sapiens
  misc_feature: GYAE6OF02ICKQ1.41.36.D03.1.454.CMB.1.raw
  modified_base (286)..(286): a, c, t, g, unknown or other
  misc_feature (286)..(286): n is a, c, g, or t
tcagtctatactatcacgaccggtgctcgatttagctgcgtcacgatctctcttggggatcacataacaaccacactcctcctctaaagaagcccctgggagcacagctcatcaccatggactggacctggcggttcctctttgtggtggcagcagctacaggtgtccagtcccaggtgcagctggtgcagtctggggctgaggtgaagagccgtgggtctcggtgaaggtctcctgcaaggcttcgtggagctaccttcttcagtctatgtcttttagttgggtnccgaacgacggtccccgtaggaccgtaagggtcttaggacggttcgggcgttaggggacgggtactaccgtaacgttccccgttaagttccgttttgggtacgtacgtaacgttacgtaaaacgtttaccggacctaacgtaaggttaacggttttaccgaacgggtaaccgtaaggtaccgttacccaaacccgttaacggttttaaccccgggaccgggtaaaccgtaaaccgttaccccggtaaaacgggtaacggttaaacccgtaaaccgggttacccctttaaacgaacgggttacggggtaacgtacccggttaaggaaggtacccggtaaggggtccttaaggggaaacggttaggtttaacccgtaaggggaaaaccgtaacccggtaacccgggtaccctaaagttttacccgttttaaacgttttccggtaacgggttacgggacccggttaacggtaaccccggtttccccgttaaccgggtttaacccgttaaaacccgttttttccgaaacccgttttcccggtttaaccccccg

SEQ ID NO: 131500 - DNA, 734 bp, Homo sapiens
  misc_feature: GYAE6OF02FNYJS.41.36.D03.1.454.CMB.1.raw
tcagtctatactatcacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggccaccctgtctctgtctccgaggggagacagccaccctctcctgcgacgggccaggtaggagtcgtcgagtaagtactaggactggtaccaacacgaaacgtcggacaggtcctcccgaggcctcctcactccatcgatcgacactaccaacgtacgggtccctggccgtaccacgtacgtacgggttccggtacggccgtagggttcggggtaccgtacggggtaaccgacggttacggttaccaccgttcgtaccgtaacccggtacgacggtaccacggtaccgtacgggtacgtaccccgttaggtacgtttacggttaacgttttcggtaccgtttaaggttttacccttttggtacctttaccgaacggttccgacgttcccggtttacccgaccgttaccggtcccgtccgttaccgtaccgggttttacccgggggaccgggggtaaccgttaggggtccggtaaggtacggttacggaggtaacccggtagtccggtagggtcctacgtacccgtacgtacgtccgttagtaccttacgacgttccccg

SEQ ID NO: 131501 - DNA, 796 bp, Homo sapiens
  misc_feature: GYAE6OF02FZANE.41.36.D03.1.454.CMB.1.raw
  modified_base (244)..(244): a, c, t, g, unknown or other
  misc_feature (244)..(244): n is a, c, g, or t
tcagtctatactatcacgaccggtgctcgatttagctgcgtcacgatctctcttgggggaggaactgctcagttaggacccagagggaaccatggaacgccccagctcagcttctcttcctcctgctactctggcctcccagactaccaaccggaaaaattgtgttgacacagtcctccaggccacctgtctctgtctccgagggacacacgcccaccctctccgtgcgacgggccaggtaggngtgtacagttaagtacgttaggcgtcggtaaccaacgaacgtaaaccgtcggaccacggtccctacccgaacgtaccttcccttacttaacgtttttacgttcggttttccttaccgtaaccgggaccgggtcccgtacgttacggttacctccccgacggcccgttaagggttccaaggttccgaccggtacgggttcgggttcgtacggggaactacggttacgtttccaccttccgtaccgtaccgtcacgtccgacggtcccgtaggtaccgtcgtacggtagttcgtttagttttcggtacctttacggttttaccttcgttcgtacgtacgtcgtaccggttcccgtacccgcccgtaccgtcccgtaccgttacggttcccgggtttaccgggggaccggggggtaccgtacgggggttacggaaacgtaaccggtaaccggtaaccgtacggttacggcggttccggtaccgtaccgtaaccgttaccgtttcgttaccgtttacttacccgttacccgtttcccgttccccggtaccttacgg

SEQ ID NO: 131502 - DNA, 596 bp, Homo sapiens
  misc_feature: GYAE6OF02HBQFH.41.36.D03.1.454.CMB.1.raw
  modified_base (110)..(110): a, c, t, g, unknown or other
  misc_feature (110)..(110): n is a, c, g, or t
  modified_base (433)..(433): a, c, t, g, unknown or other
  misc_feature (433)..(433): n is a, c, g, or t
tcagtctatactatcacgaccggtgctcgatttagctgcgtcacgatctctcttggggagctctgagagcggagccccagccccagaattcccaggtgttttcatttggngatcagcactgaacacagaggactcaccatggagttcgggctgagctgggttttccttgttgttattttacaaggtgtccagagtgaagtgcagttggtggagtccgggggagacgttggtccagcctggacgggtccctgagactctcctgtgtcgcctcgtggattcaccatcagtgaccatatatggactgggtccgcaggctccgaggggagggcgtgggagtggccttgggccgacaaggtaaaaacaaggttcgaccagtctttaatcaacgagacggacgccgcgttctaggtagaacgccagtacttccaccctnacaagagatcgacttacaagaactcattgattctgacgaatcgaacctaacggtaacgaaaaccgagaacccgacgggactacgtagttaacgtttactttggttacgtttttcggtaagttttttacgtagttaccgtaagggttacccttcggtaccccgg

SEQ ID NO: 131503 - DNA, 706 bp, Homo sapiens
  misc_feature: GYAE6OF02G1TGS.41.36.D03.1.454.CMB.1.raw
tcagtctatactatcacgaccggtgctcgatttagctgcgtcacgatctctcttgggatcacataacaaccacactcctcctctaaagaagcccctgggagcacagctcatcaccatggactggacctggcggttcctctttgtggtggcagcagctacgaggtgtccagtccgaggtgcagctggtgcagtcgtgggctggaggtgaagacgccgtgggtcctcggtgaacggtcctccgtgacgaaggtcttcgtgggacggctaccctttcgttcaacgtcttaagttggttaccgtttttaggtttcgggttcgtaccgacgtaccgggtccccttagggaaccaaggggtctttaggacggttggacggttgggggaagggtacttaccgtacgttcccttagttccggttttgggtacgacgtaacgtacgtaacgttacggcctaacgtaaggttaacgtttcgaaggtacacggtacgtacgaaccgtacgtaccgcggaacctaacgtccgaacggtacgtaacgacgaccttaacgagtcgggacgtcgtaggacgacgaggtcgtagaacgtacgtacgtaaggaacgtaccgaccgtactattacgttacgtttccgaggttaccggaccggtaacgtcccgttacccgttacggtaacccgtttaacgtttcgtaaccgttaccggttacccc

SEQ ID NO: 131504 - DNA, 851 bp, Homo sapiens
  misc_feature: GYAE6OF02IKQFC.41.36.D03.1.454.CMB.1.raw
  modified_base (188)..(188): a, c, t, g, unknown or other
  misc_feature (188)..(188): n is a, c, g, or t
tcagtctatactatcacgaccggtgctcgatttagctgcgtcacgatctctcttgggatcacataacaaccacactcctcctctaaagaagcccctgggagcacagctcatcaccatggactggacctggcgttcctctttggtggtggcagcagctacaggtgtccagtcccaggtgcagtctggtncacgtcgtggggacgtgaaggtgaaacgagcccgtggggtccctaggggttacgaacgggttcctccgtaggaccgtaacggttccgtttaccgtggggaacggtcccgtaacccgttttactttaccgacggtacccttaagtttacgtttacgttttttaacggtttcggggttacgtaccggtaaccgtacccggggtaccccggttacggggaacgtaacggggtacctttagggtacggttcggggtacgttacgggggaagggtacttaccgtaacgttccccgtttaaggtttcgtttacggggtttaccgacgtaacgtttaaccgggtaaacttttaccgggacctaaacgtaacgggtttaacggtttaccgaaagggtaacccgtaaggtacgtaccgtaaaccgtacggttaacccgacggtaaaccggacttaccgaacggtaacgtaccgacgtaccctaagacgttcggacgtacggtagacgaccgaaggtccgtacggtacgtacgttacgtaacgggaaaacgtcccggtaacgaccttagtttaccgttacggtttacgttacgggtaccggtccggttaacggaccccgttaccctttaccggttacccttaaaccggttttacgacctttaacggtaccccc

SEQ ID NO: 131505 - DNA, 852 bp, Homo sapiens
  misc_feature: GYAE6OF02INNFP.41.36.D03.1.454.CMB.1.raw
tcagtctatactatcacgaccggtgctcgatttagctgcgtcacgatctctcttgggggggagacgagcccagcactggaagtcgccggtgtttccattcggtgatcatcactgaacacagaggactcaccatggactttgggctgagattgggttttcctcgttgcttcttttaagaggtggccaggtgtcaggtgcagctaggttggagtcgtgggggaggagccggcccagccctggggaacctccctggacgacctccgtccgtgtcgcgacgcccttcgtggtacttcacttccttcgaggtaccctagtcgcctagtcgtacgtcggtccggggtcccgaccgagggccctaccgagggaccggaacggggtctagggggaggttggggtcggtacgtaaagttacgtaactaccgaagtaacggtagttagggaaagtttaacggaaaacggtaaacgtaaaccggttaaccggaacgggttaacccggtacccgggtaaacgggtaaaccggggtacccgtaacggttttacccgtacccggttaaccccgtacccggtaacggaaacccggtaacccgttaaacgttaaccccggaaagggtaaacccaaacccggtaacgttaccggaccgttaacgttaccgtaccggtaaacttaaaccgttaacccgttaaacccgtaaaccctaaccgtaaaccggtaaacggttagggaacccggtacgtaccgggtaccgttacggttaaccgttaacgttttacggttacggttaccggtaccggtaacccgggtccccgtaacccccggtacgggtaaccccgggtacccgggttacccccggg

SEQ ID NO: 131506 - DNA, 639 bp, Homo sapiens
  misc_feature: GYAE6OF02HRY49.41.36.D03.1.454.CMB.1.raw
  modified_base (203)..(203): a, c, t, g, unknown or other
  misc_feature (203)..(203): n is a, c, g, or t
  modified_base (269)..(269): a, c, t, g, unknown or other
  misc_feature (269)..(269): n is a, c, g, or t
  modified_base (318)..(318): a, c, t, g, unknown or other
  misc_feature (318)..(318): n is a, c, g, or t
  modified_base (364)..(364): a, c, t, g, unknown or other
  misc_feature (364)..(364): n is a, c, g, or t
  modified_base (411)..(411): a, c, t, g, unknown or other
  misc_feature (411)..(411): n is a, c, g, or t
  modified_base (427)..(427): a, c, t, g, unknown or other
  misc_feature (427)..(427): n is a, c, g, or t
  modified_base (447)..(447): a, c, t, g, unknown or other
  misc_feature (447)..(447): n is a, c, g, or t
  modified_base (600)..(600): a, c, t, g, unknown or other
  misc_feature (600)..(600): n is a, c, g, or t
tcagtctatactatcacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaagggganacagccaccctctcctgcacgggccaggtaggagtgcaagtaagtacttaaggctaggaaccaaanacgaaaacctggaccgacggctcccaaggcctcctacactccatgactncgatccgaacgacggtccctgcccgtccagaccgtaggtttcccgnggacaggttcgggtcgtgggacaagtagttccaattcctcgaccgtnagccgtacgctacggngtacctgactgtatttacgnttacgttacttcgtgtcacgcctaagtccgtacccgcgtaccgccgtactccttaccgggtttccggggaccgggggtaacgtagggtcgggaagtaacggtggaaccggtaaccggtaacggttcgggtacgtacggtcgaccctaaaccgntttaccgtcggtttaccctttacgaaccgttttccccgg

SEQ ID NO: 131507 - DNA, 791 bp, Homo sapiens
  misc_feature: GYAE6OF02H097S.41.36.D03.1.454.CMB.1.raw
  modified_base (269)..(269): a, c, t, g, unknown or other
  misc_feature (269)..(269): n is a, c, g, or t
  modified_base (300)..(300): a, c, t, g, unknown or other
  misc_feature (300)..(300): n is a, c, g, or t
  modified_base (314)..(314): a, c, t, g, unknown or other
  misc_feature (314)..(314): n is a, c, g, or t
tcagtctatactatcacgaccggtgctcgatttagctgcgtcacgatctctcgttgggggggagacgagcccagcactggaagtcgccggtgtttccattcggtgatcatcactgaacacagacgactcaccatggactttgggctgagtagttgggttttcctcgttcgctttactttttaaggacgggttcggcctaggtcgtcgtaggtcggcagtctaggtggagtcggtgggggagacgccggccagccgtacgggacctccgngacgtcctcgtcctgtcgtccacgtccgttntaggtactttaccngttccgttacgaacgttaccttagtccggtaccaagttcggaccgtacccggggttccgggttaccccgccgtaccgggtcctacccgggtaacggccgggtaaggggtccgtaggggggtacggttagggtacgaacgtttaattagttaacccgaaggtaaggaagttaaacggttacggttaaaagttacgaaaacgtaaacggttaacccggtaaacggggtaccgtaaacccggttacggggaaaccgggtaaaccgggtacctttaacggttacccgacccggttaaccgaccggaaacggtacgtaaccgttaaaccgttacccgaaacgtaaccgactaccggtactagtactcggtacaacgtacgtactaccctaccgaactacgaggtacgtagcgtacgtctagttaccttagttcgtcggacgtacgaccgtcccggtacccgtaccggtcctacggtaccccg

SEQ ID NO: 131508 - DNA, 152 bp, Homo sapiens
  misc_feature: GYAE6OF01BMGO1.15.70.G04.1.454.CMB.1.raw
tcagtctacgtagccacgaccggtgctcgatttagtgtagtgtgaagggaaagggaccaaggtggaaatcaaacgaactgtggctgcaccatctgtcttcatcttcccgccatctgagctacgtagactgagcgggctggcaaggcgcatag

SEQ ID NO: 131509 - DNA, 169 bp, Homo sapiens
  misc_feature: GYAE6OF01A8C48.15.70.G04.1.454.CMB.1.raw
  modified_base (154)..(169): a, c, t, g, unknown or other
  misc_feature (154)..(169): n is a, c, g, or t
tcagtctacgtagccacgaccggtgctcgatttagtgtagtgtgaagggaaagggaccaaggtggaaatcaaaacgaactgtggctgcaccatctgtcttcatcttcccgccatctgagctacgtagactgagcgggctggcaaggcgcatagnnnnnnnnnnnnnnnn

SEQ ID NO: 131510 - DNA, 522 bp, Homo sapiens
  misc_feature: GYAE6OF01AMQC0.40.42.D09.1.454.CMB.1.raw
tcagtctagcgactcacgaccggtgctcgatttagacacatacgcagggaaagggcttgatgccttggggtgggaggagagacccctctcctgctccccctcctcactttctgcacagtctctgaggcctcctatgagctgacacagccacctcgtgtcagtgtcccacggacaaacggaccacggatcacctgctctggagaagcattgccaaaaaaataatgcttattggtaccaacagaagtcaggccaggcccctcgtgctggtcatctatgaggacaaacaaacgaccctccgagatcccctgagagattctctggctcccagctcagggacaatggccacccttggctctcagtggggccccaggtggaggatgaaggctgactactactgttactcagtggacagcagtggaaatcatggggtatccgggcggaagggaccaagctgaccgtctacggtcacgcccaggctcgcccccgtcggtcactctcgttcccacccctctcatcgctgac

SEQ ID NO: 131511 - DNA, 531 bp, Homo sapiens
  misc_feature: GYAE6OF01DVHZE.40.42.D09.1.454.CMB.1.raw
  modified_base (222)..(222): a, c, t, g, unknown or other
  misc_feature (222)..(222): n is a, c, g, or t
  modified_base (402)..(402): a, c, t, g, unknown or other
  misc_feature (402)..(402): n is a, c, g, or t
  modified_base (517)..(517): a, c, t, g, unknown or other
  misc_feature (517)..(517): n is a, c, g, or t
tcagtctagcgactcacgaccggtgctcgatttagacacatacgcagggaaagggcttgatgccttggggtgggaggagagacccctctcctgctccccctcctcactttctgcacagtctctgaggcctcctatgagctgacacagccaccctcggtgtcagtgtccccaggacaaacggccaggatcacctgctctggagaagcattgaccaaaaaaatntgcttattggtaccaacagaagtcaggccaggcccctgtgctggtcatctatgaggacaacaaacgaccctccgagatccctgagagattctctggctccagctcgagggacaatcggccaccttggctctcaggtcggggcccagggtggaggatggaagctgactactactgttactnagtggacagcagtaggaaatcagtggggtattcgggcggagggaccaagcgtgaccgtccgtaggtcagcccaaggcctcgcccccgtcgtcactcctcgttccccacccttccncagtcgctagtacg

SEQ ID NO: 131512 - DNA, 648 bp, Homo sapiens
  misc_feature: GYAE6OF01BIMTJ.40.42.D09.1.454.CMB.1.raw
  modified_base (222)..(222): a, c, t, g, unknown or other
  misc_feature (222)..(222): n is a, c, g, or t
tcagtctagcgactcacgaccggtgctcgatttagacacatacgcagggaaagggcttgatgccttggggtgggaggagagacccctctcctgctccccctcctcactttctgcacagtctctgaggcctcctatgagctgacacagccaccctcggtgtcagtgtccccaggataaacggccaggatcacctgctctggagaagcattgaccaaaaaaatntgcttattggtaccaacagaagtcaggccaggcccctgtgctggtcatctatgaggacaacaaacgacctccgagactccctgagagattctcgtggctccagctacgagggacaagtcggccacgttggctcgtcgaggtcggggcccgtagggtcggaggtatggaacgtcgtaggtaccttaacgtacgttcggtttaactcgaaggttggaacgaggacgaggtaggaaactcgtaaggttggggttaacttccggggacgggaacgggaaccgaaggtccgttacgggtaacccgttaccgtaagggtaccgaacggacccgtaaggtccctacccggccccccgttcggtacccacccggttcgtacccggtttacccccacccgttccctaccgtacggtccctacgttacggtacccg

SEQ ID NO: 131513 - DNA, 552 bp, Homo sapiens
  misc_feature: GYAE6OF01B07RZ.40.42.D09.1.454.CMB.1.raw
  modified_base (223)..(223): a, c, t, g, unknown or other
  misc_feature (223)..(223): n is a, c, g, or t
  modified_base (405)..(405): a, c, t, g, unknown or other
  misc_feature (405)..(405): n is a, c, g, or t
  modified_base (507)..(507): a, c, t, g, unknown or other
  misc_feature (507)..(507): n is a, c, g, or t
tcagtctagcgactcacgaccggtgctcgatttagacacatacgcagggaaagggcttgatgccttggggtgggaggagagacccctctcctgctccccctcctcactttctgcacagtctctgaggcctcctatgagctgacacagccaccctcggtgtcagtgtccccaggacaaacggccaggatcacctgctctggagaagcattgaccaaaaaaaatntgcttattggtaccaacagaagtcaggccaggcccctgtgctggtcatctatgaggaacaacaaacgacccctccgagatccctgagagattctctggctccagctcgagggacaagtcggccaccttggctctcgaggtcggggcccagggtggaggatgaagctgactactactgttacncagtggacagcaggtaggaaatcgagtggggtatcgggacggagggaccagcgtacgaccgtccgtaggtcacgcccgaaggcctccgcccccgtcggtccnccgtccgtcgttcccccacccttcctaccagtccgcgtagtaccg

SEQ ID NO: 131514 - DNA, 545 bp, Homo sapiens
  misc_feature: GYAE6OF01EST6C.40.42.D09.1.454.CMB.1.raw
  modified_base (408)..(408): a, c, t, g, unknown or other
  misc_feature (408)..(408): n is a, c, g, or t
tcagtctagcgactcacgaccggtgctcgatttagacacatacgcagggaaagggcttgatgccttggggtgggaggagagacccctctcctgctccccctcctcactttctgcacagtctctgaggcctcctatgagctgacacagccaccctcggtgtcagtgtccccaggacaaacggccaggatcactgctctggagaagcattgaccaaaaaaaattgcttattggtaccaacagaagtcaggccaggcccctgtgctggtcatctatgaggacaacaaacgaccctccgagactccctgagagattctctggctccagctcgagggacaagtcggacctaccgttggcctctcgaggtcggggcccagggtggaggatggaagctgactactactgttactnagtgacagcagtaggaatcgagtgggtattcgggcggagggaccagctgaccgtcgtaggccagcccgaagcctccgcccccgtcggtctaccgtccgtccgttccccgccccttcctccgacgtccgcgtacgacg

SEQ ID NO: 131515 - DNA, 700 bp, Homo sapiens
  misc_feature: GYAE6OF01DEB4C.40.42.D09.1.454.CMB.1.raw
  modified_base (223)..(223): a, c, t, g, unknown or other
  misc_feature (223)..(223): n is a, c, g, or t
  modified_base (241)..(241): a, c, t, g, unknown or other
  misc_feature (241)..(241): n is a, c, g, or t
  modified_base (371)..(371): a, c, t, g, unknown or other
  misc_feature (371)..(371): n is a, c, g, or t
tcagtctagcgactcacgaccggtgctcgatttagacacatacgcagggaaagggcttgatgccttggggtgggaggagagacccctctcctgcctccccctcctcactttctgcacagtctctgaggcctcctatgagctgacacagccaccctcggtgtcagtgtccccaggacaaacggccaggatcacctgctctggagagcattgaaccaaaaaaatntgtcttattggtaccaanagaagtcaggccacggcccctgtgctggtcatctatgaggacaacaacgaccctccgagactccctagagagtacttctcgtcggcctccagctacgacgggaacagtcggcctaccgttggctctacgngggtcggggcccgagggtcgggaggtagtaggaagtcgtacgtaaccttacgttacgttacgttactacggtaggtacggacgaggaccgtaagggtaacggtaaactcggtaagggtttacggggttagttccgggggacgggaacgggaaccaggtaccgtacggtaccccggttaccgttaacgggtaccaaccggtaccccgtaacgggtcccgttaccccgtccccccggttacggttaccctacccgtttcccgtttacccggttacccccctaaccccgttcccgtacccgtaccggtcccgttacgtaccgggtaacccgg

SEQ ID NO: 131516 - DNA, 711 bp, Homo sapiens
  misc_feature: GYAE6OF01CZI92.40.42.D09.1.454.CMB.1.raw
  modified_base (222)..(222): a, c, t, g, unknown or other
  misc_feature (222)..(222): n is a, c, g, or t
tcagtctagcgactcacgaccggtgctcgatttagacacatacgcagggaaagggcttgatgccttggggtgggaggagagacccctctcctgctcccctcctcactttctgcacagtctctgaggcctcctatgagctgacacagcccaccctcggtgtcagtcgtcccccaggacaaacggccaggatcacctgctctggagagcattgaccaaaaaatntgtcttattggtaaccaacagaagtcaggccacggcccctggtcgctggtcatctatgaggaaccaaacgaacgacccctcgagactcccgtgagagattctcgtggcctccagctacgagggaacaagtcggacccacgttggcctctcgaagggtcggggaccccaggggttagggacgggtataggaacgtcgtagtaaccttacgttaacttcgttacctacgtaggttacgggaactggacgtaggtaaggaaacgtacgtaaggttagggggttacgtttccgggggacggggaaacgggtaccgaaacgggtccttacgggaaccccgttacgttaaccggggtacgaacccggtacccgtaaaccggggccttcccgggacccccccggtttcgggtaccctaccgttccccgttcccgtttacccccctaccccccgtttcccgtacccgtacggttcccggtcgttacgggtaacccgg

SEQ ID NO: 131517 - DNA, 726 bp, Homo sapiens
  misc_feature: GYAE6OF01B1I3Q.40.42.D09.1.454.CMB.1.raw
  modified_base (224)..(224): a, c, t, g, unknown or other
  misc_feature (224)..(224): n is a, c, g, or t
  modified_base (691)..(691): a, c, t, g, unknown or other
  misc_feature (691)..(691): n is a, c, g, or t
tcagtctagcgactcacgaccggtgctcgatttagacacatacgcagggaaagggcttgatgccttggggtgggaggagagacccctctcctgctccccctcctcactttctgcacagtctctgaggcctcctatgagctgacacagccaccctcggtgtcagtcgtccccaggacaaacggccaggatcacctgctctggagaagcattgaaccaaaaaaatntgactttattaggtaaccaaacagaagtcgacggccacggcccctgtcgcgtggtcatctatgaacggaacaaccaaaccgacccctaccggaagtactcccgtagacgtagtactttcctacgtcggccttaccgaacgtccgtacgaacggggtaactaaacgttcggacccctacgttcgggccttcgtacgtacgggtcggggacccgtaggggtcgggaaggtaacgtaggaacgtcgtacgtaccttaaccgttacgttacgttaacgttacgaaggttacggaacgtacggacgtaaggtaaggaaacgttcgtagggttacggggttacgtaccggggacgggaacgggaacccggtaaggtccgtaccggtaccgttaccgtaggtaccgaccggacccggtaacggtcccgtacccggtccccgtcggtaccctccgttccgtacccggtttccccncccgttcctaccgttacgtccgtccgtcgtaacgg

SEQ ID NO: 131518 - DNA, 720 bp, Homo sapiens
  misc_feature: GYAE6OF01B2R6V.40.42.D09.1.454.CMB.1.raw
  modified_base (223)..(223): a, c, t, g, unknown or other
  misc_feature (223)..(223): n is a, c, g, or t
tcagtctagcgactcacgaccggtgctcgatttagacacatacgcagggaaagggcttgatgccttggggtgggaggagagacccctctcctgctccccctcctcactttctgcacagtctctgaggcctcctatgagctgacacagccaccctcggtgtcagtgtccccaggacaaacggccaggatcacctgctctggagaagcattgaaccaaaaaaatntgacttattggtaaccaacagaagtcgaggccaggcccctgtgctggtcatctatgaggaacaacaaaccgaccctccgagactcccgtgagagtattctcgtcggctccgagcctcgaagggactaacgtcggacctacgttcgggccttcgtcgacgggtcggggcccaggggtggaggtagtggaacgcgtacgaaccttaacgtacgttacgtttacctacgtaaggtaggaaccgacggacgtaaggtacggtaaaagtccggtaaggttaggggtttaacgttccggggaacggggaaccgggtaaccgaacgggtaccgttaacgggacccgttaccggttaacgggtaccgaaccggtaccccggaacgggtcccgttacccggtacccccccgttcgggttaccccacccggtttccgttacccggtttccccccggtaccccgttccccgtaccgtaacggttcccgtaccggttaacggtacccgg

SEQ ID NO: 131519 - DNA, 573 bp, Homo sapiens
  misc_feature: GYAE6OF01AFLS3.40.42.D09.1.454.CMB.1.raw
  modified_base (222)..(222): a, c, t, g, unknown or other
  misc_feature (222)..(222): n is a, c, g, or t
  modified_base (375)..(375): a, c, t, g, unknown or other
  misc_feature (375)..(375): n is a, c, g, or t
  modified_base (399)..(399): a, c, t, g, unknown or other
  misc_feature (399)..(399): n is a, c, g, or t
tcagtctagcgactcacgaccggtgctcgatttagacacatacgcagggaaagggcttgatgccttggggtgggaggagagacccctctcctgctccccctcctcactttctgcacagtctctgaggcctcctatgagctgacacagccaccctcggtgtcagtgtccccaggacaaacggccaggatcacctgctctggagaagcattgaccaaaaaaatntgcttattggtaccacagaagtcaggccaggcccctgtgctggtcatctatgaggacaacaaacgaccctccgagactccctgagagattctctggctccagctcaggacaatcggccaccgttggctcgtcaggtcgggcccaggtggaggntagaagctgactactactgttacncagtgacagcaggtaggaatcgagtgggtattcgggcggagggaccaagtcgtagacccgttcgtaggccaacggtcccaaggtccgtaccgccccccggttcggtccctaccgtccgttacccgttcccccgccccgttcccttaccaggttcccgccgttaacggtacccgg

SEQ ID NO: 131520 - DNA, 580 bp, Homo sapiens
  misc_feature: GYAE6OF01BKY3I.40.42.D09.1.454.CMB.1.raw
  modified_base (222)..(222): a, c, t, g, unknown or other
  misc_feature (222)..(222): n is a, c, g, or t
tcagtctagcgactcacgaccggtgctcgatttagacacatacgcagggaaagggcttgatgccttggggtgggaggagagacccctctcctgctccccctcctcactttctgcacagtctctgaggcctcctatgagctgacacagccaccctcggtgtcagtgtccccaggacaaacggccaggatcacctgctctggagaagcattgaccaaaaaaatntgcttattaggtaccaacagaagtcagacgcccctgtgctggtcatctatgaggacaacaacgaccctccgagactcccagtagagtacttctctggctccgagctcgaagggacaagtcggcctaccgtgctctcgaggtcgggccgaggtggagatgaagctagtactactacgtgttactcgagtcggactagctagtaggaaatcgtaggtgggtagtcgggagggaacgggaaccgaaggcgtagtacccgtacgtacgacgacgacccgaacgtccgtaccgcccccgtcggtccgtacttcgtcccgttcccctacccctccctacgacgtccgtaccgtacgtcgtacgg

SEQ ID NO: 131521 - DNA, 757 bp, Homo sapiens
  misc_feature: GYAE6OF01EQDWN.40.42.D09.1.454.CMB.1.raw
  modified_base (239)..(239): a, c, t, g, unknown or other
  misc_feature (239)..(239): n is a, c, g, or t
tcagtctagcgactcacgaccggtgctcgatttagacacatacgcaggggaaagggcttgatcgccttggggtacgggaggagagaccctctcctgctcccctccctcactttctgcctaccagtcctctggaggccgtcctagtggagcctgtactacgaggccacctcggtgtccagtggtccacggacaaacggccagggatcactgctctggagaagcagttgaccaaaaaagtntggacttagttgggtaccaacagaagtacgacggccacggccctgtacgcttggtcattctagtgaaggactaacaaacgtaccctaccgagtacgtcccgtaggaacgacggtaccgttcgtacggtacgggtccttaccgaggtccgtacggtacggggaactaaggtccggtacccctaaccggttagggccgttacggtacgaacgggtccgggggacccgtacggggttacggaggtactacggaacggtcgttacggaacgttaccgtaagttcgttactacgtaggtagggacgacgacgtaaggtacggaaacgttcgacggttacggggttacttacgggacgggtaacgggtaacctaaggtccgtacggtaccggttacgtacggtaccggacggacccgtaagggtccttaccggtccccgttgggtacctaccggttccgttcccggttaccccgtacccgggttacccggtacgtaacggttcccggtagtcgggtaacccggg

SEQ ID NO: 131522 - DNA, 786 bp, Homo sapiens
  misc_feature: GYAE6OF01BT7JX.40.42.D09.1.454.CMB.1.raw
  modified_base (234)..(234): a, c, t, g, unknown or other
  misc_feature (234)..(234): n is a, c, g, or t
tcagtctagcgactcacgaccggtgctcgatttagacacatacgcagggaaagggcttgatgccttggggtgggaggagagacccctctcctgcctccccctcctcactttctgcacagtctctgaggcctcctatgagctgacacacgcccaccctcggtgtcagtcgtcccaggaacaaacggccaggactcacctgctcgtaggagagcattacgaaacctaaaaaaaatntagtactttaagttacggtaaaccaaacgaagtaacgtacgaacggacccgacggccccttggtcgcgttcggtacatctagtaggaacgaacaaaccgaaaccgaccccgtaccggaagtactcccgtagacgtagtacttcctcgtcggctccgagtctacggaaggaacaagtcgacctacgtggcctcgtcgtacgggtccggggacccgtaggggtacggaaggtagtaggaacggtcgttaacggtaaccttaaccgttaaccgtttacggttaaccgttacggtaagggtacggaacgtacggaacgtaaagggtaaggtaaaaccgttcggtaaggggttcggggttaacggttaccgggggacggggtaaacgggaaccgtaacggtccggttaaccggtaacccggttacggttaccggaccggaaccggtacccgaacgggtcccgtaccccggtccccggttcggtacccttacccggttccgttccccggttcccccgtaccccgttccgaccgttaccggtccgtacgtacgggtcgg

SEQ ID NO: 131523 - DNA, 628 bp, Homo sapiens
  misc_feature: GYAE6OF01B3DPG.40.42.D09.1.454.CMB.1.raw
  modified_base (223)..(223): a, c, t, g, unknown or other
  misc_feature (223)..(223): n is a, c, g, or t
tcagtctagcgactcacgaccggtgctcgatttagacacatacgcagggaaagggcttgatgccttggggtgggaggagagacccctctcctgctccccctcctcactttctgcacagtctctgaggcctcctatgagctgacacagcccaccctcggtgtcagtgtccccaggacaaacggccaggatcacctgctctggagaagcattgaccaaaaaaatntgacttattggtaccaacagaagtcaggccaggcccctgtgctggtcatctatgaaggaacaaaccgaaacgacccctcgagactccctgagagtattctctggctccgagctcgagggaacagtgccacgttggccttctcgacgggtcggggcccagggtgggaggtataggaagtctaggaacttactacgttagttactcgaagtggacaggactaaggtaggaaatcgtaaggtgggggttacttcggggcgggaacggggaaccaggtcgtacgggacccgttccgtaagggtccaaggaccccgtaagggtcccgtccggcccccgttcgggtcctacccgttcgttaccccgttcccctaccccgttccgtacgtacgttccggcgttacggtacgg

SEQ ID NO: 131524 - DNA, 854 bp, Homo sapiens
  misc_feature: GYAE6OF01DKNIB.40.42.D09.1.454.CMB.1.raw
  modified_base (226)..(226): a, c, t, g, unknown or other
  misc_feature (226)..(226): n is a, c, g, or t
tcagtctagcgactcacgaccggtgctcgatttagacacatacgcagggaaagggcttgatgccttggggtgggaggagagacccctctcctgctccccctcctcactttctgcacagtctctgaggcctcctatgagctgacacagccaccctcggtgtcagtgtccccaggacaaacggccaggatcacctgctctggagaagcattagaaccaaaaaaaaatntagtactttaattacggtaaccaaacgagaaagtcaacggccaacgggcccctgtcggtccttgggtcctatctataggaggaacaaaacaaaaccgaccccttccggagactccccgtaggaacgagtactttaccgcttcgggtccttaccgacggtcctaccgaagggaaccaaacggttcggaccctaaccgtttgggacccttccgtacgacgggtcgggggaccccgaggggttacgggaaggtaagtagggaaggtaccgtagtaaccgttaaccgttaccgttacggttaaccgttacgtaacgggtacgggtaaacgtaggtaccgtaagggtaacgggtaaaacgttcgttaagggttacgggggtttaacggtttaccgggggacgggttaaaccgggggaaacccgtaaacgggtacccggttaaccgggttaaccccgggtttccgttaaccggggtaccgtaaaccggaacccccgtaaggggcccccgtttaccggcccccccggtttacgggtacccgttacccttcccggtttaccccgtttaccccccctaacccccgtttcccgttacccgtaaccggttccccggtaaccgttaacggtaacccgggg

SEQ ID NO: 131525 - DNA, 660 bp, Homo sapiens
  misc_feature: GYAE6OF01CZLX4.40.42.D09.1.454.CMB.1.raw
tcagtctagcgactcacgaccggtgctcgatttagacacatacgcagggaaagggcttgatgccttgggggtgggaggagagacccctctcctgctccccctcctcactttctgcacagtctctgaggcctcctatgagctgacacagccaccctcggtgtcagtgtccccaggacaaacggccaggatcacctgctctggagagcattagaccaaaaaaatatgactttataggtaccaacagaagtcaggccacggcccctgtgcttggtcatctatgaggaacaaacaaacgacccctcgagactccctgagagattctcgtcggctccagctacgagggacaagtcggacctaccgtttggcttcgtcgaggtcggggcccgagggtgggaggagtaggaacgtcgtgtaaccttacttacttaggttacctacgaggtacggaacgtacgacgtaacggtaaggtaaactacgtaggtttagggggtacgtttacggggacgggaacgggtaccgaaggtccgtacggtaccggtcgtacggtcaacggacccaacgggtcctacggtccccccgttcgggtccctaccgtttcccgtacccgttcccccctaccccgttaccgtacgtaccggtccgtaccgttacggtaacgg

SEQ ID NO: 131526 - DNA, 798 bp, Homo sapiens
  misc_feature: GYAE6OF01CL9KR.40.42.D09.1.454.CMB.1.raw
  modified_base (222)..(222): a, c, t, g, unknown or other
  misc_feature (222)..(222): n is a, c, g, or t
tcagtctagcgactcacgaccggtgctcgatttagacacatacgcagggaaagggcttgatgccttggggtgggaggagagacccctctcctgctcccctcctcactttctgcacagtctctgaggcctcctatgagctgacacagccaccctcggtgtcagtgtccccaggacaaacggccaggatcacctgctctggagaagcattgaccaaaaaaaatntgcttattggtaaccaacagaagtcaggccacggccctgtgctggtcatctatgaggaacaaacaaaccgaccctacgagactccctgagagtacttctcgtcggctccgaaggtcctacgaacgggactaacgtcggaccctaaccgttcgggccttacgtcgaagggttccgggggaccccgaggggttacgggaggaagttacgggaaacgtccgtagtaaccgttaaccgtttaacgttacggtttaaccgtacggtaacgggttacgggaaacgtaacggaccgtaaaggggttaacggtaaaacgttccggtaagggtttaaggggggttacgtttacccgggggaccgggggtaaagggaaccccgtaaagggtacccgtttacgggaaccccggtttaccggttaacgggtacccggaaccggtacccggtaaaccggggtcccgttaccccgggtcccccccgttaccgggttaccttaaccccggtttccctttaccccgggttaccccccaaccccgtttcccgtacccgttaccggttacccgtaccgttaaacgggtacccgg

SEQ ID NO: 131527 - DNA, 659 bp, Homo sapiens
  misc_feature: GYAE6OF01COFDJ.40.42.D09.1.454.CMB.1.raw
  modified_base (225)..(225): a, c, t, g, unknown or other
  misc_feature (225)..(225): n is a, c, g, or t
tcagtctagcgactcacgaccggtgctcgatttagacacatacgcagggaaagggcttgatgccttggggtgggaggagagacccctctcctgcctccccctcctcactttctgcacagtctctgaggcctcctatgagctgacacacgcccaccctcggtgtcagtcgtcccaggacaaacggtcaggatcacctgctctggagaagcattgaaccaaaaaatntgtactttattcggtaaccaagagaagtcgaggccgacggcctgtcgctggcatcgtagtgagaacaaccgaaccgcctacgaagacttccgagacgatacttctcgtcggcctccagccgtacgaacggacaacgtcggacctacgttcggcttcgcgacgggtcgggccctagggtcggtagagtacgaagtcgtacgaacttacgttacgttacgttaccgtagtaggtacggaaccgagacgtaggtacgaaacgtcgtaggtacgggttacgtacgggacgggtaacggaccgaaggtaccgtcggacccgttcgacggttaccaccggaccgacggtcccgtacccgccccgttacgggaccttcccggttccgttacccgttcccccgcccgttacccgtcgtaccggttctaccgtaacggtccgg

SEQ ID NO: 131528 - DNA, 776 bp, Homo sapiens
  misc_feature: GYAE6OF01CQ1WR.40.42.D09.1.454.CMB.1.raw
  modified_base (226)..(226): a, c, t, g, unknown or other
  misc_feature (226)..(226): n is a, c, g, or t
tcagtctagcgactcacgaccggtgctcgatttagacacatacgcagggaaagggcttgatgccttggggtgggaggagagacccctctcctgcctccccctcctcactttctgcacagtctctgaggcctcctatgagctgacacagccaccctcggtgtcagtcgtccccaggacaaacggccaggatcacctgctcgtggagaagcattgaaccaaaaaaatntgtcttatggtaaccacagaatcacggccaggccctgtgcgtggtcattctatgacggacaacaaacgtaccctccgaagactcccagagagacttctctacggctaccacggctcggaggacaacgtcggacctaaccgtttggcctcgtacgcgggtcgggacccgtaggacgggaggtagtagaacgcgtacgactacgtacttcgttaactcctaaggtagaccgtagacgtaggtaaggaaactcgtaaggttcggggttaagttaccgggggacgggtaaacgggaacccgtaacgggtacccggttaccgggtaaaccccgggttccgttttaaaccggggtacccggaaccggtaaacccccgggaaccggggtaaaccccgtttacccccggggtcccccccccggggttaacgggtttaacccccggttaaccccggtttcccggtttttaaccccccgggttcccccccggttccccctttacccccggttaacgtaccccgggtttaacccggtccggtaaaccgggttaaccccggg

SEQ ID NO: 131529 - DNA, 814 bp, Homo sapiens
  misc_feature: GYAE6OF01DPTQZ.40.42.D09.1.454.CMB.1.raw
tcagtctagcgactcacgaccggtgctcgatttagacacatacgcagggaaagggcttgatgccgttgggggtgggaggagacgacccctctcctgcctccccctctctactttctgcacagtctctgacggcctcctagtgagctgacacacgacccaccgtcggtgtacaggtcgaccccgaaggaacgaaacggccaggactaccaccgtgctcgtaggagacgactagttaacgaaactaaaaaaatgtagtactttaagttacggaaccaagaaggaacgtacgacggaccgacgtcccgtagtcgacgtggtactactattaacgaggaacggaaccaaaccgaaaccgtacccgacgacgaactcccgtagacgtacgtattcctcgcggtacctaccgacgtaccagacggactacgtcgaccgtacgtcggtactcgttacgacggtcgggaccgtagggcggaagtacgagtacgtactacggtacctaacttacgtacgttaacgtacgtaagggtacggtaacgaacggtacgtaaacggtaaacggtaacgttacggtaagggttacgggttaagggttaccgggaacgggtaaccggtaaccggacggtacgttaaccggtacccggtaacgttacggggtaacctaacccgggaccggtaacccgggtacctaccccgggtacccccggtttaccggtacccggttacccggttaccggtttaccccccgtttacccggacccccctttaccgttaccggttaccggtttacccgtaacgggttaaccggttaaccggg

SEQ ID NO: 131530 - DNA, 765 bp, Homo sapiens
  misc_feature: GYAE6OF01EEW5M.40.42.D09.1.454.CMB.1.raw
  modified_base (532)..(532): a, c, t, g, unknown or other
  misc_feature (532)..(532): n is a, c, g, or t
  modified_base (596)..(596): a, c, t, g, unknown or other
  misc_feature (596)..(596): n is a, c, g, or t
  modified_base (756)..(756): a, c, t, g, unknown or other
  misc_feature (756)..(756): n is a, c, g, or t
tcagtctagcgactcacgaccggtgctcgatttagacacatacgcagggaaagggcttgatgccgttggggtgggaggagagacccctctcctcgcctccccctcctctactttctgcactagtctctgacggcctcctagtgagctacgacacgacgccctacccgtcggtcgtcgtacgttccgtaccccgaaggaaaccgaaaccggccgaaggactccgaccgtcgtcgtacgtaggaacgtaagactaagttaacgaaaacctaaaaaaagttcgtacgttacgtttacgttaacggtaaaccgaaacgtaagtaacgaccggacggtacccgaaccgtcccgtggtcgtcgttggtactatacgtaagtagaacgaaaccaaaccgaacccgtacccgtacgtacgaccgttaccgagtaagtacgttacgttccgtagtccgtccacgtacgtccgtaaggacgaatccgacgtccgtacgttgacctcggtaccggagggtccgggaacgtagggagtaacggngtaacggagtacgtacgttaacgttacttagtaccgtttacgacgtagggactacggtaaggtntaacggaagtacgtcggtaggtacggggttacgacgggacgggtaacgacggtacgtccgtaaccggaccttacggaccgtaccgaggaccgtcgtacccgccgtcccgtcggacttccgtcccgtttacccgccgtccctacgtcccgagtccggtacngggtacccg

SEQ ID NO: 131531 - DNA, 710 bp, Homo sapiens
  misc_feature: GYAE6OF01BCL5B.40.42.D09.1.454.CMB.1.raw
  modified_base (203)..(203): a, c, t, g, unknown or other
  misc_feature (203)..(203): n is a, c, g, or t
  modified_base (225)..(225): a, c, t, g, unknown or other
  misc_feature (225)..(225): n is a, c, g, or t
  modified_base (327)..(327): a, c, t, g, unknown or other
  misc_feature (327)..(327): n is a, c, g, or t
tcagtctagcgactcacgaccggtgctcgatttagacacatacgcagggaaagggcttgatgccttggggtgggaggagagacccctctcctgctccccctcctcactttctgcacagtctctgaggcctcctatgagctgacacagccaccctcggtgtcagtcgtccccaggacaaacggccaggatccactgctctgganagctattagaaccaaaaaaatntgtactttagttacggtaaccaacgaagaacgtcgacggccgaacggcccctggtcgcgttggtcattctatgaacggaacaaacgaaccgacccctcgaanactccgagacgagtacttctcgtgcctcgacgtcctacgacggtaacctagtacggccctaacgttcggacttccgtcggtacggggttccggggacccgtaggggtaggtaacggtagtaacgggaacgttcggtaacgtaaccttaaccgttaacgttacgttaacgtacgtaaggtacggtaacgacggtacgtaacgggtaaggaactgtacgggttagggttaacggttccgggaggggtaaccggaacgtaccgtacggttaccgacccgttccgttaacggactacccggaccggtaaccggcctcccggtccccgtggtacccacgtcccttccgttacccctcccggtcctacacggtactccggtataccggg

SEQ ID NO: 131532 - DNA, 858 bp, Homo sapiens
  misc_feature: GYAE6OF01EO2AL.40.42.D09.1.454.CMB.1.raw
  modified_base (240)..(240): a, c, t, g, unknown or other
  misc_feature (240)..(240): n is a, c, g, or t
tcagtctagcgactcacgaccggtgctcgatttagacacatacgcagggaaagggcttgatgccttggggtgggaggagagacccctctcctgcctccccctcctcactttctgcacagtctctgaggcctcctatgagctgacacacgcccaccctcggtgtcagtcgtaccccaggaccaaacggccaggactcacctgccttcgtggagaagctagttacgaaacctaaaaaaaatntgtactttagttacggtaaccaacgaagaacgtcaggcccacggtccccgtgtcgctggtcatctatgaaggaacaaacaaccgtaccccgtacgagacctccctaggagagtacttctcgtacggtcctaccacgtccgtacgaacgggtaacgtaacggtcggaccccgtacggttcgtacctacgtaccggtacggggtacccggggtacccggtaaggggtacggggaacggtaggtacggtaacgtaccgttacgtaaaccgtttaaccgttaaccgtttacgttaccgttaacgtacggtaggaacgtaacgtacggtaaggttaaacggtaaacgttaacgtagggtttacggggttaacgggtttacccgggggaacggggttaaaccgggaaacggtaaccgggttacccggttaacggttaccccgggttaaccgggttacggtaacccgggtaacccgacccgggtaaccggtaccccggttcccccggttacccccggtcccgggtacccgttaacccggtttccccggtttacccccgttcccccctaccccggttaccccttacggtaacccgtttcccgggttaacctaccgggttacccggg

SEQ ID NO: 131533 - DNA, 964 bp, Homo sapiens
  misc_feature: GYAE6OF01BI27L.40.42.D09.1.454.CMB.1.raw
  modified_base (696)..(696): a, c, t, g, unknown or other
  misc_feature (696)..(696): n is a, c, g, or t
  modified_base (884)..(884): a, c, t, g, unknown or other
  misc_feature (884)..(884): n is a, c, g, or t
tcagtctagcgactcacgaccggtgctcgatttagacacatacgcaggggaaagggcttgatgccgttgggggtgggaggagacgacccctctcctcgcctccccctcctctactttctggcacagtctcgtgacggcctcctagtgacgctgacacgacgcccacccgttcggtacgtccgagttccgtaccccgaagggaaccgaaaaccggccgaaggtactcccgaccgtcgccgttccgtagggaaggaacgtactaacgttaacggaaaaacctaaaaaaattgttacggttaactttacgtttaacgggtaaaccaaaacgtaacggtaaacggtccggaacgggtaccccgtaccgggtcccccgttagggtacgtccgggttaggtacctaacttaccggtttaacgtaacggaaaccgggttaaaaccaaaaacccggtaaaaccccggtaccccgtaccggtaaacgtacccgtcccggttaaggacgtaacggttacttccgtccggttacggccctacggtacgtaccgaccggtaacgggacctacggtaccggtacccttaacgttcggccctttacggacgggttaacccgggtcggggaacccgtagggggttacgggaagttaacgacggtaacgtaccgttacgtaccgttaaccgtttacgttacggtttaacccnggttaaacgggacgtaaacgtaccgggtaacgttaaggggtaacgttaacgtacggtaacggggttcgggttaacgggtcccgggtaacggggaacgggtaaacccggacggttaccggtaacccgggtacttaccggggtacgaccggaccctaaccgggtcgttacccccgccggtttaccccggnggttaaccctcccggttcccgtaccccgttacccctaccccgttccctagtaaccctcggttaaccgcgttaacccgggg

SEQ ID NO: 131534 - DNA, 914 bp, Homo sapiens
  misc_feature: GYAE6OF01D22WL.40.42.D09.1.454.CMB.1.raw
  modified_base (904)..(904): a, c, t, g, unknown or other
  misc_feature (904)..(904): n is a, c, g, or t
tcagtctagcgactcacgaccggtgctcgatttagacacatacgcaggggaaagggcttgatgccgttgggggtgggaggagacgacccctctcctcgcctccccctcctctactttctgctacacgtctctggacggtccctacctagtgagctcgaacacgacgtccctacccgttcgggtcgtacgacggttcccgtacccgaacgggaaaccgaaaccgggccgtaacgggtacctaccctacccgtcggtccgttaccggtaggggaacgtaacggtaccttaaacggtttaaaaccggaaaaaaccttaaaaaaaaactttgtttaacgggttaaccttttaaacggttaaccgggttaaaaccccaaaaggtaaacggaacggttaccgggtaaccgggacccgtacccgggtccccgtttagggttccggttaccggttacggtaactacgttacgttaacggacggaaaccggtaaaaccaaaacccgaaaccccgtacccggtacgtaaccgtaccgtaccgtagtaaggtactaccgtttccgtacggtccgtacccgtaccggtagtcccgtaaaggaccggtaaccgtaacggtcccggtaccttacggttcgaccgttccggaccgggtcggggtaccggtaccgggtagggtaacgggagtaacgaggtcgtaacgtctaacgttacttcgtacgttaccgtaggtagacggtcaagcgtaagtaacggtactgggtaggtcgggtagtccggggacggaacgaacggtccgacgtaccggtaaccttcgggaccacggaccgacggtaccgtcccggtcctaccgggtctcccggtaccttccccgtcccgtaccgttacccgtcgttacccggacgttccgtacggngtaacccggg

SEQ ID NO: 131535 - DNA, 889 bp, Homo sapiens
  misc_feature: GYAE6OF01DNH0K.40.42.D09.1.454.CMB.1.raw
  modified_base (232)..(232): a, c, t, g, unknown or other
  misc_feature (232)..(232): n is a, c, g, or t
tcagtctagcgactcacgaccggtgctcgatttagacacatacgcagggaaagggcttgatgccttggggtgggaggagagacccctctcctgcctcccctcctcactttctgcacagtctctgaggcctcctatgagctgacacacgccaccctcggtgtcgagtcgtaccccgaggacaaacggccaggatcacctgctctggagaagcattacgaaacctaaaaaaatntgtacttagtttacggaaccctaacgaggtaaacggtcgaacggaccgtaccgggtccccttaggtcggaccgttgggtacctacttaccgtaagtaggaacggaaaccaaaaccgtaaaaccccggtcccctaaccggtaacgtaccgttacccgtaggaacggtaacgtaacttttccgtacgttcggacccttacccgaggaccccgttaggaaccgggtaactaaacgggtcggtaaccccttacggtttaccgggctttaccgtacgggtaacggggtcccgggggacccgtaggggggtacggggtaaggtacggttacgggaacgtccggtaacggttaaccttaaccttacgttacgttaacctcggtacgggtaacgaccgaaggacgtaagggtaagtaacggtaggtacggggttaggggtaacgttcgggggaaccgggtaacgggaccgtaacggaccggtttccgggaacccgttacccggtaagggttccccggaaccggtaccccggtaaacgggtccccggttaccccggtacccccggttacgggtacccttacccgggttccccggtaaaccccttttccccccgtaacccccgtcccttaacggtacccgggttccctaacgggtcgtaacccgggg

SEQ ID NO: 131536 - DNA, 836 bp, Homo sapiens
  misc_feature: GYAE6OF01CN36J.40.42.D09.1.454.CMB.1.raw
  modified_base (192)..(192): a, c, t, g, unknown or other
  misc_feature (192)..(192): n is a, c, g, or t
  modified_base (237)..(237): a, c, t, g, unknown or other
  misc_feature (237)..(237): n is a, c, g, or t
tcagtctagcgactcacgaccggtgctcgatttagacacatacgcagggaaagggcttgatgccttggggtgggaggagagacccctcgtcctgcctcccctcctcactttctgcacagtctctgaggcctcctatgagctgacacacgccacccgtcggtgtcagtcgtacccgagaacgaacggcaggancacctgctcgtaggagaagctaagttacgaaacctaaaaaaaatntacgtacttaagttacgtaaccgaaacaggtaaacgtccgaacggcccgtaacggcccttagtcgcgttacggtacattacctaagtacgaacggaacctaaaacgaaacccgccccgtaccgagaacctaccgtaggaacgtaactacgttcgtaccggttacggccgtacccgtaaggacctaccggaaaggggtaaacctaacgtacgggaccccttaaccgtttcgggcccttacgtaacggaacgggttccggggaacccgtaggggttacgggaaggaagtttaacgggaactaccggttacgtaaacttaaccgtttaccgtttacggtttaactacgttaaacgggtacgggaaacgtacgtacgtaacggttaaacgtaaacgtacggtaggttaacggggttacggtaccgggaacgggtaaacggaaccggaacggtaaccggtcggtaacccgttcgttaacgggaccgacggacccggaacgtcccgtacccggtacccccgtaggtacccgtaccgttacccgtttcccggtacccccgtaccccttcgtaccggtaccgttacggtacccgtaaggtacccggg

SEQ ID NO: 131537 - DNA, 530 bp, Homo sapiens
  misc_feature: GYAE6OF02HN71B.40.42.D09.1.454.CMB.1.raw
  modified_base (223)..(223): a, c, t, g, unknown or other
  misc_feature (223)..(223): n is a, c, g, or t
tcagtctagcgactcacgaccggtgctcgatttagacacatacgcagggaaagggcttgatgccttggggtgggaggagagacccctctcctgctccccctcctcactttctgcacagtctctgaggcctcctatgagctgacacagccaccctcggtgtcagtgtccccaggacaaacggccaggatcacctgctctggagaagcattgaccaaaaaaaatntgcttattggtaccaacagaagtcaggccaggcccctgtgctggtcatctatgaggacaacaaacgaccctcgagaactccctgagagattctctggctcagctcgagggacaatcggccacttggctctcagtgggcccagggtgaggatgaagctgactactatgttactcagtggacagcagtaggaaatcgagtgggtattcgggacggagggaccaaggcgtagaccgtcctaggtcacggacccaaggctcgccccgtggtccactccgtcgttcccgccctccgctacgtcgctagtacg

SEQ ID NO: 131538 - DNA, 542 bp, Homo sapiens
  misc_feature: GYAE6OF02HAGUG.40.42.D09.1.454.CMB.1.raw
  modified_base (222)..(222): a, c, t, g, unknown or other
  misc_feature (222)..(222): n is a, c, g, or t
tcagtctagcgactcacgaccggtgctcgatttagacacatacgcagggaaagggcttgatgccttggggtgggaggagagacccctctcctgctccccctcctcactttctgcacagtctctgaggcctcctatgagctgacacagccaccctcggtgtcagtgtccccaggacaaacggccaggatcacctgctctggagaagcattgaccaaaaaaatntgcttattggtaccaacagaagtcaggccaggcccctgtgttggtcatctatgaggacaacaaacgaccctccgagatccctgagagattctctggctccagctcagggacaagtggccacttggctctcagtcggggcccaggtggaggatggaagctgactactactgttactcagtggacagcagtaggaaatcgagttggggtattcgggcggagggaccgaagcgtagaccgtcgttacgcacgccgaaggcctcgccccgtggtctaccttctccgttccctacccgtcctccgacgtccgcgtacgcctacgg

SEQ ID NO: 131539 - DNA, 528 bp, Homo sapiens
  misc_feature: GYAE6OF02HX9KK.40.42.D09.1.454.CMB.1.raw
  modified_base (312)..(312): a, c, t, g, unknown or other
  misc_feature (312)..(312): n is a, c, g, or t
  modified_base (325)..(325): a, c, t, g, unknown or other
  misc_feature (325)..(325): n is a, c, g, or t
  modified_base (392)..(392): a, c, t, g, unknown or other
  misc_feature (392)..(392): n is a, c, g, or t
tcagtctagcgactcacgaccggtgctcgatttagacacatacgcagggaaagggcttgatgccttggggtgggaggagagacccctctcctgctcccctcctcactttctgcacagtctctgaggcctcctatgagctgacacagccaccctcggtgtcagtgtccccaggacaaacggccaggatcacctgctctggagaagcattgaccaaaaaaatatgcttattggtaccaacagaagtcaggccaggcccctgtgctggtcatctatgaggacaacaaacgccctccgagatccctgagagattcnctggctccagctnagggacaatcggccaccttggctctcagtgggccaggtggaggatgaagctgactactactgtactnagtgacagcagtgaaatcagtggggtattcgggcggagggaccaagctggaccgtcgtaggcacgcccgaaggctcggccccgtcggtccaccgtctccgttccccgcccttcctcctacgtccgtctacgtaccg

SEQ ID NO: 131540 - DNA, 547 bp, Homo sapiens
  misc_feature: GYAE6OF02ICS6M.40.42.D09.1.454.CMB.1.raw
  modified_base (424)..(424): a, c, t, g, unknown or other
  misc_feature (424)..(424): n is a, c, g, or t
  modified_base (537)..(537): a, c, t, g, unknown or other
  misc_feature (537)..(537): n is a, c, g, or t
tcagtctagcgactcacgaccggtgctcgatttagacacatacgcagggaaagggcttgatgccttggggtgggaggagagacccctctcctgctccccctcctcactttctgcacagtctctgaggcctcctatgagctgacacagccaccctcggtgtcagtgtccccaggacaaacggccaggatcacctgctctggagaagcattgaccaaaaaaattgcttattggtaaccaacagaagtcaggccaggcccctgtgctggtcatctatgaggacaacaaacgaccctcgagactccctgagagattctctggctccagtctcgagggacaagtcggcctaccgttggctctcgaggtcggggaccctagggtggacggataggaagtcgtagactactacttgttactcgagtggacngcagtagaaatcgagtgggtatcgggaggacggacagcgtcgaccgtcgtaggcacgccgagcctccgcccctggtacctacgtccgtccgtcccgccctccgtctacggtcncgtacgtcgg

SEQ ID NO: 131541 - DNA, 550 bp, Homo sapiens
  misc_feature: GYAE6OF02I6Q4S.40.42.D09.1.454.CMB.1.raw
  modified_base (222)..(222): a, c, t, g, unknown or other
  misc_feature (222)..(222): n is a, c, g, or t
tcagtctagcgactcacgaccggtgctcgatttagacacatacgcagggaaagggcttgatgccttggggtgggaggagagacccctctcctgctccccctcctcactttctgcacagtctctgaggcctcctatgagctgacacagccaccctcggtgtcagtgtccccaggacaaacggccaggatcacctgctctggagaagcattgaccaaaaaaatntgcttattggtaccaacagaagtcaggccaggcccctgtgctggtcatctatgaggacaacaaacgaccctccgagactccctgagagattctctggctccagctcgagggacaatcggacccaccgtttggctctcaggtcggggcccagggtggaggatgaagctgactactactgttactcagtgacagcagtagaatcgagtgggtatcgggcggaggaccagctaggaccgttcgtaggtcacgacccaaggcctccggcccccgtcggtccaccttccgtccgttccccaccccttcctccgtacgtccgtcgtacgtaccg

SEQ ID NO: 131542 - DNA, 628 bp, Homo sapiens
  misc_feature: GYAE6OF02HF03C.40.42.D09.1.454.CMB.1.raw
  modified_base (222)..(222): a, c, t, g, unknown or other
  misc_feature (222)..(222): n is a, c, g, or t
tcagtctagcgactcacgaccggtgctcgatttagacacatacgcagggaaagggcttgatgccttggggtgggaggagagacccctctcctgctcccctcctcactttctgcacagtctctgaggcctcctatgagctgacacagccaccctcggtgtcagtgtccccaggacaaacggccaggatcacctgctctggagaagcattgaccaaaaaaaatntgcttattggtaccaacagaagtcaggccaggcccctgtgctggtcatctatgaggacaacaaacgaccctccgagactccctgagagattactctggctcagctcgagggacaagtcggacctaccgttggccttcgtcgtaggtcggggccccgtagggtggacggataggaagctagaactactacgttgttaacgtcgagtggaccagcgtaggtaagaaactacgtaaggtggggttagtccggggtacgggaacgggaaccgaacggcgtacggaacccgttccgttaacgggtcaacggtcccgaaggtccctaccggcccccgttcgggtacctacgttccgttcccggtttccccgtccccgttccgtccgtacggtcccggtacgttacgtaccgg

SEQ ID NO: 131543 - DNA, 524 bp, Homo sapiens
  misc_feature: GYAE6OF02IWHEN.40.42.D09.1.454.CMB.1.raw
  modified_base (222)..(222): a, c, t, g, unknown or other
  misc_feature (222)..(222): n is a, c, g, or t
  modified_base (374)..(374): a, c, t, g, unknown or other
  misc_feature (374)..(374): n is a, c, g, or t
tcagtctagcgactcacgaccggtgctcgatttagacacatacgcagggaaagggcttgatgccttggggtgggaggagagacccctctcctgctccccctcctcactttctgcacagtctctgaggcctcctatgagctgacacagccaccctcggtgtcagtgtccccaggacaaacggccaggatcacctgctctggagaagcattgaccaaaaaaatntgcttattggtaccaacagaagtcaggccaggcccctgtgctggtcatctatgaggacaacaaacgaccctccgagatccctgagagattctctggctccagctcaggacaatcggccacttggctctcagtgggcccaggtgaggatgaanctgactactactgttactcagtggacagcagtgaaatgatggggtatcgggcggagggaccaaggctaggaccgttccaggtcaacgcccgaaggctcggcccctggtccacctctccgttccccgccctcctccaggtccgctagaccg

SEQ ID NO: 131544 - DNA, 734 bp, Homo sapiens
  misc_feature: GYAE6OF02GZTYZ.40.42.D09.1.454.CMB.1.raw
  modified_base (222)..(222): a, c, t, g, unknown or other
  misc_feature (222)..(222): n is a, c, g, or t
  modified_base (240)..(240): a, c, t, g, unknown or other
  misc_feature (240)..(240): n is a, c, g, or t
tcagtctagcgactcacgaccggtgctcgatttagacacatacgcagggaaagggcttgatgccttggggtgggaggagagacccctctcctgctccccctcctcactttctgcacagtctctgaggcctcctatgagctgacacagccaccctcggtgtcagtgtccccaggacaaacggccaggatcacctgctctggagaagcattgaccaaaaaaatntgcttattggtaaccaanagaagtcaggccaggcccctgtgctggtcatctatgaggacaacaaacgaccctccgagactccctgagagattctctggctccagctcgagggacaagtcggcctaccgttggctctcgaggtcggggcccagggtggaaggataggaacgtcgtacgaaccttacttacgttcgtttacctacgtaaggttcgggacctaaggaccgtaagggttaacgggtaaaattccgtaagggtttacggggggttaacgtttaccggggggacgggtaaacgggggtaacccgtaaagggtacccgttacgggtaacccggttcccgttaaacggggttccgaaaccgggtaccccgaaaggggtcccgttccccgggtacccccccggttccggggttaccctacccggtttcccggtttaccccgtttaccccccgtacccccgtttccccgttacccgtacccggtttcccggtaccgttaaccggtacccggg

SEQ ID NO: 131545 - DNA, 623 bp, Homo sapiens
  misc_feature: GYAE6OF02HY7O6.40.42.D09.1.454.CMB.1.raw
  modified_base (225)..(225): a, c, t, g, unknown or other
  misc_feature (225)..(225): n is a, c, g, or t
  modified_base (304)..(304): a, c, t, g, unknown or other
  misc_feature (304)..(304): n is a, c, g, or t
tcagtctagcgactcacgaccggtgctcgatttagacacatacgcagggaaagggcttgatgccttggggtgggaggagagacccctctcctgctacccctcctcactttctgcacagtctctgaggcctcctatgagctgacacagccaccctcggtgtcagtgtccccaggacaaacggccaggatcacctgctctggagaagcattagaaccaaaaaaaatntgcttattaggtaccaaacagaagtcaggccaggcccctgtgctggtcatctatgaggacaaacaaacgaccctacganactcctgagagtatttctcgtggccttcagctcgaggactaatcggcctaccttggctctcgaggtcggggaccagggtacggaggtatggaactcgtagtacctaactacttacgttactgaagtggacaggtacgagtaggtaaactcgtaaggttaggggtacgttacgggacggggtaacgggaaccgaaggtcgtacggtacccgtacgtacggtacgacgacccgaaggtccttccggccccgttcggtacccgtacttccgttacccgttaccccacccttccgtaccgttaccgtcgtaccttagtaccgg

SEQ ID NO: 131546 - DNA, 785 bp, Homo sapiens
  misc_feature: GYAE6OF02HC5I1.40.42.D09.1.454.CMB.1.raw
  modified_base (226)..(226): a, c, t, g, unknown or other
  misc_feature (226)..(226): n is a, c, g, or t
  modified_base (523)..(523): a, c, t, g, unknown or other
  misc_feature (523)..(523): n is a, c, g, or t
tcagtctagcgactcacgaccggtgctcgatttagacacatacgcagggaaagggcttgatgccttggggtgggaggagagacccctctcctgctccccctcctcactttctgcacagtctctgaggcctcctatgagctgacacagcccaccctcggtgtcagtcgtcccaggacaaacggccaggatcacctgctcgtggagaagcattgaaaccaaaaaaatntgtacttaatacggtaacaaacaagaagtcaaggccaacggccctgtcgtctggtacatctagtacgaggaaccaaacgaaaaccgacccgtacgaagtactacccgtagaagtagtactttccttagtcggtcctacgacgtacgtacggaagggaacctaaagtccggaaccctaaccgtttcggaccttacgtacggaacgggtccggggaccgtaaggggtagggaacggtagtagaacgtgtacgtaaccgtaacttacgtacgttaactacgtaggtacgacggaacgtanaagggttaacgtaaacgttacgaagggttaggggtacgttaccgggggacggtaaacgggaaccgtaaggtccggtaaaccggtacccggttaccgttaacgggtacctaaacccgggacccggtaaccggtcccggtaacccggtccccccggttaacgggtacccgttaacccgttaccccggttacccgttaaccccccgtaccccggtttaacccgtccggtaaaccggtttccggttaccgtacggttaaacccggg

SEQ ID NO: 131547 - DNA, 492 bp, Homo sapiens
  misc_feature: GYAE6OF02I64EW.40.42.D09.1.454.CMB.1.raw
  modified_base (185)..(185): a, c, t, g, unknown or other
  misc_feature (185)..(185): n is a, c, g, or t
  modified_base (195)..(195): a, c, t, g, unknown or other
  misc_feature (195)..(195): n is a, c, g, or t
  modified_base (199)..(199): a, c, t, g, unknown or other
  misc_feature (199)..(199): n is a, c, g, or t
  modified_base (220)..(220): a, c, t, g, unknown or other
  misc_feature (220)..(220): n is a, c, g, or t
  modified_base (320)..(320): a, c, t, g, unknown or other
  misc_feature (320)..(320): n is a, c, g, or t
  modified_base (454)..(492): a, c, t, g, unknown or other
  misc_feature (454)..(492): n is a, c, g, or t
tcagtctagcgactcacgaccggtgctcgatttagacacatacgcagggaaaggcttgatgccttggggtgggaggagagacccctctcctgcctccccctcctcactttctgcacagtctctgagcctcctatgagctgacacagccacccgtggtgtcaggtctcccaggacaaacggcaggntcactgctcngganaagcattagaaacaaaaaatntgtacttattacggaaccaaagagaaagtcgacggcctaacgggccctggtcgtctggtcatctatagaaggaacaaacaacgccctaccgagactcccngaacagtactctcgtcgctacgacgtcaggacggaactaaggtccgacctaacgttcggccttacgacgtagggtccgggaccgtagggacggaggtaacgagaagcgtaaggtacttaaccgtatacggtacnnnnnnnnnnnnnnnnnnnnnnnnnnnnnnnnnnnnnnn

SEQ ID NO: 131548 - DNA, 690 bp, Homo sapiens
  misc_feature: GYAE6OF02I6LE9.40.42.D09.1.454.CMB.1.raw
  modified_base (223)..(223): a, c, t, g, unknown or other
  misc_feature (223)..(223): n is a, c, g, or t
tcagtctagcgactcacgaccggtgctcgatttagacacatacgcagggaaagggcttgatgccttggggtgggaggagagacccctctcctgctccccctcctcactttctgcacagtctctgaggcctcctatgagctgacacagccaccctcggtgtcagtgtccccaggacaaacggccaggatcacctgctctggagaagcattgaccaaaaaaaatntgcttattcggtaaccaacagaagtcaggccacggcccctgtcgctggtcatctatgaggacaacaaaccgccctcgagactccctgagagtattctcgtggcctccagctcgaggacaagtcggcctacgttggcctctcgaggtcgggccctagggtggagggtatggaagtcttacgaaccttaacgttacgttacgttactacgtaggtacggaaccaggtacgtaagggtaagtaaacgttcgtagggttagggggttacttccggggacggggtaaacgggaaccctaagggtccgttaccgggtaacccggttaccggttaacgggtacccgaaccggaccccgtaacgggcccgttacccggtccccccggttagggttaccctacccggtttcccgttacccggttaccccctacccgttcctaaccggtaccggtaccggtaccgtacgtaacccgg

SEQ ID NO: 131549 - DNA, 669 bp, Homo sapiens
  misc_feature: GYAE6OF02HF5EK.40.42.D09.1.454.CMB.1.raw
  modified_base (220)..(220): a, c, t, g, unknown or other
  misc_feature (220)..(220): n is a, c, g, or t
tcagtctagcgactcacgaccggtgctcgatttagacacatacgcagggaaagggcttgatgccttggggtgggaggagagaccctctcctgctccccctcctcactttctgcacagtctctgaggcctcctatgagctgacacagccaccctcggtgtcagtgtccccaggacaaacggccaggatcacctgctctggagaagcattgaccaaaaaatntgacttatgtacaacagaagtcagccaggccctgtgctggtcatctatcgagaacaacaaaccgaccctacgagactcctgagagattctcgtcggctccagctcgacgggactaagcggccctaccgttcggccttcgtcgacggtcggggcccgtaggggtcggagggtagtagaacggtcgtacggtaactttactaacgttacgttacttcggtaaggtcggtacgagtacgtaaggtaaggtaaactcgtaaggttagggtacggttacggggagggttaccgggaaccgtaaggacgtacggtaacccgttacgtaccggttaacgaccggtaacccgaacggtcccgtaccggtcccccggtacgggtccttaaccttcccggtcccgttaccccggccccgtttacccgtccgttaccgggtccgaccgttagaacccggg

SEQ ID NO: 131550 - DNA, 854 bp, Homo sapiens
  misc_feature: GYAE6OF02JFXPM.40.42.D09.1.454.CMB.1.raw
  modified_base (248)..(248): a, c, t, g, unknown or other
  misc_feature (248)..(248): n is a, c, g, or t
tcagtctagcgactcacgaccggtgctcgatttagacacatacgcagggaaagggacttgatgccttgggtgggaggagagaccctctcctgctcccctcctcactttctgcacagtctctgagcctcctatgagctgacacagccacctcggtgtcagtcgtcccaggacaacggccaggatccgactgctctggaagcccaatatcgtaaaccaaaaacgtattcgactttagtaggtaccaaacngaagtcacgacgaccgtaccctcgtagtcgtaggtacgtctactacgtaggtacgaacgtaaccaaaccgtacccgtacccgaacggtcccctaagtaccgtagaaacgtttccgtacttagggtacccttccgacggttccaccgtacgggggtaccaacgggttaccggaacccgtacccggttacggtacccttcggtaccctaacggtttccgggggacccttacgggggtcggaagggtacgttcgggaaacgtcggtaaacggcctttaacgtacgttacgttaacctttacggtaaccgttgggtaaacgtacggtccgtaaggttacgggaaacgttaccgtaaagggtcggggttaacgtttcggggaacggttacgggggaacccgtaacgggtacccgtaaggggtacccggttaccgttaaaccggggttcccgaaacgggttcccgtaaacgggcccgtttaccgggccccccgtttacgggggacccccgttaacccgggttcccttaaccgggtttccccccgcccgtttttacccccggtacccggttaccggttacccgtcggtttacccggggaccctttaaccgggg

SEQ ID NO: 131551 - DNA, 694 bp, Homo sapiens
  misc_feature: GYAE6OF02HSY3J.40.42.D09.1.454.CMB.1.raw
  modified_base (225)..(225): a, c, t, g, unknown or other
  misc_feature (225)..(225): n is a, c, g, or t
tcagtctagcgactcacgaccggtgctcgatttagacacatacgcagggaaagggcttgatgccttggggtgggaggagagacccctctcctgctccccctcctcactttctgcacagtctctgaggcctcctatgagctgacacagcccaccctcggtgtcagtcgtccccaggacaaacggccaggatcacctgctctggagaagcattgaaccaaaaaaatntgacttattacggtaaccaacagaagtcaggccacggcccctgtgctggtcatctatgaggacaaacaaacgaccctacgagactccctaggagagtattctcgtcggcctccagctacgaagggactaaagtcggaccctaccgttggccttctacgacgggtcggggacccgaggggtacgggaaggtagtaggaacgtcgtacgtaacttactaacgttacgttactacgtaaggtacggacgtaaggcgtaaggtaggtaaatacgtaaggttacggggttaggttaccggggacggggaacgggaaccgtaacggtacgtaccggtacccggttaccgttaacgggtacgaaccgtacccgaacggtccgtacccggtacccccgtcggtaccctaccgttcccgttacccgttaccccctaccccgtttccgacccgtaccggtaccgtccgttacgtaccgg

SEQ ID NO: 131552 - DNA, 658 bp, Homo sapiens
  misc_feature: GYAE6OF02F9EKZ.40.42.D09.1.454.CMB.1.raw
  modified_base (222)..(222): a, c, t, g, unknown or other
  misc_feature (222)..(222): n is a, c, g, or t
tcagtctagcgactcacgaccggtgctcgatttagacacatacgcagggaaagggcttgatgccttggggtgggaggagagacccctctcctgctacccctcctcactttctgcacagtctctgaggcctcctatgagctgacacagccaccctcggtgtcagtgtccccaggacaaacggccaggatcacctgctctggagaagcattgaccaaaaaaatntgcttattggtaaccaacagaagtcaggccacggcccctgtgctggtcatctatgaggacaaacaaccgaccctccgagactccctgagagtattctcgtggcctccagctacgagggacaagtcggaccctaccgttggctctcgagggtcggggccctaggggtaggagggtatggaagtcgtagtacctaactacgttcgttacgtcgaggttcggaacacgacgtaggttaacgaaagttcgtaagggttgggggttagtttccggggacgggtaacgggaccgaagggtccgttacgggaacccgttccgtacggtaccgacgaccccggaggtccctcccggtcccccggtcggttacccgtaccgttcccgttccgttacccccgtaccccgttccgttaccgaccggttccgtaccgtacggtaccgg

SEQ ID NO: 131553 - DNA, 690 bp, Homo sapiens
  misc_feature: GYAE6OF02J2V6N.40.42.D09.1.454.CMB.1.raw
  modified_base (219)..(219): a, c, t, g, unknown or other
  misc_feature (219)..(219): n is a, c, g, or t
  modified_base (238)..(238): a, c, t, g, unknown or other
  misc_feature (238)..(238): n is a, c, g, or t
  modified_base (268)..(268): a, c, t, g, unknown or other
  misc_feature (268)..(268): n is a, c, g, or t
  modified_base (316)..(316): a, c, t, g, unknown or other
  misc_feature (316)..(316): n is a, c, g, or t
  modified_base (406)..(406): a, c, t, g, unknown or other
  misc_feature (406)..(406): n is a, c, g, or t
tcagtctagcgactcacgaccggtgctcgatttagacacatacgcagggaaagggcttgatgccttggggtgggaggagagaccctctcctgctcccctcctcactttctgcacagtctctgaggcctcctatgagctgacacagccaccctcggtgtcagtcgtcccaggacaaacggccaggatcacctgctctggagaagcattgacaaaaaaatntgacttattggtaaccaanagaagtcgaggccacgccctgtgctggtcngtctatgaggtaacaacaaccgaccctcgaacgcttcccagagacgtnttacctcgtcggacctcagcttacgaggactaacgtcggcctacgttggctcgtcgacggtcggaccgtaggtcggaggtacgtggaacncgtagtacgtaactacgttacgttaccgtgaacggttacggaagtacggtataacggtaaggtaagtaccgtggtaagggggttcgtaaccgggtacggggtacgggaacctacgggttaccgtaccgggtaacccggtttaccgggtaacggtacccgacgggtaacccgaacgtcccgttcccggtaccccggtcggttaaccctcgttcccggtttaaccccttccccggtacccctttcccggaccgttacgggttccccttacgttaacccgggtccgg

SEQ ID NO: 131554 - DNA, 603 bp, Homo sapiens
  misc_feature: GYAE6OF02JKOYZ.40.42.D09.1.454.CMB.1.raw
  modified_base (216)..(216): a, c, t, g, unknown or other
  misc_feature (216)..(216): n is a, c, g, or t
tcagtctagcgactcacgaccggtgctcgatttagacacatacgcagggaaagggcttgatgccttggggtgggaggagagaccctctcctgctcccctcctcactttctgcacagtctctgagcctcctatgagctgacacagccacctcggtgtcagtcgtcccaggacaaacggccaggatcacctgctctggagaagcattgacaaaaaatntgtcttatggtaccaacagtaagtcaggccacggccctgtcgcctggtcattctagtgaggaacaacgaaccgaccctcgagactccgagacgagtacttctcgtacgcctcgacgtctacgaggactaacgtcggacctacgttcggctacgtcgacggtcggggacctagggtacgggagtacgtaggaacgtcgtagactacgttacgttacgttactgacggtacggacacgcgtagtaggtaactcgagttgggtactcgggaggtaacggacgagtcgtacgaccgttcgtacgcgaacgcgacgtcctaccggtcccgtcgtcgtaccgttcgtacccgtcccgtaccgtccgtacgtacggtcctacgttacgtaccgg

SEQ ID NO: 131555 - DNA, 711 bp, Homo sapiens
  misc_feature: GYAE6OF02INQB5.40.42.D09.1.454.CMB.1.raw
  modified_base (221)..(221): a, c, t, g, unknown or other
  misc_feature (221)..(221): n is a, c, g, or t
  modified_base (302)..(302): a, c, t, g, unknown or other
  misc_feature (302)..(302): n is a, c, g, or t
  modified_base (335)..(335): a, c, t, g, unknown or other
  misc_feature (335)..(335): n is a, c, g, or t
tcagtctagcgactcacgaccggtgctcgatttagacacatacgcagggaaagggcttgatgccttggggtgggaggagagacccctctcctgctccccctcctcactttctgcacagtctctgagcctcctatgagctgacacagccaccctcggtgtcagtcgtccccaggacaaacggccaggatcactgctctggagagcattcgaaccaaaaaatntgacttaattcgtaaccaacagaacgtcgaggccacggcccctagtcgctggtcatctatgagacaacaacgccctacganactccgtagagagtattcgtctggacctccganctacgacggaacaagtcggaccctacgtttcgaccttcgtacgagggtccgggacccgtagggtacggaggtactaggaacgtcgtagtaaccttaaccttacgttacgttacgtcgtaacggttacggaactaacggtcgtaagggttaacgtaaaacgtcgttaaagggttggggtttaacggttccggggagggtaacccggaaccgtaacgcgtaacccggaccgttcccgtaagggttacccaaccgggtacccgaacgggtccctaccccggttaccccggtcccgggtacctaacccggtttccccgttcccggtttaccccccgtcccgttacccgtccgtaaccgtcccggtacgttacgtacccgg

SEQ ID NO: 131556 - DNA, 563 bp, Homo sapiens
  misc_feature: GYAE6OF02GLPU5.40.42.D09.1.454.CMB.1.raw
  modified_base (222)..(222): a, c, t, g, unknown or other
  misc_feature (222)..(222): n is a, c, g, or t
  modified_base (412)..(412): a, c, t, g, unknown or other
  misc_feature (412)..(412): n is a, c, g, or t
tcagtctagcgactcacgaccggtgctcgatttagacacatacgcagggaaagggcttgatgccttggggtgggaggagagacccctctcctgctcccctcctcactttctgcacagtctctgaggcctcctatgagctgacacagccaccctcggtgtcagtgtccccaggacaaacggccaggatcacctgctctggagaagcattgaccaaaaaaaatntgcttattggtaaccaacagaagtcaggccaggcccctgtgctggtcatctatgaggacaacaaacgaccctccgagactccctgagacgattcctctggctccagctcgagggacaatcggcccaccgttggctctcgaggtcggggcccagggtggaggatcggaagctagacctactacgtgttacnagtggacagcgagtagaaatcgagtggggtatcgggacggaggaccaagctaggacccgtcgtaggcacgccgaaggcctccgccccgtggtacctaccgttccttccgttccccgacccttccgtacgacggttccgacgttacgtacgg

SEQ ID NO: 131557 - DNA, 638 bp, Homo sapiens
  misc_feature: GYAE6OF02HS3KK.40.42.D09.1.454.CMB.1.raw
  modified_base (159)..(159): a, c, t, g, unknown or other
  misc_feature (159)..(159): n is a, c, g, or t
  modified_base (224)..(224): a, c, t, g, unknown or other
  misc_feature (224)..(224): n is a, c, g, or t
  modified_base (290)..(290): a, c, t, g, unknown or other
  misc_feature (290)..(290): n is a, c, g, or t
  modified_base (294)..(294): a, c, t, g, unknown or other
  misc_feature (294)..(294): n is a, c, g, or t
tcagtctagcgactcacgaccggtgctcgatttagacacatacgcagggaaagggcttgatgccttggggtgggaggagagacccctctcctgctccccctcctcactttctgcacagtctctgaggcctcctatgagctgacacagccaccctcggtntccgagtcgtccccaggacaaacggccaggatcacctgctctggagaagcattgacaaaaaaatntgcttatggtaccaacagagtcaggccaggcccctgtgctggtcatcatgagacaacaacgacccncganactccctagagagtacttctctcgcctccgagctacgagggactaagtcgcctaccgttggcctcgcgtagggtcgggcccgagggtaggacgagagtacgcgtgtacttacgtagttactactacgagacgtacagtaccgaggtagaactagtagggagggttcgtacgggacgggtaggaaccgtaggtccgttacggtacccgttccgtaacgggtccaaccggaccccggtaaggtcccgtacccggttacccccgtacgggttaccccgacgtttccccgtacccggttccccgtccccgtttaccgccgttacggtcccttaccggtgtaaccccgg

SEQ ID NO: 131558 - DNA, 762 bp, Homo sapiens
  misc_feature: GYAE6OF02JL97O.40.42.D09.1.454.CMB.1.raw
  modified_base (230)..(230): a, c, t, g, unknown or other
  misc_feature (230)..(230): n is a, c, g, or t
tcagtctagcgactcacgaccggtgctcgatttagacacatacgcagggaaagggcttgatgccttggggtgggaggagagacccctctcctgctccccctcctcactttctgcacagtctctgaggcctcctatgagctgacacagcccaccctcggtgtcagtcgtccccgaggacaaacggccaggatcacctgctcgtggagaagcattacgaacctaaaaaaatntagtactttattacggtaaccaaacagagtcgaacgccgacggcccctagtcgcgtggtacattactagtaggaacggaaccaaacaaccgtaccctaccgagtacctccgtaggagactacttctcgtcgcctaccgacgtctacggacggactaacgtcggtaccctaccgtttcggccttacgtacggtacgggtccgggtacccgtaggggtacggacggtagtacgggtaacgtcgtaacggtaacttaaccgttcgtttacggttacctaggtacggttacgaacgtcgtaaccgtaagggtaacgtaaacgttacggtacggggttacggggttaacgtcggggaaccgggttaacgggaccgtaacggtcgtaaccggtacccggttaccgtacgggtaccgaacccgtacgtaccgggtaccgtcccggtccccggttacggtaccctaccgttccccgttacccgtaaccccttacccgtccgttaccggtaacccggttcgttaacccggtacggtaccgg

SEQ ID NO: 131559 - DNA, 741 bp, Homo sapiens
  misc_feature: GYAE6OF02HJA5S.40.42.D09.1.454.CMB.1.raw
tcagtctagcgactcacgaccggtgctcgatttagacacatacgcagggaaagggcttgatgccttggggtgggaggagagacccctctcctgctccccctcctcactttctgcacagtctctgaggcctcctatgagctgacacagcccaccctcggtgtcagtgtccccaggacaaacggcaggatcacctgctctggagaagcattgaaccaaaaaaaatatagacttaattaggtaaccaaacagaagtcaggccaggcccctgtacgctggtctatactatggaaggaacaaacaaaccgacccgtaccgagactcccgtagagtagtacttctcgtcggtacctaccgagtcctacggaacgggaactaaaggtcggaccctaacgttcggaccttctacgtacgggtccggggaccctaaggggtaggacgggtaatagggaacggtcgtaggtaacccttaacgttacgttacgttaacgtacgtagggttacggaacgaggacgtaaagggtaggtaaagtcgtaaggttaggggttacgtacggggacgggtaacggggaacctaaggtccgtaccggtacccgttaccgttaacgggtcaaccggacccgaacgggtacccgtcccggtaccccccgttacggggttacctaaccttcccggttacccgttaccccccggtacccttacccggacgttaacccgggttcgtaaccgttacggtaaccggg

SEQ ID NO: 131560 - DNA, 715 bp, Homo sapiens
  misc_feature: GYAE6OF02G1UVL.40.42.D09.1.454.CMB.1.raw
  modified_base (230)..(230): a, c, t, g, unknown or other
  misc_feature (230)..(230): n is a, c, g, or t
  modified_base (568)..(568): a, c, t, g, unknown or other
  misc_feature (568)..(568): n is a, c, g, or t
  modified_base (572)..(572): a, c, t, g, unknown or other
  misc_feature (572)..(572): n is a, c, g, or t
tcagtctagcgactcacgaccggtgctcgatttagacacatacgcagggaaagggcttgatgccttggggtgggaggagagacccctctcctgctccccctcctcactttctgcacagtctctggaggcctcctatgagctgacacagcccacccgttcggtgtcagtcgtccccgaggacaaacggccaggatcactgctcgtggagagctattacgaacaaaaaaatntgtactttagttacggtaaccaacgagtaacgtacgacggccacgggtcccctggtcgtcgtcgggtactacgttacttaggtaggaacggaaacctaaaccgaaaacccggtacccccttaccggaacggtacccttcccggtagggaacggtaacgtaacgtttccgtacggtccggtacccgtacccgacgtccgtaaccggaaggggtaactaacggtccggacccttaccgtcggtcctacacggtagggtccggggacccgtagggggtggacgggtacgtaggtaacgtcgtagtaaccgtaacgttcgttacgtacgtcgtagtacgganacgnaggtacgaatgtaggttggtacggtcgggacgggacggacgacgtccacggtaccgtacgtcgacgaccgtccgacgaccgtcccgacccgtcgtacctcgtccgtcccttacccgtcctcctacgacgtacgtcaacgtcgg

SEQ ID NO: 131561 - DNA, 880 bp, Homo sapiens
  misc_feature: GYAE6OF02FKOD6.40.42.D09.1.454.CMB.1.raw
  modified_base (205)..(205): a, c, t, g, unknown or other
  misc_feature (205)..(205): n is a, c, g, or t
  modified_base (224)..(224): a, c, t, g, unknown or other
  misc_feature (224)..(224): n is a, c, g, or t
tcagtctagcgactcacgaccggtgctcgatttagacacatacgcagggaaagggcttgatgccttggggtgggaggagagacccctctcctgcctcccctcctcacttctgcacagtctctgaggcctcctatgagctgacacagccaccctcggtgtcagtcgtccccaggacaaacggccaggatcacctgctctggagaancattagaaccaaaaaaatntgactttagttacggtaaccaaacgagaacgtcgacggccacggtcccctgtgccgtggtctactactatacggacgtacaaacgaaccggtacccctacggacgtactcccgtagtaacgacggtaacttccgttccggtacggtccttacccgaacggtcccttacgggaaccggggtaacaacgggttccgggtaccccttacccggtttagggacccctttccgtaaccggtacggggtcccgggggtacccgtagggggttgggaaacgggtagtacggtaaacgggtctaacgtaaccggttaacttaaccggttacgtttaacgtacggtacgggtaaccggtaaccgaggtaaccggtagggttaaacggtaacgttacggtaaggggtttcccgggggtttaaacggttccgggggggaaacccggggttaacggggtaaaccccgtaacgggtaaccgttaacccgggttaccgtacccgggttttaaacgggacccgaacgggtaccccggtaacgggtccctaccccggttaccccggttaccgggaccgtttaccccgtacccggtttaccccggttacccccgttacccccgttacccgtacccgttcgggtttacccggtaaccgttacggtaacccgggg

SEQ ID NO: 131562 - DNA, 821 bp, Homo sapiens
  misc_feature: GYAE6OF02H8YMV.40.42.D09.1.454.CMB.1.raw
  modified_base (229)..(229): a, c, t, g, unknown or other
  misc_feature (229)..(229): n is a, c, g, or t
tcagtctagcgactcacgaccggtgctcgatttagacacatacgcagggaaagggcttgatgccttggggtgggaggagagaccctctcctgcctccccctcctcactttctgcacagtctctgaggcctcctatgagctgacacagcccaccctcggtgtcagtcgtccccaggacaaacggccaggactcactgctctggagaagctattacgaaccaaaaaaaatntgtactttattacggtaaccaacaagaacgtacgacggccgtacggtccccttaggtcgtcgttacggtactaagttaccttagtaggaacggaaaccaacgaaaacccgtaccccgtacgacgtaaccttacccgtaggaacgtaggttactttaccgtcgtggtaccctcgacgtcctacggaacggtaactaacgtcggaccctacggtttcggccttaccgtacggtagggtacccggggtaccgtagggtacggggtacggtaacgttaggaaccggttccgtaacggtaacctttaaaccgtttaccggttttagttaaccgtacggtaacgggttacgaaaccgtggtaaccgtaacgggttaaggtaaacgttaccggtaagggtttacgggggtaaccgttaccgggggaaccggggtaaacggaacccggtaacggtcccgttaaccggtacccgttaaccggttaacggtacgaaccgggttacccgacggtccccgtaccggttaccccgtcggtacctaccgttcccgtttacccgtccccgtccttaccgcgttaaccgtcgtaacccgtgtaacccg

SEQ ID NO: 131563 - DNA, 684 bp, Homo sapiens
  misc_feature: GYAE6OF02FVTVL.40.42.D09.1.454.CMB.1.raw
  modified_base (222)..(222): a, c, t, g, unknown or other
  misc_feature (222)..(222): n is a, c, g, or t
  modified_base (411)..(411): a, c, t, g, unknown or other
  misc_feature (411)..(411): n is a, c, g, or t
tcagtctagcgactcacgaccggtgctcgatttagacacatacgcagggaaagggcttgatgccttggggtgggaggagagacccctctcctgctcccctcctcactttctgcacagtctctgacggcctcctatgagctgacacagccaccctcggtgtcagtcgtcccaggacaacggccaggactcactgctctggagacgctattacaacaaaaaatntgactttagttacggaaccaagacgaagtcgacggaccgacggccctgtcgctggtacattctagtgagaacaaacaaccgaccctacgaactctccagacgagtacttcgtcgtcggcctaccgagccttacggaaggactaacggtcggacctaccgttggtcctctacgacggggtccgggaccgngggttacgggaggacgtaggaacgtcttaacgtaaccgttaccgttaacgttcggtttaacctcgtaaagggtccggaacgtaggacgtaagggtaactaagtaccgtagggttcgggtacgttccggggaacgggtacgaaccgtcgcgttaccggacccgttacggacgtacgaaccgtaccggacgtaccgtcccggtccccgtcggtacccttaccgttcccgttcccgtcccctaccttcccgtacgaccggttcgccttacggccgg

SEQ ID NO: 131564 - DNA, 748 bp, Homo sapiens
  misc_feature: GYAE6OF02FMHMA.40.42.D09.1.454.CMB.1.raw
  modified_base (578)..(578): a, c, t, g, unknown or other
  misc_feature (578)..(578): n is a, c, g, or t
tcagtctagcgactcacgaccggtgctcgatttagacacatacgcagggaaagggcttgatgccttggggtgggaggagagacccctctcctgctcccctcctcactttctgcacagtctctgaggcctcctatgagctgacacagccaccctcggtgtcagtcgtccccaggacaaacggccaggactccacctgctcgtggagaacgctattagaaacctaaaaaaaatgtcgtacgtttaagtttacggtaaaccaaacgaaggtaaacgtccgaaccgggacccgacggtcccctggtcgtcgtcggtactagttactatcgggaacgtaaccaaaaccgaaacccggacccgtaccgtagtacctccgtagagagttactccgtactcgggcctacgaccgtccgttacggaacggtacgtaagtccggtaacccttaccggtttcggccttacggtccggtaacggggtcccggggaccgttaagggggtcggaaggtacggaaggacgtacgtacgtaacgtacctttcgtacgttacgacggtaggtacgacgtagacgtagtaagtaancgttgggtaagggtcggtacgggacgggtaacgacgtacgaccgtcgtaccgtaccgtacgaccgtaccgacgtcggtccgtcccgtaccccggtagtcccgtacgtccccgtttccgtaccccgttcccgttacctaccggtcggttacccggtacgtaccgttccggg

SEQ ID NO: 131565 - DNA, 519 bp, Homo sapiens
  misc_feature: GYAE6OF01DYZPN.36.7.A07.1.454.CMB.1.raw
  modified_base (395)..(395): a, c, t, g, unknown or other
  misc_feature (395)..(395): n is a, c, g, or t
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacaatccagatgacccagtctccatcctccctgtctgcatctgtaggagacgagagtcaccatctcttgcgggcagtgaggacattgtcaattatttagcctggtatcagcagagaccgagggagagttcgtaagctccgtgatctatgctgcctcctattttgctagtcgagggtcccatctcggttcagtggcagtggatcgtggacagtatttcactctacacatcagcagctgcagcctagaagntgttacgactaactttattatttgtactaaaagtataaactagtacgtccttaccgcttccgtaaccgtttcgggaccgggtaacggggtaacccgtaagggttaggtacgttagtaaacccgg

SEQ ID NO: 131566 - DNA, 518 bp, Homo sapiens
  misc_feature: GYAE6OF01BID9E.36.7.A07.1.454.CMB.1.raw
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcaccatctcttgtcgggcagtgaggacattgtcaattatttagcctggtatcagcagagaccagggagagttcctaagctcctgatctatgctgcctcattttgcagtcaggggtcccatctcggttcagtggcagtggatctgggacagatttcactctcaccatcagtcagcctgcagcctgaacgatgttgactaactttattattgtaactaaaagtattaaacaagttcgaccccgtattaccgtaccttttccgggacggtaacggggtaacccgtaaaggggtagggaacgtagtacgtaaaaacccggg

SEQ ID NO: 131567 - DNA, 470 bp, Homo sapiens
  misc_feature: GYAE6OF01B1QW4.36.7.A07.1.454.CMB.1.raw
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcaccatctcttgtcgggcagtgaggacattgtcaatatttagcctggtatcagcagagaccagggagagttcctaagctcctgatctatgctgcctccattttgcagtcaggggtcccatctcggttcagtggcagtggatctgggacagatttcactctcaccatcagcagcctgcagcctgaagatgttgctaactttattattgtacaaaagtataaacagtgctccgctcactttcggcggtagggaccaaggtggatgtaaccg

SEQ ID NO: 131568 - DNA, 473 bp, Homo sapiens
  misc_feature: GYAE6OF01CKF7N.36.7.A07.1.454.CMB.1.raw
  modified_base (269)..(269): a, c, t, g, unknown or other
  misc_feature (269)..(269): n is a, c, g, or t
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcaccatctcttgtcgggcgagtgaggacattgtcaattatttagcctggtatcagcagagaccagggngagttcctaagctcctgatctatgctgcctccattttgcagtcaggggtcccatctcggttcagtggcagtggatcgtgggacagatttcactctcaccatcagcagcctgcagcctagaagatgttgctaactttattattgtactaaagtataaacagtagcctcgctcacgtttcggcggagggacaaggtgatagtaacg

SEQ ID NO: 131569 - DNA, 525 bp, Homo sapiens
  misc_feature: GYAE6OF01D0EQH.36.7.A07.1.454.CMB.1.raw
tcagtacgctgtctcacgaccggtgctcgatttagcacgtgtcgcaggggacccaaaaccacacccctccttgggagaatcccctagatcacagctcctcaccatggactggacctggagcatcctttttcttggtggcagcagcaacaggtgcccactcccaggttcaattggtgcagtctggagctgaactgaagaagcctggggccttagtaaacgtctcctgcaaggcttctggttactcctttcttacgtatggcatcagctgggtgcgacaggcccctggacaagggctcgagtggatggggtggatcaggcctaacatggttacacaaactatgcacggaagttgcaggacagaatgaccatgaccacagacacgtccacgagcacagcgtacatggaactgaggagcctgagacctggacgacacggccaagtatattactgtgcgagaataaccgggatccgtatgttgatttagtttggggattcgatgtattacctttagattgtcgtacgggg

SEQ ID NO: 131570 - DNA, 556 bp, Homo sapiens
  misc_feature: GYAE6OF01CKAKG.36.7.A07.1.454.CMB.1.raw
  modified_base (194)..(194): a, c, t, g, unknown or other
  misc_feature (194)..(194): n is a, c, g, or t
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatgacccagtctccatcctccctgtctgcatctgtagganacagagtcaccatctctgtcgggcgagtgaggacattgtcaattatttagcctggtatcagcagagaccagggagagttccaagctcctgatctatgctcgccttcctattttgctacggtcgtacggggtccctagtcgttcggttcaggtcggctaggtggtatcgtgggactagtattcacttctacacctatcagtcagtccctgcagcctgaatattgttacgacttaagtttactttattacgtaactaaaagttactaaacgtagtcgtccttacccggtacttccgttacggttttacccggggacggtaacggggtaacccgtaagggtacggtaaagttaacgttaaaccgg

SEQ ID NO: 131571 - DNA, 466 bp, Homo sapiens
  misc_feature: GYAE6OF01AXW47.36.7.A07.1.454.CMB.1.raw
  modified_base (418)..(418): a, c, t, g, unknown or other
  misc_feature (418)..(418): n is a, c, g, or t
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcaccatctcttgtcgggcagtgaggacattgtcaattatttagcctggtatcagcagagaccagggagagttcctaagctcctgatctatgctgcctccattttgcagtcaggggtcccatctcggttcagtggcagtggatctgggacagatttcactctcaccatcagcagcctgcagcctgaagatgttgctaacttattattgtacaaaagtntaaacagtgctccgctcactttcggcggtaggacaaggtgatgtaacg

SEQ ID NO: 131572 - DNA, 529 bp, Homo sapiens
  misc_feature: GYAE6OF01CEQQ9.36.7.A07.1.454.CMB.1.raw
  modified_base (398)..(398): a, c, t, g, unknown or other
  misc_feature (398)..(398): n is a, c, g, or t
tcagtacgctgtctcacgaccggtgctcgatttagcacgtgtcgcagggggcagaagtctctctcaatcaggacacagcatggacatgagggtccctgctcagctcctgggactcctgctgctctggctcccagataccagatgtgacatccagatgacccagtctccatcctccctgtctgcatctgtaggagacagagtcaccatctcttgtcgggcgagtgaggacattgtcaattatttagcctggtatcagcagagaccagggagagttacctaagctcctgatctatgctgcctcctatttgctagtcgacggggtcccatctcggttcagtggcagtggatcgtgggacagtattcactctcaccatcagcagcctgcacgccgtgaacgnttggttacgactaactttattattagtaactaaaagtactaaactaggttcgtccgttaccgacttcgtaccgttttacgggaccgggtaacggggacccgtaaagggttcggtaaacttagtaaacccgg

SEQ ID NO: 131573 - DNA, 515 bp, Homo sapiens
  misc_feature: GYAE6OF01BVNXJ.36.7.A07.1.454.CMB.1.raw
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatgacccagtctccatcctcctgtctgcatctgtaggagacagagtcaccatctcttgcgggcagtgaggacattgtcaattattagcctggtatcagcagagaccagggagagttcctaagctcctgatctatgctgcctcctatttgctagtcagggtcccatcgtcgttcagtggctagtggatcgtgggacagtatttcgactctacacatcagcacgcctgcagcctagaagtatgttagctaactttattattacgtataaaagttactaaacgtagttacgccgttaccgacgttcgtaccgttttacgggaccggtaacggggaacctaagggtaggtaagttacgtaaaccg

SEQ ID NO: 131574 - DNA, 609 bp, Homo sapiens
  misc_feature: GYAE6OF01BX56W.36.7.A07.1.454.CMB.1.raw
tcagtacgctgtctcacgaccggtgctcgatttagcacgtgtcgcagggggcagaagtctctctcagtcaggacacagcatggacatgagggtccctgctcagctccgtgggactcctgctgctctggcctcccagactaccagatgtgacatccagatcgacccagtcctccatccctccctgtctgctatctggtaggagacagagtcaccatctcgttggcgggcgagtgaggacattgtactaattattagcctggtatcagacagagaccgagggagtacgttacctaagtcctcctagacttcgtatcgtctcgtccttcctatttcgctacggtcgtacgggtcccagttcgtcggttctaggtggtcgaggtggactcggtagggactaggtactttaccgtacgtcctaccaactactaccgagcctacgcccgtagcctacggtccctaaggtaacgtagttcggttacgtaccttaaattttatttaacgttacgttaaacgtaaaagttaactacgtaggttactaccgtcccgtacttacgttaccggtttacgggacgggtaacgggaacgtaagggtagtaatacgtaaaccgg

SEQ ID NO: 131575 - DNA, 470 bp, Homo sapiens
  misc_feature: GYAE6OF01A19YC.36.7.A07.1.454.CMB.1.raw
  modified_base (465)..(465): a, c, t, g, unknown or other
  misc_feature (465)..(465): n is a, c, g, or t
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcaccatctcttgtcgggcgagtgaggacattgtcaattatttagcctggtatcagcagagaccagggagagttcctaagctcctgatctatgctgcctccattttgcagtcaggggtcccatctcggttcagtggcagtggatctgggacagatttcactctcaccatcagcagcctgcagcctgaagatgttgctaactttattattgtactaaaagtataaacagtgctccgctcactttggcggagggaccaaggtgagtntaacg

SEQ ID NO: 131576 - DNA, 566 bp, Homo sapiens
  misc_feature: GYAE6OF01BWQD0.36.7.A07.1.454.CMB.1.raw
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcaccatctcttgtcgggcagtgaggacattgtcaattatttagcctggtatcagcagagaccgagggagagttcctaagctcctgatctatgctcgcctcctattttgctagtcgacggggtcccatccgtcggttcagtggcaggtggatcgtgggactaggtatttcacgtctacacctactcagccacgtccctgcctacgccgttagaaacgtattggtttacgtacttaaactttaattaagtttacgtaactaaaaagttaagttaaacgtaggttacgccgttaccggtacttcgttaccgtttaccgggacgggtaacgggtaaccgtaagggtacggtaagttaacgtaaacccgg

SEQ ID NO: 131577 - DNA, 512 bp, Homo sapiens
  misc_feature: GYAE6OF01B2NTJ.36.7.A07.1.454.CMB.1.raw
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcaccatctcttgtcgggcagtgaggacattgtcaattatttagcctggtatcagcagagaccagggagagttcctaagctcctgatctatgctgcctccattttgcagtcagggtcccatcgtcgttcagtggcagtgatcgtgggacagtatttcactctcaccatcagcagctgcagcctagaagatgttgtactaactttattaattgtaactaaaagttattaaactagtacgtcccgtacgtcctaacttccggtaccgggaacggtaccgggtaaacggtaagggtagtacgtataaaaacccgg

SEQ ID NO: 131578 - DNA, 498 bp, Homo sapiens
  misc_feature: GYAE6OF01C1262.36.7.A07.1.454.CMB.1.raw
tcagtacgctgtctcacgaccggtgctcgatttagcacgtgtcgcagggggcagaagtctctctcagtcaggacacagcatggacatgagggtccctgctcagctcctgggactcctgttgctctggctcccagataccagatgtgacatccagatgacccagtctccatcctccctgtctgcatctgtaggagacagagtcaccatctcttggtcgggcagtgaggacattgtcaattattagcctggtatcagcagagaccgagggagagttacctaagctcctgatctatgctgtcctctattttgctagtcacggggtcccagtctcggttcagtggcagtgatcgtggacagtatttcactctcacatcagcagcctgcagcctagaagtatgttagactaactttattattagtactaaaagtaataactagtgcctccgtcttcgtacgttcggacggagggaccgtaaggtaggaactgtacgtaaaacg

SEQ ID NO: 131579 - DNA, 553 bp, Homo sapiens
  misc_feature: GYAE6OF01CKTAB.36.7.A07.1.454.CMB.1.raw
  modified_base (394)..(394): a, c, t, g, unknown or other
  misc_feature (394)..(394): n is a, c, g, or t
tcagtacgctgtctcacgaccggtgctcgatttagcacgtgtcgcagggggcagaagtctctctcagtcaggacacagcatggacagtggggtccctgctcagctcctgggactcctgctgctctggcctcccagataccagatgtgacatccagatgacccagtctccatccctcctgtctgcatctgtaggagacagagtcaccatctcttggtcgggcagtgagacattgtcaattattagcctagtatcagcagagacgaggagagttaccaagtctctgatctatgctcgcctctatttcgctagtcgagggtcccagtcgtgttcagtgcgagtgagtcgtaggacagtcttcactctacacatcagcacgctgcacgtctagaagtnttagtcgaactaatttattaacgttagtaactaaaagttactaaacgtagtacgtaccgtacccgtacgttacccgttacggttttacccggggaaccgggtaacgggtaacccggtaaagggttaagggtacttaaaacgtaacccggtaaaaaacgg

SEQ ID NO: 131580 - DNA, 570 bp, Homo sapiens
  misc_feature: GYAE6OF01CNWQE.36.7.A07.1.454.CMB.1.raw
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcaccatctcttggcgggcgagtgaggacattgtcaattattagcctggtatcagcagtacgaccgagggagagttacctaagctcctagatctatgctcgcctcctatttgctagtcgacgggtcccatcgtcggttcaggtggcaggtgatcgtagggacagtacgtttcacttcgtacaacctatccgagacagccctgaccagacctggaaagtattggttacgacttaaactttaagtttacttacggtaactaaaaagttacgtaaactacggttacgtcccttacccgtactttaaccgtaccggtttcgggaccgggtaacgggtaacccgtaaggggttacgtaagtaacgttaaaaccgg

SEQ ID NO: 131581 - DNA, 865 bp, Homo sapiens
  misc_feature: GYAE6OF01DDU8K.36.7.A07.1.454.CMB.1.raw
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatcgacctactcctacctctcctccgtcgtctcgtctactcgtaggaggacgaacgtagtacctacctactcgttcgttcggtcgggtacggtacggtaggtacggtacgtaacttagttaccgttaaacgttaacgtttttacgtaccgttcgtagtaccgcgaacgaacggaacggtaccggtaacgggtagggttaacttaccccggttacgtaaccgttccttacggttaatccgttacgttcggtcccgttacccgttccgtttaccccgtagtttttaacggtaccgtaacggggttacccggtacggggtttaccccttaaccgttcggtttaccccgggttaggttaccgggacgggttccggaaagtttcgggtacccgtagggtaccgtaaggttaacctttacgttacctttacccgtacctaacccgtacgtaccgtaacgtaccccgtaaggtacccgttacggaccgttacggtacccgttaacggtaacgttacgttaacggttagttaaaccccgtttaatttaaacctttaacgtttacttaaacggtaaacgtttaaacgtaaacgttacgttaccggtaacccgttcccgtaccgttaacccggttaccggttaccgggtaaccggggtaaccgggtaaaccgggtaacgggtaaacggttacgtaacttaaaccggtaacggtaaaccggg

SEQ ID NO: 131582 - DNA, 673 bp, Homo sapiens
  misc_feature: GYAE6OF01CUY2W.36.7.A07.1.454.CMB.1.raw
  modified_base (194)..(194): a, c, t, g, unknown or other
  misc_feature (194)..(194): n is a, c, g, or t
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatgacccagtctccatccctcctgtctgcatctgtagganacagagtcaccatctcttggcgggcagtgaggacattgtactaattatttagcctggtatcagcagagaccgagggagtacgttacctaagccttccgtgtaactcttaatcgccgttcgtcccttccttattttcgactaggtccgtacggggtccctaagtccgttcggttactaggtggcgtaggtcggtacttcgtagggtactagtactttccaccgttacctacaccatacgagccacgcctgacacgtccgtagaacgtagttacgttacgtaccttaaacgtttacttaacgtttacgtaaaccttaaaaagttaaccgttaaaccgtacggttacgtacccgttaccccggttaaccgttaacccgtttaacccgggtttttacgggggacccggggggtaaaacgggggttaaacccccggtaaaaggggtttaccggggtaaacttttaaacggttaaaaaccccggg

SEQ ID NO: 131583 - DNA, 530 bp, Homo sapiens
  misc_feature: GYAE6OF01BY5D8.36.7.A07.1.454.CMB.1.raw
  modified_base (458)..(458): a, c, t, g, unknown or other
  misc_feature (458)..(458): n is a, c, g, or t
  modified_base (518)..(518): a, c, t, g, unknown or other
  misc_feature (518)..(518): n is a, c, g, or t
tcagtacgctgtctcacgaccggtgctcgatttagcacgtgtcgcaggggacccaaaaaccacacccctccttgggagaatcccctagatcacagctcctcaccatggactggacctggagcatcctttttcttggtggcagcagcaacaggtgcccactcccaggttcaattggtgcagtctggagctgaactgaagaagcctggggccttagtaaacgtctcctgcaaggcttctggttactcctttcttacgtatggcatcagctgggtgcgacaggcccctggacaagggctcgagtggatggggtggatcgaggcctaacgaatgggttaacacaaactatagcgacggaagttgtaaggacagaatgaccatgacacagacacgtcacgagcacagcgtacatggaactggaggagcctagacgaccgtgacgacacggccatatattacgngtgacgagaataccggatccgtatgtagtagttagtttgggattcgatgattctttgatntcgtgggtaccg

SEQ ID NO: 131584 - DNA, 682 bp, Homo sapiens
  misc_feature: GYAE6OF01BHN83.36.7.A07.1.454.CMB.1.raw
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatgacccagtctccatcctccctgtctgcatcgtgtaggagacagacgtccacctatcctcgttggtacggggcgaaggttggaaggtactagtttgtactaatttatttacgccttggtatcgagcgagacgaccgagggacgtacgttaccgtaacgtcctaccgtagtattcgtatcgtccttcgtcccttacttagttttcgccgtaggttccggtacggggttcccctagtttccgttccgggtttacgagggttcggtcgtaaggttggtacgttcggtagggactagttactttcgaccgttctaccacctagtccagtccacgtccctaggctacgaccgtagaacgtagttacgtacgtaaccttaactttagttaacgttagttaaacgtaaaagttactaaacgtaggttaccgtccgttaccgttaccttaccgggttaaccgtttacccgggggaaccgggtaacgggtaacccggttaaaggggttaccgtaaagtttaaccggtaaaacccgg

SEQ ID NO: 131585 - DNA, 639 bp, Homo sapiens
  misc_feature: GYAE6OF01D4TVP.36.7.A07.1.454.CMB.1.raw
tcagtacgctgtctcacgaccggtgctcgatttagcacgtgtcgcgagggggcagaagtctctctcagtcaggacacagcatggacatgagggtccctgctcagctcctgggactcctgctgctctggcctccagataccagatgtgacatccagatcgacccagtctccatcctccctgtctgcatctggtaggagacagacgtcaccattcctcgttcggtcgggctaggtggaacggactagttggttacctaaattttatttaagccgttaggtacttcagacgaagacgaaccgaggggtagtacgttccgtaagtccttcgtagacttcgtatgctcgtcctctatttgctacgtcgtacgggtccctatcgttcggtcaggtcggataggtggactcgtaggtactagttacttctaacgtctaccgtacacgttaccacgtcgacgtctacgccgtaagtcccgtaagaaccgttagtcgttacgtaactttaacgttttaacttacgtttaacttaaacgtaaaagttaacttaaaccgagtttaccgtaccgttacccgttacttaccggttaacgttcgggaaccgggttacggaaccggtaaggtacggtaataacgtaaaacccgg

SEQ ID NO: 131586 - DNA, 511 bp, Homo sapiens
  misc_feature: GYAE6OF01B6QKA.36.7.A07.1.454.CMB.1.raw
  modified_base (389)..(389): a, c, t, g, unknown or other
  misc_feature (389)..(389): n is a, c, g, or t
  modified_base (435)..(435): a, c, t, g, unknown or other
  misc_feature (435)..(435): n is a, c, g, or t
tcagtacgctgtctcacgaccggtgctcgatttagcacgtgtcgcagggggcagaagtctctctcagtcaggacacagcatggacatgagggtccctgctcagctcctgggactcctgctgctctggcctcccagataccagatgtgacatccagatgacccagtctccatcctccctgtctgcatctgtaggagacagagtcaccatctcttgtcgggcagtgaggacattgtcaattatttagcctggtatcagcagagaccagggagagttcctaagctcctgatctatgctgcctctattttgctagtcgagggtcccatcgtcgtcagtggcaggtgatcgtgggactgtatttcactctcacctatcacgacacgtcctgccngcctgaagtatgttgtactactttattagttagtaactaaaagttntaaactagtcgtctcccgcttccgtacgtttcgggacggtacgggtaaccgtaaggtacggagttacgtaaaccgg

SEQ ID NO: 131587 - DNA, 526 bp, Homo sapiens
  misc_feature: GYAE6OF01B4VVS.36.7.A07.1.454.CMB.1.raw
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcaccatctcttgtcgggcgagtgaggacattgtcaattatttagcctggtatcagcagagaccgagggagagttcctaagctcctgatctatgctgcctcctatttgctagtcagggtcccatctcggttcagtggcagtggatcgtgggacagtactttcactctcacctatcagcagcctgcagcctagaagtattgtgtactaactttattattagtaactaaaagttataaacgtagtacgtccttccgacgttcgttaccgtttccggggacgggtaacgggtaaccgtaaagggttcggtaaagttaacgtaaacccgg

SEQ ID NO: 131588 - DNA, 496 bp, Homo sapiens
  misc_feature: GYAE6OF01EBPZ4.36.7.A07.1.454.CMB.1.raw
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcaccatctcttgtcgggcagtgaggacattgtcaattatttagcctggtatcagcagagaccagggagagttcctaagctcctgatctatgctgcctccattttgcagtcaggggtcccatctcggttcagtggcagtggatcgtgggacagtatttcactctcaccatcagcagcctgcagcctagaagtatgttgactaaacgtttattaattagtactaaaagtataaacagtgccttccgacttcacgtttcggacgggtacgggaccgtaagggtcggaatagtaaaccg

SEQ ID NO: 131589 - DNA, 626 bp, Homo sapiens
  misc_feature: GYAE6OF01BQGOG.36.7.A07.1.454.CMB.1.raw
  modified_base (207)..(207): a, c, t, g, unknown or other
  misc_feature (207)..(207): n is a, c, g, or t
  modified_base (219)..(219): a, c, t, g, unknown or other
  misc_feature (219)..(219): n is a, c, g, or t
tcagtacgctgtctcacgaccggtgctcgatttagcacgtgtcgcagggggcagaagtctctctcagtcaggacacagcattgacatgagggtccctgctcagctcctgggactcctgctgctctggctccagataccagatgtgacatccagatcgacccagtcctccatcctccctgtctgcatctgtagagacagacgtcaccntctcgtgcgggngagtgaggactattgtactaattattacgccttaggtatcgagcagacggaccgagggtagtacgttacctaagcctccgtagtacttacgtatcgtcttacgtcccttacctattttcggactacggtccgtacggggtcccctagttccgttcgggttacacgggttcggacgtaacggtggtaacgttcgtacgggacctagttactttcacttcctaccgaactacttcgacgtaccgtacgtcctgaccgtacgtcctaggaacgtattcggttacgtaacgttaactttagttattacgtaacgttaaaacgttactaaacgtacgtcgtaccttccgtacttccggtacgtttccgggacggtaacggtaaccgtaagggtccgtaagtaccgtaaacgg

SEQ ID NO: 131590 - DNA, 620 bp, Homo sapiens
  misc_feature: GYAE6OF01A3AAW.36.7.A07.1.454.CMB.1.raw
tcagtacgctgtctcacgaccggtgctcgatttagcacgtgtcgcagggggcagaagtctctctcagtcaggacacagcatggacatgagggtccctgctcagctcctgggactctgctgctctggctcccagataccagatgtgacatccagatgacccagtctccatccctcctgtctgcatctgtaggagacagagtcaccatctcgttggtcgggcgagtggaggactagttgtactaatttatttacgccttggtatcgagtcaggacgaccgaggggacgagttcctaagctctgtatctatgctcgtccttcgtattttgctaggtcgtacgggtccctatcgttcggtctaggtggctaggtggtatcggtagggtactaggttactttcgaccttcgtaccaccgtatccgagtccgacgtcccgtagccgtaacgcccgttaggaacgttagtggttacgtaaccttaacgttttattaagtttacggtaaactaaaacgttaataaaccgtaaggttacggcccttacccggtaccttacggttaccggtttaaccggggacgggtaacgggtaaccgttaagggtaacggtaattaacgtaaacccgg

SEQ ID NO: 131591 - DNA, 647 bp, Homo sapiens
  misc_feature: GYAE6OF01BN16Q.36.7.A07.1.454.CMB.1.raw
  modified_base (194)..(194): a, c, t, g, unknown or other
  misc_feature (194)..(194): n is a, c, g, or t
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatgacccagtctccatcctccctgtctgcatctgtagganacagagtcaccatctcttggtcggcgagtgagacattgtactaattatttagcctggtatcagcagacgaccgagggagtacgttacctaacgctccgtgatctatgctcgtcctctatttcgcgtagtcgtacgggtccctacgtcggttcggttacgtaggtcggtcgtaggtcggtacgttcggtacgggtaactagttacctttacctaccttacctacctaacctacgtaccgaggtaccgtacgtcccgtacgacgacgtaccgtaaggtaagttacgttacggttacgtaactttaaactttaagtttaacttaagtaaacgttaaaacgtaacgttaaacggtacgttaccggtacccgtacccgttaccgttaccggttacccgggttacgggaacgggtaaccgggtaacggtaagggttacgtaaacgtaccgtaaaaccgg

SEQ ID NO: 131592 - DNA, 690 bp, Homo sapiens
  misc_feature: GYAE6OF01DPHTD.36.7.A07.1.454.CMB.1.raw
  modified_base (193)..(193): a, c, t, g, unknown or other
  misc_feature (193)..(193): n is a, c, g, or t
  modified_base (198)..(198): a, c, t, g, unknown or other
  misc_feature (198)..(198): n is a, c, g, or t
tcagtacgctgtctcacgaccggtgctcgatttagcacgtgtcgcagggggcagaagtctctctcagtcaggacacagcatggacatgagggtccctgctcagctcctggactcctgctgctctggctccagataccagatgtgacatccagatcgacccagtctccatccctcctgtctgcatctgtagganacagntcacctatctcgttggcgggcagtgagactattgtactaatttagtttacgcttaggtactcgagacgaaggacgaccgagggtacgtacgttacctaacgtcctaccgtagtactactagtcgtcgtccgtccttaccgttagttttcgacgtacggtccgtaccggggttaccctacgttcgttcgggttacgtacggtcggtacgtacggtcggtacgtcggtacgggaactacgttactttccgacttacctaccgtaactacgtacgacgtaccgacgtcccgtgaccgtacggtaccgtagtaacgttacgttacgttaacgttacctttaaacgttttagttaacgtttaacgtaaaccgttaaaaagttaacgttaaaccgtcggttaaccgtcccgttacccggtacgtttaccggttaaccgggttccgggaaccgggtaacgggtaaccgtagggttacgtaaacgttacggtaaacccgg

SEQ ID NO: 131593 - DNA, 672 bp, Homo sapiens
  misc_feature: GYAE6OF01DS514.36.7.A07.1.454.CMB.1.raw
  modified_base (194)..(194): a, c, t, g, unknown or other
  misc_feature (194)..(194): n is a, c, g, or t
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatgacccagtctccatccctcctgtctgcatctgtagganacagacgtccacctattctcgttggtcgggacgagtgaggactagttgtactaattatttagctggtatcagcgagagaccgagggagtacgttaccgtaacgtcctctagtactctatcgtctcgtcctaccttatttcgactagtcgacgggtcccagttcgtcggttcaggtcggcgtaggtggtactcggtagggaactacgtactttccacgttcctaccgtaacctacttaccgaacgtccgacgtcccgttacgacccgtaacggtacccgtaaggtaacggttacgttacggttacgtaacctttaaacgttttaatttaacgtttaacgtaaacgttaaaaagttaactaaacggtacggttacgtacccgttacccgtaccgtttaccggttaacccggtttacggggaaccgggtaaacgggtaaccggttaaagggttaacgtaaacgttaaccggtaaaaccggg

SEQ ID NO: 131594 - DNA, 803 bp, Homo sapiens
  misc_feature: GYAE6OF01DBAX5.36.7.A07.1.454.CMB.1.raw
  modified_base (195)..(195): a, c, t, g, unknown or other
  misc_feature (195)..(195): n is a, c, g, or t
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatgacccagtctccatccctccctgtctgcatctgtagganacagagtccaccatctcgttggcgggcagtgaggacattgtactaattatttaagccttggtatcagcagacgaccgagggacgtagttacctaaggccttaccgtggtaacttctaagtcgtccgtcggtcccttaccttaagttttttcggaccgtaaaggttccgtaaccgggggttcccctaagttccgtttccgggtttaccgtagggttacgggtccgtaagggttcgggtacgttaccggttacggggaaccttaacgggttactttttacccgtaacccgtttcccttaaccgtaacccgtaacgttaccccgaaggtaccccgtaaggtccccgtttacggaccgtaaccgtaccccgttagggaaaacgttacgtttaacggtttacgggtaaccttaaaccgtttttaagttttaacgtttacggttaaaaccgttaaaaaacggttttaaacgtaaaacccgttaaggttacccgggttaacccgttacccggtacccgtttacccggttaacccggtttttaccggggacccggggttaaacggggtaacccgttaagggggttaacgggtaacgttaacgttaaaaaccccggg

SEQ ID NO: 131595 - DNA, 522 bp, Homo sapiens
  misc_feature: GYAE6OF01BA10H.36.7.A07.1.454.CMB.1.raw
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcaccatctcttgtcgggcagtgaggacattgtcaattatttagcctggtatcagcagagaccagggagagttcctaagctctgatctatgctgcctccattttgcagtcaggggtcccatctcggttcagtggcagtggatcgtgggactagtatttcactctcacatcagcacgcctgcagcctagaagatgttgtactaactttattattacgttaacgaaaagtaacttaaagacgttagtaccttaccgcttccttaccgtttccgggaccgggtaacggggacccgtaaaggggtcggtaaagttaagtaaacccg

SEQ ID NO: 131596 - DNA, 592 bp, Homo sapiens
  misc_feature: GYAE6OF01EI658.36.7.A07.1.454.CMB.1.raw
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagatcaccatctcttggcgggcagtgaggacattgtacaattattagctaggtatcagcagagaccgagggagagttacctagtctcctagatctatgctcgtcctctatttgctagtcgacggggtccctacgttccgttcggttaccgaggtcggtacgtaggtagggtacgttcggtacgggtactaaggtactttactaccttactaccaactacgtcacggacctacgtcctacgacgtacgtacgtacgtaagtacgttaggttataaccgtttaatttaacgtttaagttacgttaaactaaagttaactaacgtagtaccgtcctaccgtacttcgtaccgttcgggacgggtacgggtaacgtaagggtacggtataacggtaaacg

SEQ ID NO: 131597 - DNA, 717 bp, Homo sapiens
  misc_feature: GYAE6OF01DYZYB.36.7.A07.1.454.CMB.1.raw
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatcgacccagtcctccatccctccctgtctgcatctggtaggagacagactccaccattctcgttggtcgggcagtgaggactatttgtactaaattattttagccttaggtactcagtcgagacgaccgaaggggagtacgttaccgtaagccttccgtagtacttctagtcgtccgttcgtccccttaccgttagttttcggaccgtaacggttccggtacgggggttcccctaacgtttccgttccgggttccgtagggttcggacgtagggtcgggtattccggtaggggaacctaaggttactttactaccttcgtacccaactacttacgacgtccgaacgtccgtacggaccgtacggtaccgtaggaaagttcttcggtttaaccgtaacttttaaacttttaacgtttaagtttaacgtaaacgttaaaagttaactaaaccgtaggttccgttacccgttaccgttccgttacccggttaccgggttttaccggggaaccgggtaaccggggtaaccgtaagggggttaacgtaacgttaacgtaaaacccgg

SEQ ID NO: 131598 - DNA, 724 bp, Homo sapiens
  misc_feature: GYAE6OF01CURDC.36.7.A07.1.454.CMB.1.raw
  modified_base (188)..(188): a, c, t, g, unknown or other
  misc_feature (188)..(188): n is a, c, g, or t
  modified_base (266)..(266): a, c, t, g, unknown or other
  misc_feature (266)..(266): n is a, c, g, or t
tcagtacgctgtctcacgaccggtgctcgatttagcacgtgtcgcaggggacccaaaaaccacacccctccttgggagaatcccctagatcacagctcctcaccatggactggacctggagcattcctttttcttggtggcagcagcaacaggtgcccactcccaggttcaattggtgcagtctgganctgaactgaagaagccgtggggccttaagtaaacgtctctgcaaggtcttcgtgttactctttcttacgtatggcatnagtcgtgggtggcgacgacggcccgtaggacaagggctcggaggtggagtggggtggactcgaacggtacctaaacgtaagttagggttaaaccaacgtaaaacgtacgtaggaccgtaacgggtaaagttgacgaagggaacaaggaagtacgaaccacgtacgaaccacaagaccacgtaccgacgaaggcccagacgtacgtaacgagtacggaacgtaggacggtaacgcccgtagaacggacccgtacggaaccggacaccggtactaaagtaacttaacgttacgtggtaccgaagtaacgggtaaccgtaaccggggttaacttacccggttagttagttaaccgggtttaaagtttttaaagggggttttacggggtaattttacccggaagtttacggttaaccgtttttacgttttaagagtttaacgggtcgggttaaacccggggg

SEQ ID NO: 131599 - DNA, 776 bp, Homo sapiens
  misc_feature: GYAE6OF01DJG7U.36.7.A07.1.454.CMB.1.raw
tcagtacgctgtctcacgaccggtgctcgatttagcacgtgtcgcagggggcagaagtctctctcagtcaggacacagcatggacatgagggtccctgctcagctccgtgggactcctgctgctctggctcccagataccagatgtgacatccagatcgacccagtctccatccctcctgtctgcatcgtgtaggagacagacgtccacctattccttcgttggtccggggacgaggtggaaggtactagtttgtacctaattttagttttacgccgttaggtactcgaaggccgaaggaacggaaccgaaggggtaacgtacggtttacccgtaacggtccttaccgtgtaacttcgtagtcgtcctcgtcccttaccgttagttttcgacgtacggtccggtaccggggttacccctagttcccggttccgggttacgtagggtcggtacgtagggttacggtacgttcggtacgggtaactagttacgtttaccacccgttactaccctaactaccgttacgacggtacccgtacgtcccgtagaccgtaaccggtccgttaaggtaacggttagtttaccggttacgttaaccgtttaaactttttaacgtttaacgtttacgggttaaaaccttaaaaacgtttaacgtaaccgttacggtacccgttcccgtacccgttaccggttaccggttaacccgggtttaccggggaacgggtaaacccggggtaacgttaacgggttacgtaaacggttaccgtaaaacccggg

SEQ ID NO: 131600 - DNA, 730 bp, Homo sapiens
  misc_feature: GYAE6OF01CJULI.36.7.A07.1.454.CMB.1.raw
tcagtacgctgtctcacgaccggtgctcgatttagcacgtgtcgcaggggacccaaaaaccacacccctccttgggagaatcccctagatcacagctcctcaccatggactggacctggagcattccttttctggtggcagcagcaacaggtgcccactcccaggttcaattggtgcagtctggagctgaactgaagagccgtggggccttagtaaacgtctccgtgacaaggtcttcgtggtttaccttcctttcttacgtatggctagtcgagtcgtgggtcgcgacgacggtcccgtaggacgaagggccttggaaggttgggaaggtgggggtaggagttaccgaacgggtacccttaaagtaacgttagggttaaacaacgtaaaactagtacggacgtaacggtaacggttagaccgaaagggtaccaaagtaacgtacggaacctaagtaccggaaacccaacgaacgaacccgtaaccgtacccgaacggtaacgaccgaaccgacggtaccgtaatacggtaacgggtaactacgggaacggacgtaccccgtagggaaccgtacccgtagggaaccggaccgaacccgggacttaacgtaagttacgttaccgtagtacgaacgaacgtaacgaccggtataccgttaagtgttagtaagtttaggttagggtaacttcgtaagttgtactttcgtttaagcttaggtcggtaaccgggg

SEQ ID NO: 131601 - DNA, 702 bp, Homo sapiens
  misc_feature: GYAE6OF01C2PKP.36.7.A07.1.454.CMB.1.raw
tcagtacgctgtctcacgaccggtgctcgatttagcacgtgtcgcagggggcagaagtctctctcagtcaggacacagcatggacatgagggtccctgctcagctcctgggactcctgctgctctggcctcccagataccagatgtgacatccagatcgacccagtctccatccctccctgtctgcatctgtaggagacagacgtcaccatctcgttggcgggcgagtgaggactattgtactaatttatttagccttggtatcgagcagagaccgagggacgtacgttacctaagcctccgtgtacttctagtgctcgccttctattttcgctagtcgtacgggtccctagtccgttcggttcgaggtcggcgtaggtggtagtacggtcggggaactaggttactttaccgacctttaccgtaccgtaaaccctacgttccgaacggaccgtaccgtcccgtcggtaccacggtcccgttaaggaaacgttagttacggtttacgtaacctttaaacgttttaacgtttaagtttacggttaaaacgttaaaaacgtttaactaaaaccgttacggttaccgtaccgttacccggttaccttaccggtttaaccccgggttttaccggggaacccggggttaaccggggtaaacccggttaagggggttaacggtaaacgttaacggttaaaaaccccgg

SEQ ID NO: 131602 - DNA, 586 bp, Homo sapiens
  misc_feature: GYAE6OF01B5EII.36.7.A07.1.454.CMB.1.raw
  modified_base (442)..(442): a, c, t, g, unknown or other
  misc_feature (442)..(442): n is a, c, g, or t
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatgacccagtctccatccctccctgtctgcatctgtaggagacagagtcacctatctcttggtccggggcagtgaggactattgtactaattatttagccttggtatcagcagagaccgagggagagttcctaaggctcctgtactctagttcgctcgccttcctattttcgctagtccgtacggggtccctagtcgttcggttctaggtcgacgtaggtggagttcgtgggaactagtactttacgtaccttacgtaccacctattcgacgcctacgtccctgtacncggtacctaggaacgtactaggtttacggacttaactttagtttaacttacgtaactaaaggtactaaacgtagttcgcttccgtcttacgtaccgtttacgggacgggtacggtaccgaagggtacgtaacgtagtaaaccgg

SEQ ID NO: 131603 - DNA, 604 bp, Homo sapiens
  misc_feature: GYAE6OF01BS3ZA.36.7.A07.1.454.CMB.1.raw
tcagtacgctgtctcacgaccggtgctcgatttagcacgtgtcgcgagggggcagaagtctctctcagtcaggacacagcatggacatgagggtccctgctcagctcctgggactcctgctgctctggctcccagataccagatgtgacatccagatgacccagtctccatcctccctgtctgcatcgtgtaggagacagagtcaccatctcttaggtcggcagtgaggacattgtactaattattagcctaggtatcagctagacgaccgagggagtacgttactaaggctcctgatctatcgctagtcctacgtatttcgactaggtcgacgggtcccagttcgtacggtcaggtcgacgtagtaggtacgtcgtacgggtactagttactttcgaccttctacctaccgtatcgagtactaccgtccgtgactacgtaccgttagaacgttcgtcggttacccgtaattaacgtttagttagttaacgtaaacgtaaaagttactaaacgtacgtaccgtccttaccggaccgttacggtaacccgtttacggggacggttaaacgggaacttaaggggttctaattaaccggtaaaccgg

SEQ ID NO: 131604 - DNA, 647 bp, Homo sapiens
  misc_feature: GYAE6OF01CN024.36.7.A07.1.454.CMB.1.raw
  modified_base (269)..(269): a, c, t, g, unknown or other
  misc_feature (269)..(269): n is a, c, g, or t
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcaccatctcttggcgggcagtgaggacattgtctaattatttagcctggtatcagcagagaccgaggngagttccaagctcctgatctatgctgtcctcctatttcgctaggtcgacggggtccctattcgtcggttcgaggtcggcgtaggtgtagtcggtacgggaactaggttactttaccgaccgttacctaccaacctacgtcgaaccggtaccaccgtaccctcggacctaccggtacccttaaggtaaacggtagtttacggttacgtaaccctttaaagttttaactttaagtttacggttaaaacctaaaaaggtttaacctaaacgttaacggttaccgtaccgttacccgtactttacccggttaccggtttaccgggacggggtaaccggggtaacccgtaagggttaacggtaacgttaaccgtaaaaccggg

SEQ ID NO: 131605 - DNA, 503 bp, Homo sapiens
  misc_feature: GYAE6OF01EMXZE.36.7.A07.1.454.CMB.1.raw
  modified_base (194)..(194): a, c, t, g, unknown or other
  misc_feature (194)..(194): n is a, c, g, or t
  modified_base (245)..(245): a, c, t, g, unknown or other
  misc_feature (245)..(245): n is a, c, g, or t
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatgacccagtctccatcctccctgtctgcatctgtagganacagagtcaccatctcttggtcgggcagtgaggacattgtcaattatttanctggtatcagcagagaccgagggagagttcctaagctcctgatctatgctgcctctatttgctagtcgagggtccatcgtcgtcgagtggcgagtggtatcgtgggacagtatttcactctcacgtcacgcagcctgcactcgtgaagtagttgtcgctaacttagttattagtaataaagtaataactagtcgtcgtccgtcttctacgttccggtaggacgggtacgtaagggtagtacgtaagtacgtaaaacgg

SEQ ID NO: 131606 - DNA, 596 bp, Homo sapiens
  misc_feature: GYAE6OF01A2WGK.36.7.A07.1.454.CMB.1.raw
  modified_base (194)..(194): a, c, t, g, unknown or other
  misc_feature (194)..(194): n is a, c, g, or t
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatgacccagtctccatcctccctgtctgcatctgtagganacagagtcaccgattcctcgttggtacgggctaggtgaggacattgtactaattattacgcctaggtatcgagcagacgaccgaggtagacgttacctaagctcctgactctagtcgctcgcctcctatttgctagtcgacgggtcccagtcgtcgttcagtgcgtagtgatcgtaggactagtacttcgactcctacacctatcacgtcacgtcctgcgtactccgtagaacgtattcggttacgtaccttaaactttagttaacttacggtaaacctaaaaagttacgttaaaccgtagttaccgtacccttacccgtacttacccgttaccggtttaccgggaaccggggttaaccggggtaaccgtaagggtagttaaaccgttaacgttaaacccgg

SEQ ID NO: 131607 - DNA, 540 bp, Homo sapiens
  misc_feature: GYAE6OF01B2LZQ.36.7.A07.1.454.CMB.1.raw
  modified_base (394)..(394): a, c, t, g, unknown or other
  misc_feature (394)..(394): n is a, c, g, or t
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcaccatctcttgtcgggcgagtgaggacattgtcaattatttagctggtatcagcagagaccgagggagagttcctaagctctgatctatcgctcgcctctattttgctagtcgacggggtcccatccgtcggttcgagtggtcagtggatcgtgggacagtatttcactctacaccatcagtcacgcctgcncgtcctagaagtagttgtgtacttaacttattagttacgtaagtaaaagttactaaacgttagtacgtccgttaccgaccgttccgtacgtttaccgggaccgggtacgggaaccgtaaaggggttacggaagttacgtaaaccgg

SEQ ID NO: 131608 - DNA, 574 bp, Homo sapiens
  misc_feature: GYAE6OF01AWELB.36.7.A07.1.454.CMB.1.raw
tcagtacgctgtctcacgaccggtgctcgatttagcacgtgtcgcaggggacccaaaaaccacacccctccttgggagaatcccctagatcacagctcctcaccatggactggacctggagcatcctttttcttggtggcagcagcaacaggtgcccactcccaggttcaattggtgcagtctggagctgaactgaagaagcctggggccttagtaaacgtctcctgcaaggcttctggttactcctttcttacgtatggcatcagctgggtgcgacaggcccctggacaagggctcgagtgggagtggggtgatcgaggcctaacaatggttacacaaactatgacacggaagttgcaggacagaatgaccatgaccacagaccacgtccaacgacgcacacgacgtacgaagtaggaactggaaggacgaccgtacgagacccgtagacgaacaccggccataactattactgtgagagaagtaaccgggtagtaccgtagtaggttagtaacgtttaaggttttgggggtatttcggtagttggtacttccttttagattgtggtacgggg

SEQ ID NO: 131609 - DNA, 660 bp, Homo sapiens
  misc_feature: GYAE6OF01AFVIP.36.7.A07.1.454.CMB.1.raw
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcaccatctcttggtcgggcgagtgaggacattgtactaattatttagcctggtatcagcagagaccgagggagacgttacctaacgctccgtagtactctagtcgcgttcgccttctatttcgacgtacggtcgacggggtccctacgttccgttcggttcgtaggtcggccgtagggtcggtacgtcgtacgggaacgtacgtactttctaccttccttaccacctaactacgaccgacgtaccgtccgtcgcgacgtacccgtacgtaagtaagttcggttacgtaaccttaaactttactttaagtttacgttaaacttaaaacgttaaacgttaaacgtaacggttacggtcccgttacccgttacccgttcccgttaaccgggtttcccgggtaaccgggggtaccgggtaaaccgggtaaacggggttaggtaacggttaaccgtaaaccggg

SEQ ID NO: 131610 - DNA, 615 bp, Homo sapiens
  misc_feature: GYAE6OF01CF0ER.36.7.A07.1.454.CMB.1.raw
  modified_base (464)..(464): a, c, t, g, unknown or other
  misc_feature (464)..(464): n is a, c, g, or t
tcagtacgctgtctcacgaccggtgctcgatttagcacgtgtcgcagggggcagaagtctctctcagtcaggacacagcatggacatgagggtccctgctcagctccgtgggactcctgctgctctggcctcccagactaccagatgtgacatccagatcgacccagtcctccactccctccctgtcctgcattctaggtaggagacagtacgtccaacctatccttcgttgggtcggggacgtagtggaaggtactagttgtactaattagtttacgccgttggtatcgagcaggacgaccgagggtacgtacgttacctaacgccttcgagtactctatcggtctacgtcccttacgttattttacgactaacggtccgtacggggtcccctattccgttcggttcgaggttcgacgtggtaggtatcggtagggtactagtacttcgacctctacacctancagcacgctagcacgtcagagtatgtacgtactaactttagtactataaacgtaagtactaagtacggttacgcccgttacgcgttaccgtacggtttaccgggaacgggtaaccgggacgtaagggttacggtaactaacggtaaaccgg

SEQ ID NO: 131611 - DNA, 629 bp, Homo sapiens
  misc_feature: GYAE6OF01CM6XY.36.7.A07.1.454.CMB.1.raw
  modified_base (509)..(509): a, c, t, g, unknown or other
  misc_feature (509)..(509): n is a, c, g, or t
tcagtacgctgtctcacgaccggtgctcgatttagcacgtgtcgcaggggacccaaaaaccacacccctccttgggagaatcccctagatcacagctcctcaccatggactggacctggagcattcctttttcttggtggcagcagcaacaggtgcccactcccaggttcaattggtgcagtctggagctgaactgaagaagcctggggccttagtaaacttctcctgcaaggcttctggttactctttcttacgtatggctatcagtctgggtcgcgacacggccctaggacaagggctcgagtggagtggggtgatcgaggcctaaagagtcggttacaacaaactatacgacacgggtaagttgacgaaggacaaggaatacggaaccaagtacggaacccaagacgaaccgacgtaccgaacgacgtacaacgacgtacgtaacacgtaggaacgtaggaggacgcgtagacgactacggacgacgacgactaatactattacgngtacgagtaacgaacgtaaccggtataccgtagttagttacggtaagttttaacggttttaggggactttacggtaattcgttacgtttacgtttaggtaacttacgtcgggtaacgggg

SEQ ID NO: 131612 - DNA, 702 bp, Homo sapiens
  misc_feature: GYAE6OF01BVZ30.36.7.A07.1.454.CMB.1.raw
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatcgacccagtctccactcctccctgtctgctatcgtagtagacgacagacgtccaaccgtattcttcgttgggccgggcgtaggtggaacggtactagttacgtacttaatttacgtttacgccgttaggtactcgtagcgaaggtacgaaccggtaagggtacgtaacgttaccgtaacgtcttccgtagtacgttactagtcgtctcgtacccttcgttagtttacgcgtacggtccggtacgggtaccctaggttccgttacggttactagggttacggacgtaggttaggtacgttcggtacggtacttaaggtacctttacgtacctctacgtaacctacgtacgtacgccgtacgtccgtacgacgtacgtaccgtaaggtacgttacgttacgttaacgtactttaacgtttagttataaccgttaactaaaggttacacgttacggtaccgtaccgttacgttaccttacccggttacgttaaccggggtacggtaaacccggttaaggtaacgggttacgtaacgttacgtaaaccgg

SEQ ID NO: 131613 - DNA, 669 bp, Homo sapiens
  misc_feature: GYAE6OF01C5QUY.36.7.A07.1.454.CMB.1.raw
  modified_base (521)..(521): a, c, t, g, unknown or other
  misc_feature (521)..(521): n is a, c, g, or t
tcagtacgctgtctcacgaccggtgctcgatttagcacgtgtcgcagggggcagaagtctctctcagtcaggacacagcatggacatgagggtccctgctcagctcctgggactcctgctgctctggcctcccagactaccagatgtgacatccagatcgacccagtctccatccctcctgtctgcatctgtaggagacagacgtccacctatcgttccgttgggccggggagtaggtgaacgggtactagtttacggtaacttaatttaatttacggaccttagggttactacgaacgacgaacggaacggaccgtaaggggacgttaaccggtttaccaacggtcccttacgtagtaacttcgtagtcgtacctaccgtccttccgtttattttccgacgtacggtccgtaccgggtacctacggttccgtcgggttctaggtcggatacgggtcgtagtcgtagggacctaggttaccttacgccttactaccactatacgagccgtacgctcgacgntaccgtagtaagtattacggttacgtacttaacgtttattaacgttacgtaaacgttaaacgttccaaagtcgtacgtccgtacgtaccgttcgttacgggttacggacggggtaaccgtaacgggtagggtataacgttagtaaacg

SEQ ID NO: 131614 - DNA, 729 bp, Homo sapiens
  misc_feature: GYAE6OF01C47YW.36.7.A07.1.454.CMB.1.raw
tcagtacgctgtctcacgaccggtgctcgatttagcacgtgtcgcagggggcagaagtctctctcagtcaggacacagcatggacatgagggtccctgctcagctcctgggactcctgctgctctggcctcccagataccagatgtgacatccagatcgacccagtcctccatccctccctgtctgcatcgtgtaggagacagagtccaccatctcgttggtcgggcgaggtgaaggtactagttgtactaatttatttacgccgttaggtactacagacgaggaacgtaaccgaaggggacgtacgttaccgtaagccttacctaggtacttctagtcgacttcgtcccttaccttagttttcggacgtaacggtccgtaccggggtccctagtccgttcggttcgtaggtcggtacgtaggtagggtacgtacggtagggtactaggttactttacctaccttaccgtaacctaaccgtacttaccgaagtcccgtaacgtccgtacgtccgacgtaccgtagaaagttacgttcgttaacgtaccctttaaagttttagtttaacgtttacgtaaaacgttaaaaaggtttaaactaaccggttagtacccggtacccgtttcccgttacgtttaacccgtttacgggtttaccccggggaacggggttaaaccgggtaaacgggttacgggttaacggtaaacgttaaccggttaaaaacccggg

SEQ ID NO: 131615 - DNA, 755 bp, Homo sapiens
  misc_feature: GYAE6OF01E4N04.36.7.A07.1.454.CMB.1.raw
  modified_base (196)..(196): a, c, t, g, unknown or other
  misc_feature (196)..(196): n is a, c, g, or t
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatcgacccagtctccatccctccctgtctgcatctgtagganacagagtccacctatcctcgttggtcgggacgaggtgaggactattgtactaatttagttagccttggtatcgagactagacggaccgaagggtagtacgttaccgtaacgtcttcccgtagtacttacttacgttcgtccgttccgttcccttaccgttacgtttttcggaccgttaacgggttcccggtaaccggggtttccccctaacgtttcccggtttaccggggtttacgtacgggttcggacgttaagggttacgggtaacgttcgggttaacggggaaccgttaaggtttaaccttttaccggtacccttaccgttaaccccacggtaacctacccgaacggtaccctaccggtccccgtaggtacccgaccggttaccgaaggtaacggttaacgttcggttttacgaaacctttaactttactttaacgttaacgtaacgttaaaagttacgtaaacgttacggttaccgtcccgttaccgtccttaccggttacgggttaccgggacgggtaccgggtaacgtaagggtaacgttataaccgtaaacg

SEQ ID NO: 131616 - DNA, 613 bp, Homo sapiens
  misc_feature: GYAE6OF01CAPJX.36.7.A07.1.454.CMB.1.raw
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatcgtgacatccagatgacccagtctccatcctccctgtctgcatctgtaggagacagagtccaccatcctcgttggtcgggcgtagtgaggactagttgtactaattatttagccttaggtatcagacagacgaccgaggtacgtacgttaccgtaagtcctctagacttctatcgctacgtcctcgtatttcgactagtcgtacgggtccctagttcgtcggttacaggtcggacgtaggtgtacgtcgtacggtaactacgttactttaccaccttactacctaccgtaacgtacgacgtccgacgtcccgtagtaccgtacgtaccgtagaacgtagttacggttacgtacttaacgtttacgttacgttacgtaaactaaaacgttactaacgtacgttcggtaccttaccgacttaccgtacgttacgggacggtaacggacgtaggtacgtaactacgtaaaccg

SEQ ID NO: 131617 - DNA, 589 bp, Homo sapiens
  misc_feature: GYAE6OF01BACZR.36.7.A07.1.454.CMB.1.raw
  modified_base (349)..(349): a, c, t, g, unknown or other
  misc_feature (349)..(349): n is a, c, g, or t
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcaccattctcttggtcgggcgagtgaggactattgtcaattatttagcctggtatcagcagagacgaggagtacgttcctaagctccgtgatctatcgctgtcctctatttgcgtagtcgacgggtccagtcgttcggtcagtggcgngtgtagtcgtgggtacagtacttccacttctccaaccgtatccgagcgacgtcccgtgaccgtacgtccgtaaggaacgttacgtcggttacgtaaccttaacttttagttaacgttacgtaaacgtaaaacgttacgtaaaccgtacgttcgtaccttacccgtccgttacgttaccgggttcgggaacgggtaaccggggtacccgtaaggggttacgtaaacgttaacgtaaaccgg

SEQ ID NO: 131618 - DNA, 643 bp, Homo sapiens
  misc_feature: GYAE6OF01CV7YA.36.7.A07.1.454.CMB.1.raw
tcagtacgctgtctcacgaccggtgctcgatttagcacgtgtcgcaggggacccaaaaaccacacccctccttgggagaatcccctagatcacagctcctcaccatggactggacctggagcattccttttcttggtggcagcagcaacaggtgcccactcccaggttcaattggtgcagtctggagctgaactgaagaagcctggggccttagtaaacgtctcctgcaaggtcttctggttactcctttcttacgtatggcatcagcgtgggtgcgacgacggcccctaggacgaagggctacggaggtggagtgggggtgacgtcgaggacctaacgtaagtacgggttaacaacgtaaactagtacggacgtaacggtaaggtttcgacgaggaacgaggaagtacgaacctagtacgaacccaagaacgaaccaccgtaccacgagaccaacgacgtacgtaacagtacggacgtggacggacgccgtaggacgaccgtggaacgacgaccggactaatattacttacgtggtacgacggaagaacgtaacggtacttaccgtagttgttaggttaagttttaagggtttgggtactttacggagttcgtactttcgtttagattcggtggtacggggg

SEQ ID NO: 131619 - DNA, 728 bp, Homo sapiens
  misc_feature: GYAE6OF01CGNM9.36.7.A07.1.454.CMB.1.raw
  modified_base (196)..(196): a, c, t, g, unknown or other
  misc_feature (196)..(196): n is a, c, g, or t
tcagtacgctgtctcacgaccggtgctcgatttagcacgtgtcgcagggggcagaagtctctctcagtcaggacacagcatggacatgagggtccctgctcagctcctgggactcctgctgctctggctccagactaccagactgtgacatccagatcgaccctagtcctccatcctcctgctgcatctgtagganactagacgtcaaccattccttcgttcgggtccgggcgtaaggtcggaggactagtttacgtactaacttttagtttacgccgttggtactctacgacaggacgaccggaagggagtacgttaccgtagcctcgtgtatctatcgcgtcgtcctccgtatttcgcgtacgtacggtacgggtcctagtccgtacggttcgtaaggtcggtacgtacggtacggttaacgcggttacgggtaactacgttactttaccgacttccgtaccgtaaccttagtaccgtacggtccgtacggtacccgttagtaccgacgttaccgtagggttaacgtacggtttacggttacgtaccgtttaaatttaacggtttacgtttaactaaaggtaaaaacgttacgtaaaccggttacggttaccgttaccgttaccccggttactttacccgggtttaccggttaccggggacgggggttaaacccggggtaacgtaaacgggggtttacgtaaacggttaacccggtaaaacccggg

SEQ ID NO: 131620 - DNA, 703 bp, Homo sapiens
  misc_feature: GYAE6OF01CO1GL.36.7.A07.1.454.CMB.1.raw
  modified_base (201)..(201): a, c, t, g, unknown or other
  misc_feature (201)..(201): n is a, c, g, or t
  modified_base (217)..(217): a, c, t, g, unknown or other
  misc_feature (217)..(217): n is a, c, g, or t
  modified_base (273)..(273): a, c, t, g, unknown or other
  misc_feature (273)..(273): n is a, c, g, or t
  modified_base (344)..(344): a, c, t, g, unknown or other
  misc_feature (344)..(344): n is a, c, g, or t
  modified_base (353)..(353): a, c, t, g, unknown or other
  misc_feature (353)..(353): n is a, c, g, or t
tcagtacgctgtctcacgaccggtgctcgatttagcacgtgtcgcaggggggcagaagtctctctcagtcaggacacagcatggacatgagggtccctgctcagctcctgggactcctgctgctctggctcccagactaccagatgtgacatccagatcgacccagtcctccactccctccctgtctgcatcgtgtagganacgagtacgtcaaccnttcgttcgttcggacgggtcgaggtaggaacggtactatttggtaactaaagtttntttacggccttaggtaactccgagcgaagaacggaccgtaaggggacgttacttacctagtccttacgganacttactancggtctaccgtcttaccgttatttcgaccgtaggtccggacggtcctacgttccggttggttaccagggtccggagtcgggttagctcggtagggtactacgttcttaccgcgttcctacgacctagtaccagtcccgtaacgccgttagaccgtacgtaccggtaagtaactaggtttccggttaagaccttttaaacgtttatttaaagtttaccgaaaacttaaaacggtttaactaacggtaccggtttacgtaccccgttaccgggttacttacccgtttacggggttacccgggaacgggtaacccggtaaggtacggggtaacaacgtttaacgtaaacccgg

SEQ ID NO: 131621 - DNA, 655 bp, Homo sapiens
  misc_feature: GYAE6OF01B8H6B.36.7.A07.1.454.CMB.1.raw
  modified_base (325)..(325): a, c, t, g, unknown or other
  misc_feature (325)..(325): n is a, c, g, or t
tcagtacgctgtctcacgaccggtgctcgatttagcacgtgtcgcaggggacccaaaaaccacacccctccttgggagaatcccctagatcacagctcctcaccatggactggacctggagcatcctttttcttggtggcagcagcaacaggtgcccactcccaggttcaattggtgcagtctggagctgaactgaagagcctggggccttagtaacgtctctgcaaggcttctggttactcctttcttacgtatggcatcagctgggtgcgacgacggcccctggacaagggctcggagtggagtggggtgatcgaggcctaanagtggttacaacaactgtgacgagggagttgacgaaggacagaagtcgaaccatacgaacccagtaacgaccgtaccgtaccgaccggacgacacggaccgtaccgtacgaacggtacggtaaccgtgggaacggacgtacccgtaggaccggaccgtaggaccgtaccgaccggacgtactaacgttactacggttacgtcggtaacgaagggtaaccgtaaccgggtacgttaccggtttagtaccgtttaggttaagttttacgggtttaggggtacttagggtacttggtacgttttcctttaggtacgttgttcgggtaacgggg

SEQ ID NO: 131622 - DNA, 813 bp, Homo sapiens
  misc_feature: GYAE6OF01BK6OV.36.7.A07.1.454.CMB.1.raw
tcagtacgctgtctcacgaccggtgctcgatttagcacgtgtcgcagggggcagaagtctctctcagtcaggacacagcatggacatgagggtccctgctcagctcctgggactcctgctgctctggcctcccagataccagatgtgacatccagatcgacccagtcctccatccctccctgtctgactatctaggtaggacacagtacgtccaacctattccgttcgttggtccgggacgtaggtcggaaggtactagtttaggtactaagtttacgtttagtccgttggtattacgagacgaacggaacgtaaccgaggggtaacgtacgtttacccgtaaacgtccttaccgtacgtaacttaccgtaatcggtcctcggtacccttaccgttaagttttcgacgtacggttacccgaacggggttccctacgttccgtcgggtttcaacgggttcggaacctggttcgggtacttacgggttacggggaacttaggttaactttccgtaaccgttaccgtacccttaaccgacgttacccaacggacctaacgtcccgtaccggtacgtaacggtcccttaaggtaaccgtaggttacggttaccgtaacttaaaacgttttacgtttaacttacggtaaaccttaaaaagtttaccgtaaacggtttaacgtcccggttaacccgtttaccccggtacggttaaaccccggtttaacggttttacccggggggaaacccggaacgggggtttaaaccgtaaacccggggggtttaattaaaacccggtaaccgggttaaaaaccccgg

SEQ ID NO: 131623 - DNA, 506 bp, Homo sapiens
  misc_feature: GYAE6OF01AYM7I.36.7.A07.1.454.CMB.1.raw
  modified_base (368)..(368): a, c, t, g, unknown or other
  misc_feature (368)..(368): n is a, c, g, or t
  modified_base (380)..(380): a, c, t, g, unknown or other
  misc_feature (380)..(380): n is a, c, g, or t
  modified_base (384)..(384): a, c, t, g, unknown or other
  misc_feature (384)..(384): n is a, c, g, or t
  modified_base (390)..(390): a, c, t, g, unknown or other
  misc_feature (390)..(390): n is a, c, g, or t
  modified_base (395)..(395): a, c, t, g, unknown or other
  misc_feature (395)..(395): n is a, c, g, or t
  modified_base (397)..(397): a, c, t, g, unknown or other
  misc_feature (397)..(397): n is a, c, g, or t
  modified_base (402)..(402): a, c, t, g, unknown or other
  misc_feature (402)..(402): n is a, c, g, or t
  modified_base (412)..(412): a, c, t, g, unknown or other
  misc_feature (412)..(412): n is a, c, g, or t
  modified_base (422)..(422): a, c, t, g, unknown or other
  misc_feature (422)..(422): n is a, c, g, or t
  modified_base (450)..(450): a, c, t, g, unknown or other
  misc_feature (450)..(450): n is a, c, g, or t
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagacgtcaccatctcgttggtcgggcaggtgaggactattgtactaattatttagccgtaggtatcagcagagaccgagggagagttcctaagctacctgatctatgctgcctctatttgactagtcgagggtcccatcgtcggttcaggttggcaggtgattcgtgggacngtacttcactcncacntcagcngcctncncgacngaagatggtntacttaattnttagtataacaaattactaagtagtacncgttaccgactcgtacgttcggagggtacggaccgtaaaggtcggaactagtaacg

SEQ ID NO: 131624 - DNA, 752 bp, Homo sapiens
  misc_feature: GYAE6OF01D96FV.36.7.A07.1.454.CMB.1.raw
  modified_base (580)..(580): a, c, t, g, unknown or other
  misc_feature (580)..(580): n is a, c, g, or t
  modified_base (723)..(723): a, c, t, g, unknown or other
  misc_feature (723)..(723): n is a, c, g, or t
tcagtacgctgtctcacgaccggtgctcgatttagcacgtgtcgcgaggggaacccaaaaaccaccacccctccgttgggagaactcccctagatcacagctcctcaccatggactggacctggagctatttcctttttgtggtgcagcagcaacgagtcgcccactccctaggttacaagttggtgacgtagtcgtggagcgtagaactaggaaagacgtccggtgggtaccttaagtaacgtctccgtgacgtagtcttcgtcgttacttcctttacgttacgtagtcgactacgtcgacggtcgtgggcgtaccggaccgaaccggtcccgtaagggaacgtaacgggtccgtagggaaggtgggtaagggtggggtacgtacgtaccggacgtaacccgttaaagtaacggttaaccgttaacaaactaaaccgttaggtacgaaccggtaacgggtaagtcgaaccgtaaaggaacgtaagtaaacgacgaaccaaggttacaaaacccgacgaaacgtaaccaccggtaccgaagacgaaccgacgtaacggtacgaacgtaggaagtaacggnggaacgacgtcgaaggtaacccgcgaacgggaccaaccgacggtaatacttaaggtactacgggtgtaacgaagtaacgtaaccggttgtacgtaaccgttgttaaggttaacgttttaggtagggttatacgttgtaagttnttacgtttagaatcggttaggtcggaacg

SEQ ID NO: 131625 - DNA, 690 bp, Homo sapiens
  misc_feature: GYAE6OF01D5OFE.36.7.A07.1.454.CMB.1.raw
tcagtacgctgtctcacgaccggtgctcgatttagcacgtgtcgcagggacccaaaaaccacacccctccttgggagaatcccctacgatcacagctcctcaccatggactggacctggagcattcctttttcttggtggcagcagcaacaggtgcccactcccaggttcaattggtgctagtctggagctagaactagaagaagccgtagggtccttaagtaaacgtctcctgacaaggtcttcgttggttaccttccttttcttacgttatggctatcgagtcgtgggtgccgacgaccggtccccgtaggaacgaacgggtcgtacggaggtggaggtggggtaggacgtcgacggtacctaacgaagttcggttaacaacgtaaaactagtacgaccgacggtaagttcgaacgtaaggaacgaagaagtacgaaaccgtataccgaacccaacgaacgaaccgtaaccgtacccgacgaacgaccacgaacgaccgtaacaaggtacgaaacgtggaacggacgcgtagacgtacccgaggaacgaccgacgactaagtacgtagttacgtgtagcgaagaacgtaccggtattacgtagttagttagttaagttttaagggttgggtaacgtttacgtagttacgtttacgtttacgtttagtaacgttcgtcgggtaaccggg

SEQ ID NO: 131626 - DNA, 755 bp, Homo sapiens
  misc_feature: GYAE6OF01AZ389.36.7.A07.1.454.CMB.1.raw
  modified_base (311)..(311): a, c, t, g, unknown or other
  misc_feature (311)..(311): n is a, c, g, or t
tcagtacgctgtctcacgaccggtgctcgatttagcacgtgtcgcagggggcagaagtctctctcagtcaggacacagcatggacatgagggtccctgctcagctcctgggactcctgctgctctggcctcccagactaccagtatgtcgacactccagatcgacccagtctcctactccctccctgtctgctatcgtaggtaggagacgagtacgtaccacctacttccgttcggttcgggtccgggacgtaggttacggacggtaactagtttacgtacttaagttttacgttacgtccgttaggtacncgagacgaggaacggacgagggtactacgttaccgtaacgtccgttacgtagtactcgtacgtcgtccgttcgtccctttacgttatttcggacgtacgggtaccggtaccggttccctagttccggttacggttacgaggtcggaccgttggtacggttacgtcgggttacggtaacctgttacctttaccacccttcgtaccctaactccgtaccgacgtccgccgtaccgtccgtacgaacccgttacgtagaaacgtttacgttaccggtttaactaaccgttttaaacgtttaacgtttaaccttaaacggtaaacttaaaaccggtacttaccgggtacgttcccggttaccctaccgttaccgtttaaccggtacccggggttacgggaaccgggtaacggtacggtaaagtacgttaaagtaacccggtaaaccgg

SEQ ID NO: 131627 - DNA, 509 bp, Homo sapiens
  misc_feature: GYAE6OF01DNYC7.36.7.A07.1.454.CMB.1.raw
  modified_base (447)..(509): a, c, t, g, unknown or other
  misc_feature (447)..(509): n is a, c, g, or t
tcagtacgctgtctcacgaccggtgctcgatttagcacgtgtcgcaggggggcagaagtctctctcagtcaggacacagcatggacatgagggtccctgctcagcctcctgggactcctgctgctctggctcccagataccagatgtgacatccagactcgacccagtctccatcccgtccctgtcctgcattcgtaggtaggacgaacaggactccaacctattcctacgttggcgggggacaggtaggaacggactaagtttggtaacctaaaattttacgttttaacggcctttagggtaacttacaacggaccggaaggaaacgaacccgggaaagggggtaacgtaccgggttttacccgtaaaaacggtcccgttacccgtaggttaaatttcccttaaagttccgtccgtaacggttccccccttattaaccggtttttnnnnnnnnnnnnnnnnnnnnnnnnnnnnnnnnnnnnnnnnnnnnnnnnnnnnnnnnnnnnnnn

SEQ ID NO: 131628 - DNA, 824 bp, Homo sapiens
  misc_feature: GYAE6OF01CPNZ4.36.7.A07.1.454.CMB.1.raw
  modified_base (119)..(119): a, c, t, g, unknown or other
  misc_feature (119)..(119): n is a, c, g, or t
tcagtacgctgtctcacgaccggtgctcgatttagcacgtgtcgcaggggacccaaaaccacacccctcttgggagaatcccctagatcacagctcctcaccatggactggacctggancattcctttttctggtggcagcagcaacaggtcgcccactcccaggttcaagttggtgcagtctggagctagaactgaagaacgccgtaggggaccttaagtaaaccgtctaccgtgacgaacggtcctttcgtcggtttaccttccttttcgttaacggtagtcgggtactaagtacgtacgtcgttaggggtcgacggtaacgaccgggtacccccgtagggaaccggaaacggggtccgtaacggtagggtacgggtaaggtttcggggtaagtacgtaccgaacgggacccttaaaacgtaagttacgggttaaaccaaaacgtaaaacgttagtaccggaaccggaacgggttaacgtttacgaccggtaaagggaacccgttaaaggaacgtaacgtaaccaaggtaccgaaacccgaagtaacgaccgtacgtacccgagaaccgtaacgacgaacgtacgtaacgtacgtaaaggtaacgtaacggtacgggaacgttcccggtaacggaacgttacccggtaggaaacccggtaaccgaaccgggtaacaagtttacgtaacgtttaacgtcggtacgtaacgtaacggtaacggtaaccggtacgttaacggtgttaacggttaggtaaagtttacgggttaggggtacttaggtacgttagttactttacgttagaattcggtaggtaaccggg

SEQ ID NO: 131629 - DNA, 473 bp, Homo sapiens
  misc_feature: GYAE6OF01APTI7.36.7.A07.1.454.CMB.1.raw
  modified_base (383)..(383): a, c, t, g, unknown or other
  misc_feature (383)..(383): n is a, c, g, or t
  modified_base (425)..(425): a, c, t, g, unknown or other
  misc_feature (425)..(425): n is a, c, g, or t
tcagtacgctgtctcacgaccggtgctcgatttagcacgtgtcgcagggggcagaagtctctctcagtcaggacacagcatggacatgagggtcccctgctcagctcctgggactcctgctgctctggctcccagataccagatgtgacatccagatgacccagtctccatcctccctgtctgcatctgtaggagacagagtcaccatctcttgtcgggcgagtgaggacattgtcaattatttagcctggtatcagcagagaccagggagagttcctaagctcctgatctatgctgcctccattttgcagtcagggtcccatctcggttcgagtggcagtggatcgtgggactagtatttcactcctcaccatcagcagccngcacgcctgaagatgttgtacctatttattatgtacaaagtntaacagtgctccgctcactttggcggacggacaaggtgagtataaccg

SEQ ID NO: 131630 - DNA, 760 bp, Homo sapiens
  misc_feature: GYAE6OF01CMWPU.36.7.A07.1.454.CMB.1.raw
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatcgacccagtcctccatccctcctgtctgcatctggtaggagacagactcacctattcttcttgggtccgggcgtaggtgaggtactagttgtactaatttatttacgccgttaggtactcgagcaaggacgaccggagggtaacgtacgttaccgtaacgtccttccgtagtacttacgttagtcgtccgttccgtcccttccgtttaagtttttcgaccgtagggttaccggtaccggggtaccctacgttccggtttacggttcgtaggtcggtcgtaagggtcggtacgttcggtacgggtacttaacgttacgtttccaccgttacctaccgtaacctattaccgaacgtccgtaaccgtccgttacggaccgtacggtaacccgttaaggtaacggtttaggtttacgttaaccgtttaaccgtttaaacgtttttaactttaacggtttaacgtaaaaacgttaaaacggttaacttaaaccggttaccggttaccgtccccgttacccggtaccgttacccgtttaccgggttaccggggaccgggtaaaccggtaaccgggttaagggtacgttaacgtaaaccggttaaacccgg

SEQ ID NO: 131631 - DNA, 611 bp, Homo sapiens
  misc_feature: GYAE6OF01EODYK.36.7.A07.1.454.CMB.1.raw
  modified_base (169)..(169): a, c, t, g, unknown or other
  misc_feature (169)..(169): n is a, c, g, or t
  modified_base (197)..(197): a, c, t, g, unknown or other
  misc_feature (197)..(197): n is a, c, g, or t
tcagtacgctgtctcacgaccggtgctcgattttagcacgtgtcgcagggggcgagaagtctctctcagtcaggacacagcatggacatgagggtccctgctcagcctccgtgggactcctgctgctctggctccagataccagatgtgacatccagatgacccagtcnccatcctccctgtctgcatctgtagganacagagtcaccatctcttggtcgggacagtgaggacattgtacaatttatttagccttggtatcagaccaagagtaaccgagggacgaggttacctaagccttaccgtagatcgtatgctcgcctacctagtttcgacgtagtcgaacggggtccctacgttctcggtttcaggtggacgtaggtggactcggtagggtaacaggtacttttaccacttaccgtacacgtaactcacggtacacgtaccgtgactaacgcctaaggaagtaacttggttacgtaccgttaaactttagttaacgttaacgtaacgtaaaaagttataaaccgtagtacgtacgtacccgtcttacgtaacccggtttcggaaccgggtacggtaacccgaaaggttcggaattaacgtaaaccg

SEQ ID NO: 131632 - DNA, 889 bp, Homo sapiens
  misc_feature: GYAE6OF01DZDW2.36.7.A07.1.454.CMB.1.raw
tcagtacgctgtctcacgaccggtgctcgatttagcacgtgtcgcagggggcagaagtctctctcagtcaggacacagcatggacatgagggtccctgctcagctccgtgggactcctgctgctctcggcctacccagtactaccagtattggacacactaccaagtactaccgaccctacgttcctacctacttcccctcccgttagtctcgctagtcgtaggaacggacgacagtacgtaccactacttccgttggttcgggtccgggagtaaggtcggaacggttactaagttcgtaacttaattttaagttcgtaccgttaggttaacctgaacgtacgaacggaacggtaccggtaagggtaacgttaccgttaccggtaactcccgttacgtacggttattaccgttacgttaccgttacgtaccgttacctttacgtttacggtttacgacggttaacggttacccgggtaccggtttaccccttaacggtccggtttaaccgggttaggtacgggtaaccggttacgtacgggtacggttacggttcggtaaccgggtttaataaccgggtttccttaaaccgttacccgttaccgtaacccgtaagtaacccgttacgacggttaccgtaacggtccgtaacccgttacgtaaccgggtaccgtttaaggtaaaccttcggtttaacggttaacccttaaaggttttaaccttttaaacggtttaacttaaaacggttaaaaccgtaaagttaccggaaccggtttactaaccgggtcccctttaaccggacgttttaaacccggggttccggttaaaccggggacggttaaaccgggtaacttaacggggtaacttaaaccgtaaagttaaaacccggg

SEQ ID NO: 131633 - DNA, 786 bp, Homo sapiens
  misc_feature: GYAE6OF01BKRPU.36.7.A07.1.454.CMB.1.raw
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatcgacccagtcctccactcctccctgtctgcatctggtacgagacagactaccacctattccgttcgttagggtcggacgtaggtacggaaggtaccttagttcgtaacctaaagttttacgttaacggccgtttaggtaactcgacggactaacggacggtaacccgaaggggtacgttaaccgtttaccgaaaggtcccttacgttacggtacttaccgttagtccgtccttcgtacccctttaccgttaagttttcggaaccgtacggttccggaacggggttcccctaagttccggtcggtttacgagggtcgtacgtaggttcggtacttaccggtagggtaaacctaggttaccgtttaccaacccgtcgttacccaacgtaaccgtcgaggtaccctccggtccgtagaccgtagtaacccggttaagtaacggttacgttacggtttacccgtaaacttttaaacttttaacggtttaccttaaagggtaaaaccttaaggttaaacgtaccgtaaccgttgtccccgttacccgggtattacccgggttaacccggtccggggtaacccgggtaaggggtaaacccctttaagggacgtaaccgtttaaacgaaaacccggg

SEQ ID NO: 131634 - DNA, 707 bp, Homo sapiens
  misc_feature: GYAE6OF01A6YVF.36.7.A07.1.454.CMB.1.raw
  modified_base (149)..(149): a, c, t, g, unknown or other
  misc_feature (149)..(149): n is a, c, g, or t
tcagtacgctgtctcacgaccggtgctcgatttagcacgtgtcgcgagggggcagaagtctctctcagtcaggacacagcatggacatgagggtccctgctcagctccgtgggactcctgctgctctggcctcccagataccagatgtnacatccagatcgaccctagtcctaccactccctccctgtacctgcctatctaggtaggagactagactccaacctattccgtcgttcggacgggcgtaggtacggacggactatttaggtaacttaagtttaatttacgacgttacggttactacgagacaacggaagaccggtaagggtaagtaaccgttaccgtaagtacctacgtagacttacgtaagtcgtctaccgtccttacgttacgtttcgcgtaggtccggtacgggtaccctagttccgttacggttaccgaggttacggtacgtagggtacggtacgttacgggtacgggtaaccgttaagttaaccgttttacgacccggtttacctaccgaaccggttactacgtacggaccgtacgtacgtaccggacgtacggtactacggtaacgtagttagttaactacgtttaactttaacttaacgttaataacgtaaaatacgtaacgtacgttccgacttccgtactacgttaccggtacgggacggtacggaggtaacgtagtaagtacgtaaacg

SEQ ID NO: 131635 - DNA, 1088 bp, Homo sapiens
  misc_feature: GYAE6OF01DGX00.36.7.A07.1.454.CMB.1.raw
  modified_base (925)..(925): a, c, t, g, unknown or other
  misc_feature (925)..(925): n is a, c, g, or t
tcagtacgctgtctcacgaccggtgctcgatttagcacgtgtcgcaggggacccaaaaaccacacccctccttgggagaatcccctagatcacagctcctcaccatggactggacctggagctattcctttttctgggtggcgagcagacaacgaggtccgccccacctaccccgtagggttacctaaagtttgggtacgtacgtacggttccgtaggggagtccgttaaggaaaccgttagggaaaacgggaaccggtcccgggttacgggggttaacccgtttaaacgggttaaaaccggttccctaccgttacggaccgtaaacgggttcctttacggttaggttaaccgtagtttaccgtttaaggggtaggtaacgtcgtaaccgtaacgttaccgtacccgggtcggggtacggtaccggaaccgtccggggtaccccggttaaggggaaaccggtaaggggttcgttacggtaaggggttcgggtaaggtagggtaacggttagggtaccgtacgggaccgggtaccgtttaaccttaaacggtaaggttaaacccggttaaactaaaaccgttaaaggtttaaaacgtaacgggtaaaaccggttaaacgggttaaccgggttaaccggggacggggttaaaccggtaacggtaacggttaaccccgtaaaccgtaaacggttaacccggaaaaccctaaaaccttaaacccggaacccttaacccggaacccgtaacgggtaaccgaaacccggttacaaaccccggggttacttaaccggaacggttacgggaaccgtttaacggaacgggtaaccggggtactaacccggtaggtacccgttaacggttacggtaaccccgaaaggggtaccccggttaaccgggttacgttaacggtttacgttttaacgggnggggtaccgggggtaacggggggttacgggtttaggtccgggtttgggaacccgtttaccggacgttaccgttacggttccggtaaccggtacggtttaaaacccggtcggtttacccggggtaccggacccccggggttagggaccccgggtttaacccggg

SEQ ID NO: 131636 - DNA, 799 bp, Homo sapiens
  misc_feature: GYAE6OF01DHZ1Y.36.7.A07.1.454.CMB.1.raw
tcagtacgctgtctcacgaccggtgctcgatttagcacgtgtcgcgagggggcagaagtctctctcagtcaggacacagcatggacatgacgggtccctgctcacgtctccgtggctcctgctgctcgtcggcctcccagactaaccgagagtgtacgactactaccgaagtacgtaccgaaccctagtccctaccctacgttccccttccttgtcctcgactacgtcgtagggaacgaacgacgagtaccgtacctaacctacgttccgttcggttcgggaccggtaggtacggtacggacggtaacttagttacgttaaactttaagtttacgtttacggcgtttaggtacacgacggacgaacgggaagaccggtaaggttacgtaactttccgaacgttctaccgtagtactctacgtcgtccgtcgtaccttcgttagttcgacggttaccgtaccgggtaccgttacctaccgttcggttacggtaccgtgggtaggtcgtaaggttcgtaccggtacggtacggtaacttaccgttacgtttacccaccttacgtaacccgtacgtacttacccggaggtccacgtccgccgtaacgtcgaaccgtaagtcgttacgttaacgtacccttaaagtttaaacgtttctttaaacggaacgttaaaagttaacccgttacgtaaaccgttcgttaccccgggtcttaccgttaccccgttacggggtcccgggtaacggggtacgggtaaaccgggttagtaaacggttaacgtaacgttaacgtaaacccggg

SEQ ID NO: 131637 - DNA, 661 bp, Homo sapiens
  misc_feature: GYAE6OF01AB9T6.36.7.A07.1.454.CMB.1.raw
  modified_base (194)..(194): a, c, t, g, unknown or other
  misc_feature (194)..(194): n is a, c, g, or t
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatgacccagtctccatcctccctgtctgcatctgtagganacagagtcaccatctcgttggtcgggcagtggaggacattgtactaatttatttagcctaggtatcagcagacggaccgagggagtacgttaccgtagcctctgtactctatcgcctacgtcccttaccgtattttgacgtagtcggtacggggttcctacgtacgttcgttccggttacgtacggtcggtacgtacggttgggtaacgttcggtagggtactagttacgtttaccaccgttcctaccctacctactaccgtacgaccgtacgtccgtacgacgaccggtaccgttaaggtaacgtagtttacggttacgtaaccttaagttttaacgtttagttaacgttaaacgtaaaagtaacgttaacgtacggttcgtacccgtaccggttcctacccggttacgggttacccgggaacgggttaaccgggaaccggtaagggtacggtaacgttaaaccgg

SEQ ID NO: 131638 - DNA, 661 bp, Homo sapiens
  misc_feature: GYAE6OF01BX4Q6.36.7.A07.1.454.CMB.1.raw
tcagtacgctgtctcacgaccggtgctcgatttagcacgtgtcgcaggggacccaaaaaccacacccctccttgggagaatcccctagatcacagctcctcaccatggactggacctggagcattcctttttcttggtggcagcagcaacaggtgcccactcccaggttcaattggtgcagtctggagctagaactgaaggaagccgtggggccttagtaaacgtctcctgcaaggtcttctgttactcctttctacgtatggcatcagcgtgggtcgcgacgacggcccctggacaagggctcggagtggaggtgggggtagatcgaggtacctaactagtaggttaaccaactaaacgtagtcgacgaacggtaggttgacgaggtacaagaatacgaccgtatacgaaccacgaacgaccgtaccgaccgtaacgacacccaacgcgacgtacgaagtacggaacgtaggaggacgaccgtaggaccgtacggtagaccgacggaccgactaagtattacgttacgtgtacgtaacggaagaaccggtaacgggtacttacggttattacggtttaagtaacggttttacgggtttaggggtactttacggtagttacgttacgttttacgttagtaacttggttcgggtaaccgggg

SEQ ID NO: 131639 - DNA, 816 bp, Homo sapiens
  misc_feature: GYAE6OF01CWLGN.36.7.A07.1.454.CMB.1.raw
  modified_base (149)..(149): a, c, t, g, unknown or other
  misc_feature (149)..(149): n is a, c, g, or t
tcagtacgctgtctcacgaccggtgctcgatttagcacgtgtcgcagggggcagaagtctctctcagtcaggacacagcatggacatgacgggtccctgctcagctccgtgggactcctgctgctctggctccagataccgagtatggnacatccagatcgacccagtctccatcctcccgtgtactcgactagtcgtggaaggacaccgtagacgtacaacctgtcctccgttggaccgggagtacgggttacggaacgtacgtaacgttgtacttaagtttaacgttacgaccgttaggtacttacgagaccgaagaacgtaccggaaggacgtacgtaccaacgtctaccgtagtactactaacgtggtacctacgttactacttagtttacgacgtaacgtacggtaccggggtacctagtaccgttacggtgtaaccgggtacggtacgaggttacggtacgtacgggtaacgtacgtaagttaccttaaccgaacggttccttaaccgaaccgtacgtaaccgtcgtaaaccgtacgtacccgggtattaaccgggaacccggttacgtaacgggttaaaccggttaagtttaaccccggtttaaggttaccttaaaaacgtttaccgttttaaagtttacccgggtaaaaacttaaaaaccgggttaaacctaaacggttaacggtacccggttaaaccgtttaccccgttacccgttaacgtttaccggggttaaccccgggtaagggttacccccggtaaaaggtcccggggttaaaagttaacccggtaaacgttaaaaccccggg

SEQ ID NO: 131640 - DNA, 809 bp, Homo sapiens
  misc_feature: GYAE6OF01CPGEL.36.7.A07.1.454.CMB.1.raw
tcagtacgctgtctcacgaccggtgctcgatttagcacgtgtcgcgagggggcagaagtctctctcagtcagacacagcatggacagtggacgggtccctgctcacgcctccgtgggactccgtgctgctctcgacctccagactaccagatgcgacactccaagctccgaccctacgtcctcctactcccttcccgtgtcctcgctacgttcgtacggaggaacgacgacggtaccgtaccaaccttcgttccgttcggttagggtccggggacggtaacggttacgggaacggttaacgttaacgtttacgttaacctttaaagttttaccgttttaaccgggcgtttacggttaactaccgacggtaaacgaacgggaaccggtaaccggtaaggggttaacgtaaccgttttaccgaaccgttaccgttaccgtagtacctttacgacgtttcgaccgtttccgtacccgttttacgtttacgtttccggaaccgtttacgggtaacccggttacccggttacccgtttaacgttcccgggtttacgttacggttacgggtacggtacggttaggttacgggtacggttacgggtacggtaccgttacgttacgttacctacccgtacctactacctactacgacccgtcgacccgtcgtacgccgtacgtacgagtaacgtactacgttcgttattaactttagttaacgttagtaaacgtaagtaactcgtagtaccgccgttacgtaccggtcgttacgggtacggacggtaacgacggtaaccgtacgtacgtaagtaacg

SEQ ID NO: 131641 - DNA, 655 bp, Homo sapiens
  misc_feature: GYAE6OF01BR2GG.36.7.A07.1.454.CMB.1.raw
  modified_base (193)..(193): a, c, t, g, unknown or other
  misc_feature (193)..(193): n is a, c, g, or t
  modified_base (198)..(198): a, c, t, g, unknown or other
  misc_feature (198)..(198): n is a, c, g, or t
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatgacccagtctccatcctcctgtctgcatctgtagganacagngtacaccattcctcgttggtcgggcgaggtgaggactattgtctaatttatttagccgttaggtatcagacagagaccgagggagtagttccgtaagctcgtagattctagtcgtcttcgcccttcttatttcgctggttaccgacggggtcccagttccgttcgggttcgaggtggtcgtaggtggtagtcgtagggaccgtagtacgtttactacgttactaccgtactagttaccgacgtacgtcccgtagtccgtacgtccgttagtacgttgttaacttttacggaaccttaaacgttaatttaaccgtttacgtaccgtaacctacggtaaactaaactttaaagttaaacgttaacgttttaaggttacgggttacccgtttaccggggaaccggttaaaccgggtacgggttaacggggtaggtaacgtaaacgtacggtaaaaccggg

SEQ ID NO: 131642 - DNA, 749 bp, Homo sapiens
  misc_feature: GYAE6OF01AQXUP.36.7.A07.1.454.CMB.1.raw
  modified_base (144)..(144): a, c, t, g, unknown or other
  misc_feature (144)..(144): n is a, c, g, or t
tcagtacgctgtctcacgaccggtgctcgatttagcacgtgtcgcagggggcagaagtctctctcagtcaggacacagcatggacatgagggtccctgctcagctcctgggctcctgctgctctggctccagataccagatgtnacatccagatcgacccagtctccatccctccctgtctgctatcgttgaggagacagtagtcacctattccttcgttcggtcgggcgtaggtggaaggtactattgtactaatttattacgtcgttggtatcagtcaggacgtaaccggaagggtacgtacgtttaccgtaacggtccttaccgtagtacttctaacgttggtcctttccgtacccttttaccgttaacgtttttcggaccgttacggggttacccggtaaccgggggtttaccccttaacggtttcccggtttacccggggttttacgtaaccggggtttcgggtaccggttaaggggtttaccgggttacgtttaccgggttaacgggggttaaccttaagggtttaaccctttttaccctaacccgtttaccgtaccctaaccgtacgtaccgtaacgtccgtaacgtccgtacgacgtacgtcgtaacggtagttacgtgttaacgtactttaagtttacttagtactaaacgtaagttactaacgtagtcgtaccgtaccgttacttcggtaccggttacggtacggtacgggtaacgtaggtagtattaacgtaaaccgg

SEQ ID NO: 131643 - DNA, 717 bp, Homo sapiens
  misc_feature: GYAE6OF01B1WQE.36.7.A07.1.454.CMB.1.raw
tcagtacgctgtctcacgaccggtgctcgatttagcacgtgtcgcagggggacccaaaaaccacacccctccttgggagaatcccctagatcacagctcctcaccatggactggacctggagcatcctttttcttggtggcagcagcaacaggtgcccactcccaggttcaattggtgcagtctggagctgaactgaagagccgtggggccttagtaacgtctcctgcaaggtcttcgtggttaccttccttttcttacgtattggctctcgagtcgtgggtgccgacgacggccccgtaggacgaacgggctcggtaggtgggaggtgggggtaggagtcggaacggtcctaaacgtaagttacggttaaccaactaaacgttagtacggacgtaacgggtaaggttgaacgaaggaacgagtaagtacggaacctacgtacgacccaagtacgaccgaccgtacgaacgacgacctacgacgtacgtactaaggtacggtaacgtaggacgggtacctaccggtacgaccggtaccgacggtaaccgacgtacccggactaattaccgttaattacggtggtagaacggtaacggaacggttaccgggacttacggttagttaggttaaggttaaggttttaggggtttaggggtactttacggtagttacgttacgtttacgtttaggacgtttcggtccggggttaaccgggg

SEQ ID NO: 131644 - DNA, 779 bp, Homo sapiens
  misc_feature: GYAE6OF01DKRES.36.7.A07.1.454.CMB.1.raw
tcagtacgctgtctcacgaccggtgctcgatttagcacgtgtcgcgagggggcagaagtctctctcagtcaggacacagcatggacatggagggtccctgctcagcctccgtgggactccgtgctgctcgtggcctacccagactaccagtagtgtcactactccaagtactccgaaccctagtccctacctacttccccttccctgtccgtacgactacttcggtaaggtaacgggaacgaacgaacggtaccgtacctaacctcgttccgttcggttacggggaccggggtacgtacggtaggaacggttacttacggttcttaaacctttaaagttttacggtttacgaccgtttaggtactacggacgtaccgaagggaaaccgaccgggtaagggtacgtttaccttaccgtaacgtccttacgtatacgttatcggtctccttacgtccttagtttacgtagcggtaacgtcgggacctttactcgttcgggtacgtcgtgacggactagtagggacgtcggacgtacgttacgtcttaccgcttacctacaacttacgacgacgtaaccctccgtacgtacgaccgtagtaacggtagtaacgttgttaaccggtacttaacttttaaccgttttagtaacggttaaccgtaaaacggttaaacttaccgtacggttaccccggtacccttacggtacccttacggggttcggttaacgggaaccggggtaacgaacgggttacggaattaacgaacgtaaccgttaacggg

SEQ ID NO: 131645 - DNA, 814 bp, Homo sapiens
  misc_feature: GYAE6OF01D23PR.36.7.A07.1.454.CMB.1.raw
tcagtacgctgtctcacgaccggtgctcgatttagcacgtgtcgcaggggacccaaaaaccacacccctccttgggagaatcccctagatcacagctcctcaccatggactggacctggagcattcctttttcgttggtgcagcagcaacgaggtcgccctactccctaggtttactaagttggtgcgtagttcgtggagcgtgaacgtagaagacgtccgtagggtaccttaaggtaaccgtctccgtgacgtaacgtcctttcgttacgtttacctttccgtttacttacgtagtggactagtcaggtcgtggtcgaccgtacgaccggtcccaggaacgacggtcgtaccggtaggttgggtaggttcgggggtacgtacgtaccggtaacgggtaaccttaaacggtaacggtaaccggttaaccaaacgtaaacgttacgtacggaaccggtaagggttaaaccggttgaacggtaacggtaacgaaggtaacgtaccgaacgtaacgtaaccgaacgaacgacgtaaccgaccgtaacacggacgacgaacgtacgtaccggtaagtaacggtaacggtaacgtaggaacggtacgtacggtacgaacgaccggtacgaaccggtaccgaacgaacttaagtaacgtttacgtacggttagacggaacgtaaacggtaacgtaaacggtcgtacggttacggtttaggttaaggtttaacggttttagggttaagggttacgttacgtacggtttacgtttaacttttaccggtttaaggttaccgttacgggttacgggtaacgggg

SEQ ID NO: 131646 - DNA, 756 bp, Homo sapiens
  misc_feature: GYAE6OF01EF97J.36.7.A07.1.454.CMB.1.raw
tcagtacgctgtctcacgaccggtgctcgatttagcacgtgtcgcagggggcagaagtctctctcagtcaggacacagcatggacatgagggtccctgctcagctcctgggactcctgctgctctggcctcccagataccagatgtgacatccagatcgacccagtcctccatcccgtcctgtctagccattcgtaggaggacacagtacgtaccacctaattccgttcgtttacgggacggggtacctaaaggttcggaagggtaactaacgtttacggttaaccttaaaagttttaacgtttacggtacccgtttagggttaacttacgaacggtaccgtaaggaaggtaaccgaagggggtaacgtaacggtttaccgtaaacgtccgtacccgtagtacttacgtagtcgtcgtccgtaccgttacctacgttttcgcgtacgtccgtaacgggtccctaagttccgtcggttacgaaggttcggcgtaggttcgagtcggtagggactagttactttaccgaacttccgactaccgtactacgacgtaccacgtccttagacacgtccgtaagtaagtagttcggtaactacctttaaagtttacgttaagtttaacgtaacgtaaaaagttacgtaaacccgttagtaccgtcccgttaccgtaccttacggtttaacccgggttacgggaacccgggtaaagggtaacccgttaaagggttacggttaaataacccggttaaaacccgg

SEQ ID NO: 131647 - DNA, 700 bp, Homo sapiens
  misc_feature: GYAE6OF01BDF3Z.36.7.A07.1.454.CMB.1.raw
  modified_base (691)..(700): a, c, t, g, unknown or other
  misc_feature (691)..(700): n is a, c, g, or t
tcagtacgctgtctcacgaccggtgctcgatttagcacgtgtcgcagggggcagaagtctctctcagtcaggacacagcatggacatgagggtcccctgctcagctccgtgggacctcctgctgctctgcctcccagactaccagatgcgacatccagatacgacccagtcctccactcccttccctgtctgactattccgtaggtaacggagaaccaggactacaacctacgttccttcgtttacgggccggggacgtaaggaggtaacggtacttagtttaggttaacctaaaagttttacgtttacggtacgttacggttaacgtacctaacggacgaacggaaccggaaccggtaagggtaacgttaaccgttaccgtaacgtcccgttactacggttaactccttaagtccgtacgtaccgtcctttaccttacgtttcgacgtacgtacggtaccgggtcctagttccgttcgtacgtaggtcggacgtaggtagtacgtcgtacggtacgtagttacttactactacctactacctactcgacgacgcgtcctacgtcgtacgtacgtacgtaacgttacgttacgttacgtaaccttaacgtttaactttaacgttaacgtaaacgttaaagttaacgttaacgtaacgttaccgtaccgtaccgttaccgttaacccggttnnnnnnnnnn

SEQ ID NO: 131648 - DNA, 759 bp, Homo sapiens
  misc_feature: GYAE6OF01C1WIO.36.7.A07.1.454.CMB.1.raw
tcagtacgctgtctcacgaccggtgctcgatttagcacgtgtcgcaggggggcagaagtctctctcagtcaggacacagcatggacatgagggtccctgctcagctcctgggactcctgctgctctggcctcccagataccagatgtgacatccagatcgacccagtcctccactccctccctagtcctgacatcgtagtaggagacagacgtccacctattcctcgttcgggtcgggacgtaggtgaaggtactagttcgtactaatttagtttacgaccgtggtactacgagacaggaacgaccgaggggagtacgttacgtaacgccttacgtagtactacttacgtcgtccgtaccgtccttaccttagttttacgcgttaacgtccggtacggggtaccctacgttccggttcgggtactagggtcggacgtaaggtcggtacgttacggtacgggtaactaaggtttacttaccgtaacttcctaaccgtaacctactaccgaacggtacccgtaacgtcccggtaaccgtccgtaacgtccggttaaggaaacgtttggttaacgtttccggttaactttaaacgtttagttttaacttagtaaacgttaaaaacgttaacgtaaacgttacggtaccgttacccgttccgacccggttacccggtttaaccgggttaccccgggggaaacgggttacccggggaaaccgggttaagggttaacgggtagtttaaaccggtaaaaccccggg

SEQ ID NO: 131649 - DNA, 466 bp, Homo sapiens
  misc_feature: GYAE6OF02I6HF7.36.7.A07.1.454.CMB.1.raw
tcagtacgctgtctcacgaccggtgctcgatttagcacgtgtcgcaggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcaccatctcttgtcgggcgagtgaggacattgtcaattatttagcctggtatcagcagagaccagggagagttcctaagctcctgatctatgctgcctccatttgcagtcaggggtcccatctcggttcagtggcagtggatctgggacagatttcactctcacatcagcagcctgcagcctgaagatgttgcaacttattattgtacaaagttataacagtagctaccgctctactttcggcggaggaccaaggtggatataacg

SEQ ID NO: 131650 - DNA, 480 bp, Homo sapiens
  misc_feature: GYAE6OF02FZG91.36.7.A07.1.454.CMB.1.raw
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcaccatctcttgtcgggcagtgaggacattgtcaattatttagcctggtatcagcagagaccagggagagttcctaagctcctgatctatgctgcctccatttgcagtcaggggtcccatctcgttcagtggcagtggatctgggacagatttcactctcaccatcagcagcctgcagcctgaacgatgttgactaacttattattgtacaaaagtataacagtgtctccgcttccacgttttccggcggtagggacctaagggtcggtatagtaaccg

SEQ ID NO: 131651 - DNA, 475 bp, Homo sapiens
  misc_feature: GYAE6OF02FYFJA.36.7.A07.1.454.CMB.1.raw
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcaccatctcttgtcgggcgagtgaggacattgtcaattatttagcctggtatcagcagagaccagggagagttcctaagctcctgatctatgctgcctcctattttgcagtcaggggtcccagtctcggttcagtggctagtggatcgtgggacagatttcactctcaccatcagcagcctgcagcctgaagatgttgctaattattattgttacaaatatacagtagctccgactctacgttcggacggtacgggaccaaggtgtatataacg

SEQ ID NO: 131652 - DNA, 472 bp, Homo sapiens
  misc_feature: GYAE6OF02G2MRD.36.7.A07.1.454.CMB.1.raw
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcaccatctcttgtcgggcagtgaggacattgtcaattatttagcctggtatcagcagagaccagggagagttcctaagctcctgatctatgctgcctcattttgcagtcaggggtcccatctcgttcagtggcagtggatctgggacagatttcactctcaccatcagcagcctgcagcctgaagatgttgctaactttattattgtactaaagtataacagtgctccgctcacgtttcggacggtacggaccgaaggtggatagtaaccg

SEQ ID NO: 131653 - DNA, 521 bp, Homo sapiens
  misc_feature: GYAE6OF02IZ23G.36.7.A07.1.454.CMB.1.raw
  modified_base (441)..(441): a, c, t, g, unknown or other
  misc_feature (441)..(441): n is a, c, g, or t
  modified_base (459)..(459): a, c, t, g, unknown or other
  misc_feature (459)..(459): n is a, c, g, or t
tcagtacgctgtctcacgaccggtgctcgatttagcacgtgtcgcaggggacccaaaaaccacacccctccttgggagaatcccctagatcacagctcctcaccatggactggacctggagcatccttttcttggtggcagcagcaacaggtgcccactcccaggttcaattggtgcagtctggagctgaactgaagaagcctggggccttagtaaacgtctcctgcaaggcttctggttactcctttcttacgtatggcatcagctgggtgcgacaggcccctggacaagggctcgagtggatggggtggatcaggcctaacgaatggttacacaaactatgcacggaagttgcaggacagaatgacatgaccacagacacgtcacgagcacagcgtacatggaactgaggagctgagactgacgacacgcatatatacngtgcgagaataaccgggntaccgtatgttgtaattaaggtttggggattcgtagtgtacttcctttgattatgtacgggg

SEQ ID NO: 131654 - DNA, 803 bp, Homo sapiens
  misc_feature: GYAE6OF02JP71W.36.7.A07.1.454.CMB.1.raw
tcagtacgctgtctcacgaccggtgctcgatttagcacgtgtcgcagggggcagaagtctctctcagtcaggacacagcatggacatgagggtccctgctcagctcctggactcctgctgctctggctcccagataccagatgtgacatccagactgacccagtctccatcctccctgtctgcatctgtaggagacagagtcacctatcctcttggtcgggctagtgaggactattgtacctaagtttacgtttacggccttaggtactcgaacgtacgaacgaacggacccgaggggtaacgtacggtttaccctaaggtaccgttccgtagtaacgtcccttaagtcgtaccgttcgtacccttaccgttaagtttttcggaccgttaaacggttcccggtaacgggggtttaccccttaacgttcccgttttaccggggttaccgtaacggggtttccgggtaccgttaacgggttacgggtaacttaccgggttacggggtaacttaacgggtttaaccttttaccgaaccctttccggtaaccttaaacccgtacgttacccgaacggttacctacggtaccccgtttacggaccctacggttaccccgtaagggtaaaccgttacgtttacggggttaccttaaccgttaaacggtttaaacttttacggttacgttaaaactaaaacgttaacgtaacgttagttaccggtccgttaaccgtccgttaaacgtcccggttttaacgggaccggtaaccgggtaacgttaacgggtacggtaactaccgtaaaccgg

SEQ ID NO: 131655 - DNA, 585 bp, Homo sapiens
  misc_feature: GYAE6OF02HFZD9.36.7.A07.1.454.CMB.1.raw
  modified_base (270)..(270): a, c, t, g, unknown or other
  misc_feature (270)..(270): n is a, c, g, or t
  modified_base (362)..(362): a, c, t, g, unknown or other
  misc_feature (362)..(362): n is a, c, g, or t
  modified_base (416)..(416): a, c, t, g, unknown or other
  misc_feature (416)..(416): n is a, c, g, or t
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatgacccagtctccatcctccctgtctgcatctgttggagacagagtcaccatcacttgccgggcaagtcagagcattagccactttttaaatggtatcagttcaaaccagggaancccccaggctcctcatctacggtgcgtcagtttgcagagtggggtcccaacgaggttcagtggcagtggatcggggacaggatttcatttcncaccattaacagtctacactgaagtattttgctaactttactacttgtacaaanacgtagtttaacactttaccttacctccggtactaagtttccgggaacccgtaaccgggggaacccgtaagggttggggtaaaactacccggtaaaaccggaaaccgttcgggttagacccggttcggactaacccgaactttccgttacggtttacctttccgtaacg

SEQ ID NO: 131656 - DNA, 510 bp, Homo sapiens
  misc_feature: GYAE6OF02JXLDM.36.7.A07.1.454.CMB.1.raw
  modified_base (396)..(396): a, c, t, g, unknown or other
  misc_feature (396)..(396): n is a, c, g, or t
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcaccatctcttgtcgggcgagtgaggacattgtcaattatttagcctggtatcagcagagaccagggagagttcctaagctcctgatctatgctgcctctattttgctagtcaggggtcccatctcggttcagtggcagtgagtgtgggactagtatttcactctacaccatcagcacgcctgcagcctgaagtntgtgactaactttattagttctaactaaagtataactagtcgtcctaccgcttaccgtacgttttccggacgggtacgggtaacccgaagggttaggtacgttagtaaacccgg

SEQ ID NO: 131657 - DNA, 587 bp, Homo sapiens
  misc_feature: GYAE6OF02IP02H.36.7.A07.1.454.CMB.1.raw
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcaccatctcttgtcgggcgagtgaggacattgtctaattatttagcctggtatcagcagagaccgagggagagttcctaagctcctgatctatgctcgtcctcctattttgactagtcgtacgggtccctagtcgttcggttcaggtggacgtaggtaggtatcgtagggactagtactttccacttcctcctacctactcgacgcgacgtcctcgaccgtacgccgtagaagtacgttggttacgactttaactttaagtttaacttacgttaaacgtaaagttaacgttaacgtaggttacgtccgttacccgtacgtttaccgttaccggtttaccgggacgggttaacgggaaccgtaagggtacggtactacgttaaacgg

SEQ ID NO: 131658 - DNA, 476 bp, Homo sapiens
  misc_feature: GYAE6OF02F2LOR.36.7.A07.1.454.CMB.1.raw
  modified_base (420)..(420): a, c, t, g, unknown or other
  misc_feature (420)..(420): n is a, c, g, or t
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcaccatctcttgtcgggcagtgaggacattgtcaattatttagcctggtatcagcagagaccagggagagttcctaagctcctgatctatgctgcctcatttgcagtcagggtcccatctcgttcagtggcagtggatcgtgggacagatttcactctcaccatcagcagcctgcagcctgaagatgttgactaactttattattgtacaaagtataanagtgactccgctactacgtttcggacggtagggaacccgagggtggtatataaccg

SEQ ID NO: 131659 - DNA, 530 bp, Homo sapiens
  misc_feature: GYAE6OF02G3OYE.36.7.A07.1.454.CMB.1.raw
  modified_base (311)..(311): a, c, t, g, unknown or other
  misc_feature (311)..(311): n is a, c, g, or t
  modified_base (408)..(408): a, c, t, g, unknown or other
  misc_feature (408)..(408): n is a, c, g, or t
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatgacccagtctccatcctccctgtctgccatctgtaggagacagagtccaccatctcttggcgggcgagtgaggacattgtcaatttatttagcctggtatcagcagagaccgagggagagttcctaagctcctgatctatgctgcctcctatttncagtcacggggtcccatcgtcgttcagtggctgtgatcgtgggacagtagtttcactcgtacacctatcagcagcctgcacgtctagaagtactgtnactaactttattatttagtaactaaagttagtaactagtacgtctacccgtacttccttaaccggtttccgggacgggtacgggtaacccggtaagggtacggtacgttacgttaaacccgg

SEQ ID NO: 131660 - DNA, 550 bp, Homo sapiens
  misc_feature: GYAE6OF02I5FHZ.36.7.A07.1.454.CMB.1.raw
  modified_base (194)..(194): a, c, t, g, unknown or other
  misc_feature (194)..(194): n is a, c, g, or t
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatgacccagtctccatcctccctgtctgcatctgtagganacagagtcaccatctcttgtcgggcagtgaggacattgtcaattatttagcctggtatcagcagagaccgagggagagttcctaagctcctgatctatgctgcctcctattttgctagtcgacggggtcccatctcggttcagtcggctaggtggtatcgtcgggactagtatttcactctcgaccatcagcagtcctgcacgcctagaagtacgttgttcgaacctaacttttatttaagttacgtaacgtaaaaagttactaacgtagttacgccgttaccgtacgttaccgttacgtttccgggaccggtaacggggtaacccgtaaggggttacggtaactacgtaaaccgg

SEQ ID NO: 131661 - DNA, 521 bp, Homo sapiens
  misc_feature: GYAE6OF02H7CVQ.36.7.A07.1.454.CMB.1.raw
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatgacccagtctccatcctccctgtctgccatctgtaggagacagagtcaaccatctcttggcggcgagtgaggacattgtactaattatttagccttggtatcagcagagaccgagggagagttacctaagctcctgtatctatcgctgcctctatttcgctagtcgacgggtcccatcgtcgtcagtggcaggtgtatcgtggactagtcttcacttctcacatcagcacgctgcagcctagaagtatgtacgactaactttattacgttagtaactaaaagtataacgtacggtccgcccgtctactaccgtttacgggaccgggtaacggaccgtaagggtacggacgtactacgtaaaccgg

SEQ ID NO: 131662 - DNA, 498 bp, Homo sapiens
  misc_feature: GYAE6OF02HNA3Q.36.7.A07.1.454.CMB.1.raw
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcacatctcttgtcgggcagtgaggacattgtcaattatttagcctggtatcagcagagaccagggagagttcctaagctcctgtatctatgctgcctctatttgctagtcagggtcccatctcgttcagtggcagtggatctgggacagtattcactctcacatcagcagcctgcagcctagaatatgtagactaatttattattcgtacttaacaagttacttaactaactttaccctacgttacgttaccggaccgaagggacctaagggtagaacgttacgaacgtacgtacgg

SEQ ID NO: 131663 - DNA, 585 bp, Homo sapiens
  misc_feature: GYAE6OF02GNOGW.36.7.A07.1.454.CMB.1.raw
  modified_base (221)..(221): a, c, t, g, unknown or other
  misc_feature (221)..(221): n is a, c, g, or t
tcagtacgctgtctcacgaccggtgctcgatttagcacgtgtcgcagggggcagaagtctctctcagtcaggacacagcatggacatgagggtccctgctcagctcctgggactcctgctgctctggctcccagactaccagatgtgacatccagatgacccagtctccatcctccctgtctgcatctgtaggatacagagtcaccatctcttgtcggganagtgaggacattgtcaattatttagcctggtatcagcagagtaccagggagagttcctaaagctccgtgactcctaatgctggcctccattttcgcagtcgacggggtcccatcgtcggttcagtcggcaggtggatcgtagggactagtactttcgacttctacaacctacgtacaacgtcaacgtccgtgaactacggtccctaggaaacgtagttcggttacgaccttaaacgttttaattaacgttaagttaacgtaaaaagttactaaacgtagtacggtccgttaccggtaccttaccgttacgtttccgggacgggtacgggtaacccgtaagggtcggtaactagttaaaacccgg

SEQ ID NO: 131664 - DNA, 512 bp, Homo sapiens
  misc_feature: GYAE6OF02HO0VD.36.7.A07.1.454.CMB.1.raw
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcaccatctcttgtcgggcgagtgaggacattgtcaattatttagcctggtatcagcagagaccagggagagttcctaagctcctgatctatgctgcctctatttgcagtcaggggtcccatctcggttcagtggcagtggatcgtgggacagtatttcactctcacatcagcagcctgcagcctgaagtatgttacgactaactttatttagttataactaaaagttataacgtagttacgcctaccgtctaccgtaccgttttcgggacgggtaacgggtaccgtaagggtacggtacttagtaaaccgg

SEQ ID NO: 131665 - DNA, 492 bp, Homo sapiens
  misc_feature: GYAE6OF02GDMR1.36.7.A07.1.454.CMB.1.raw
  modified_base (350)..(350): a, c, t, g, unknown or other
  misc_feature (350)..(350): n is a, c, g, or t
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcaccatctcttgtcgggcgagtgaggacattgtcaattatttagcctggtatcagcagagaccagggagagttcctaaggctcctgatctatgctgcctcattttgcagtcaggggtcccatctcgttcagtgcagtgatctgggcagntttcactctcaccatcagcagcctgcagcctgaagattgttgactaactttattattgtactaaaagtattaacgagtgtcctaccgtctcctacgtttccgggacggtacgggtaacccgaagggtggtaatagtaaaccg

SEQ ID NO: 131666 - DNA, 588 bp, Homo sapiens
  misc_feature: GYAE6OF02G1BJM.36.7.A07.1.454.CMB.1.raw
  modified_base (383)..(383): a, c, t, g, unknown or other
  misc_feature (383)..(383): n is a, c, g, or t
tcagtacgctgtctcacgaccggtgctcgatttagcacgtgtcgcagggggacccaaaaaccacacccctccttgggagaatcccctagatcacagctcctcaccatggactggacctggagcatcctttttcttggtggcagcagcaacaggtgcccactcccaggttcaattggtgcagtctggagctgaactgaagagcctggggccttagtaaacgtctcctgcaaggcttctggttactcctttcttacgtatggcatcagctgggtgcgacacggcccctggacaagggctcggagtggagtggggtggatcgaggcctaacatggttaacacaaactatgcgacggaagttgacgaggacagaatgacatgaccanacgacacgtaccacgagcacgagacgtaacagtaggaacgtggaacggacgccgtagacgaccgtagacgacgacggcatatattactgtagacgaagaaacgtaaccgggactaccgtagttggttagtaagttttaaggttttagggggtatttaggtagttaggttactttccgttttagtacgttagttacggttacgggg

SEQ ID NO: 131667 - DNA, 513 bp, Homo sapiens
  misc_feature: GYAE6OF02H43VI.36.7.A07.1.454.CMB.1.raw
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcaccatctcttggtcgggcgagtgaggacattgtcaattatttagcctggtatcagcagagaccagggagagttcctaagctcctgatctatgctgcctccattttgctagtcaggggtcccatctcggttcagtggcagtggatctgggacagtatttcactctcacctatcagcagcctgcagcctagaagtatgttgactaactttattagttgtaacaaagttataactagtgaccttcccgcttaccgtacgtttcgggaccgggtaacgggtaacccgtaaggggtcggtaacttagtaaacccgg

SEQ ID NO: 131668 - DNA, 554 bp, Homo sapiens
  misc_feature: GYAE6OF02H7LGM.36.7.A07.1.454.CMB.1.raw
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcaccatctcttgtcgggcgagtgaggacattgtcaatttatttagcctggtatcagcagagaccagggagagttcctaagctcctgatctatgctgtcctcctattttcgctagtcgagggtcccagtctcggttcaggtggcagtggatcgtgggacaggtatttaccgacttctacgaccatcgaagccagcctgcagcctagaagtagttgtagacttaacgttaatttaagttcgtaaacgtaaaagttactaaacgtgtacgtaccgtcccggtacttaccgtaccgttttccgggaccgggtaacggggtaaacccgtaaggggtacggtaactacgttaaacccgg

SEQ ID NO: 131669 - DNA, 534 bp, Homo sapiens
  misc_feature: GYAE6OF02JZV2R.36.7.A07.1.454.CMB.1.raw
  modified_base (194)..(194): a, c, t, g, unknown or other
  misc_feature (194)..(194): n is a, c, g, or t
  modified_base (209)..(209): a, c, t, g, unknown or other
  misc_feature (209)..(209): n is a, c, g, or t
  modified_base (391)..(391): a, c, t, g, unknown or other
  misc_feature (391)..(391): n is a, c, g, or t
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatgacccagtctccatcctccctgtctgcatctgtagganacagatcaccatctnttgcgggcagtgaggacattgtctaattattagcctggtatcagcagagaccgagggtagacgttacctaaggcttccgtgtatctaatgtctcgccttctattttgctagtcgtacgggtcccattcgtcgttcaggtcgactagtgatcgtggactaggtatttcgacttcctacacctntacgacgtcagcctgacacgcctagaagtatgttacgtactaactttattaacgttacgtaacgtaaagtactacgtagtacgtccgtaccgtacttccgtacgttcgggacggtacggaacgtaggtacgtatacgtaaccg

SEQ ID NO: 131670 - DNA, 540 bp, Homo sapiens
  misc_feature: GYAE6OF02HF12Q.36.7.A07.1.454.CMB.1.raw
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcaccatctcttggtcgggcgagtgaggacattgtcaattattagcctggtatcagcagagaccagggagagttcctaagctcctgatctatgctgcctctattttgctagtcgtacggggtcccagtcgtcggttcgagtggctaggtggatcgtgggacagtatttcactctcacctatcagcacgcctgcacgcctagaagtattgtacgacttaactttatttaattacgtaactaaaagttactaacgtagttacgtacctacccgtacttaccgtaccggttttcgggaccgggtaacgggtaaccgtaaagggtcggtaagtacgtaaaccgg

SEQ ID NO: 131671 - DNA, 567 bp, Homo sapiens
  misc_feature: GYAE6OF02JZGLI.36.7.A07.1.454.CMB.1.raw
  modified_base (210)..(210): a, c, t, g, unknown or other
  misc_feature (210)..(210): n is a, c, g, or t
  modified_base (237)..(237): a, c, t, g, unknown or other
  misc_feature (237)..(237): n is a, c, g, or t
  modified_base (260)..(260): a, c, t, g, unknown or other
  misc_feature (260)..(260): n is a, c, g, or t
  modified_base (264)..(264): a, c, t, g, unknown or other
  misc_feature (264)..(264): n is a, c, g, or t
  modified_base (328)..(328): a, c, t, g, unknown or other
  misc_feature (328)..(328): n is a, c, g, or t
  modified_base (369)..(369): a, c, t, g, unknown or other
  misc_feature (369)..(369): n is a, c, g, or t
tcagtacgctgtctcacgaccggtgctcgatttagcacgtgtcgcagggggcgagaagtctctctcagtcaggacacagcatggacatgagggtccctgctcagctcctgggactcctgctgctctggctcccagataccagatgtgacatccagatgacccagtctcatcctcccgtgtctgacatctgtagagacagatcaccatctnttggcggcagtgaggacatgtcaattnttagcctggtatcagcagagacngganagtctaagactctgactctatcgcgtcgccttcattttgctagtcgagggtcccatctcggttnacgtggctagtgatcgtggacagtaacttcgctctcgtacntcaggctagccttgacacgtccgtataagtacgttcgttaggtacctaaccgtttatttacgttagtaaccgttaaaagttacgttaaacttggttacgtaccgttacccgtacgttaaccgttaacggtttacccggggtaacgggtaacgggtaaccccgttaaagggtacggttaacgtaactttaaaccccggg

SEQ ID NO: 131672 - DNA, 487 bp, Homo sapiens
  misc_feature: GYAE6OF02JI5R8.36.7.A07.1.454.CMB.1.raw
  modified_base (385)..(385): a, c, t, g, unknown or other
  misc_feature (385)..(385): n is a, c, g, or t
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcaccatctcttgtcgggcagtgaggacattgtcaattatttagcctggtatcagcagagaccagggagagttcctaagctcctgatctatgctgcctcatttgctagtcagggtcccatctcggtcagtgcagtgatctggacagatttcactctcaccatcagcagcctgcagcctagaagtntgtcgacgtaactttattattcgtacaaaagttataactagtcgtctccgtactcgtacgtttcgggacggtacgggacctaagggtcggtagtagtaaccg

SEQ ID NO: 131673 - DNA, 485 bp, Homo sapiens
  misc_feature: GYAE6OF02I07X7.36.7.A07.1.454.CMB.1.raw
  modified_base (194)..(194): a, c, t, g, unknown or other
  misc_feature (194)..(194): n is a, c, g, or t
  modified_base (350)..(350): a, c, t, g, unknown or other
  misc_feature (350)..(350): n is a, c, g, or t
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatgacccagtctccatcctccctgtctgcatctgtagganacagagtcaccatctcttgtcgggcagtgaggacattgtcaattatttagcctggtatcagcagagaccagggagagttcctaagctcctgatctatgctgcctccattttgcagtcagggtcccatctcgttcagtgcagtgatcgtgggacagntttcactctcaccatcagcagcctgcagcctagaagatgttgactaactttattagtttgaactaaaagtataactagtgaccttccgctctaccgtttcggacggtagggaacctagggtacgtatataaccgg

SEQ ID NO: 131674 - DNA, 737 bp, Homo sapiens
  misc_feature: GYAE6OF02JZPDG.36.7.A07.1.454.CMB.1.raw
  modified_base (194)..(194): a, c, t, g, unknown or other
  misc_feature (194)..(194): n is a, c, g, or t
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatgacccagtctccatcctccctgtctgcatctgtagganacagagtcaccatctcttggcgggcagtgaggacattgtactaattattagcttggtatcagtcagagaccgagggagtacgttaccgtaagccttaccgtgtatccttaagtcggtccttacgcccttccgtaagttttcgccgtaggttaccgtaaccggggttccctaacgttccgttacgggtttcctaagggttccgggtacgtagggttacgggtacgttaccggtcgggtaaccgtaggttaacgttttaccgacctttccgtacctaaccgtacgttaccgacgtacctaaccggtcccgttagaccgacgtccgtaagtaaacggtacgtttacggttacgtaaccgttaacttttaagtttaacgttaaaccgtaaacggttaaaaaacgtttacgttaacgtaacggtttaccggtacccgttacccggtaccttaacccgggttaccggtttaaccggggtacccgggtaacggggttaaacccccgggtaaagggtttaaccgggtaacgttaacccggttaaacccggg

SEQ ID NO: 131675 - DNA, 478 bp, Homo sapiens
  misc_feature: GYAE6OF02H6FFN.36.7.A07.1.454.CMB.1.raw
  modified_base (194)..(194): a, c, t, g, unknown or other
  misc_feature (194)..(194): n is a, c, g, or t
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatgacccagtctccatcctccctgtctgcatctgtagganacagagtcaccatctcttgtcgggcagtgaggcattgtcaattatttagcctggtatcagcagagaccagggagagttcctaagctcctgatctatgctgcctctatttgcagtcagggtcccatctcgttcagtggctagtgatcgtgggacagtatttcactctcaccatcagcagcctgcagcctagaagtatgtgactaatttattattgtaactaaagttactaacagtgctcctctctacgtttcggacggtaggaccgtaagggtcgagtataaccg

SEQ ID NO: 131676 - DNA, 572 bp, Homo sapiens
  misc_feature: GYAE6OF02GL8PZ.36.7.A07.1.454.CMB.1.raw
  modified_base (197)..(197): a, c, t, g, unknown or other
  misc_feature (197)..(197): n is a, c, g, or t
  modified_base (219)..(219): a, c, t, g, unknown or other
  misc_feature (219)..(219): n is a, c, g, or t
  modified_base (249)..(249): a, c, t, g, unknown or other
  misc_feature (249)..(249): n is a, c, g, or t
  modified_base (307)..(307): a, c, t, g, unknown or other
  misc_feature (307)..(307): n is a, c, g, or t
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatcgaccctagtttccatccctccctgtctgcatctgtagganacagagtcacatctctgccggnaagtcaggcataacatcattagcctgtatnagtcaagaaaccaggtaaagttacctaagcctcctagatatatgctgtattcactgtntcgacgtcggggtcctagtcgtcggttcaggtgcgtaggtggtagtagtgggataggtatttcacttcctacgacctatacagcacgtcctgacacgtctgaagtatgttacgacgttaactttatttaagttacgtaaacgtaaagttactaacgtagtccggacccgttaccgtaccgttaccggtttacgggaaccgggtaacggggtaaccgtaaggggtaccgtaacggtacgtaaccgaaacggtacgttgggtaccgg

SEQ ID NO: 131677 - DNA, 538 bp, Homo sapiens
  misc_feature: GYAE6OF02IHUGJ.36.7.A07.1.454.CMB.1.raw
tcagtacgctgtctcacgaccggtgctcgatttagcacgtgtcgcaggggggcagaagtctctctcagtcaggacacagcatggacatgagggtccctgctcagctcctgggactcctgctgctctggctcccagataccagatgtgacatccagatgacccagtctccatcctccctgtctgcatctgtagagacagatcacatctcttgtcgggcagtgaggacattgtcaattattagcctggtatcagcagagaccgaggggagtacgttacctaagctctgatctatgctgtcctctattttgctagtcgacgggtccctagtccgttcggttcagtcggctaggtggtatcgtagggtactagtatttcacttctaccaccatacagtcagtcctgccagccgtagaagtagtgttagtacttaattattaattacgtaactaaagttataacgtagtgacttaccggtctaccgttacgtttaccgggacgggtaacggtaccggtaagggtaggttaactagtaaaccgg

SEQ ID NO: 131678 - DNA, 567 bp, Homo sapiens
  misc_feature: GYAE6OF02G110A.36.7.A07.1.454.CMB.1.raw
  modified_base (385)..(385): a, c, t, g, unknown or other
  misc_feature (385)..(385): n is a, c, g, or t
tcagtacgctgtctcacgaccggtgctcgatttagcacgtgtcgcaggggacccaaaaaccacacccctccttgggagaatcccctagatcacagctcctcaccatggactggacctggagcatccttttcttggtggcagcagcaacaggtgcccactcccaggttcaattggtgcagtctggagctgaactgaagagcctggggccttagtaaacgtctcctgcaaggcttctggttactcctttcttacgtatggcatcagctgggtgcgacacggcccctggacaagggctcggagtggagtggggtggatcgaggcctaacaagtggtaacacaaactagtagcgtacggaagttgacgaggacagaatgacatgaccanagacacgtccacgagacacagcgtacagtagaactgagagcctaggacgacgtgacgacgacggcatatattactgtgacgaagaacgtaaccgggataccggttattggttagtaagtttaaggttttaggggatttacggagttacgtagttccgttttagacgttagttcggtacgggg

SEQ ID NO: 131679 - DNA, 519 bp, Homo sapiens
  misc_feature: GYAE6OF02GHY1T.36.7.A07.1.454.CMB.1.raw
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcaccatctcttgcgggcagtgaggacattgtcaattatttagcctggtatcagcagagaccagggagagttcctaagctctgatctatgctgcctccattttgctagtcacggggtcccatcgtcggttcagtggcaggtgagtcgtgggacagtactttcactctcaccatcagcacgcctgacagcctagaacgagttgttacgaccttaaactttagtttaattagttaacgtaaaagttactaacgtagtcgtacctccgtcctacgtaccgtttcgggacggacgggaccgtaagggtggtactagtaaccgg

SEQ ID NO: 131680 - DNA, 745 bp, Homo sapiens
  misc_feature: GYAE6OF02HWP48.36.7.A07.1.454.CMB.1.raw
  modified_base (202)..(202): a, c, t, g, unknown or other
  misc_feature (202)..(202): n is a, c, g, or t
tcagtacgctgtctcacgaccggtgctcgatttagcacgtgtcgcgagggggcgagaagtctctctcagtcaggacacagcatggacatgagggtccctgctcagctcctgggactcctgctgctctggcctcccagactaccagatgtgacatccagatcgacccagtcctccatcctcccgtgtctgacatctgtagganacagagtcaccatcttcgttggtacgggcgtaggtgaggactattgtactaatttagttagtcctaggtactcagcgaagcgaacgagggagtacgttacctaaggccttaccgtgaacttctagtcgtctccggtccttccttaacgttttcggaccgtacgggttaccggtaacccggggggtttcccctaacgttttccccggtttaccgggtttacccgtaaagggggtttccgggaccggttaacggggttcgggttaaccgtttcggggtaacggggtaccgttaaacgggttacttttaccccggtaactttcccggtaaccgtaacccctaagttaccaacggtaccgtaaccgtccgtacgaacgtccgtaccgtaagtaaccgtagttacgtaccggaacttaaccgtttaattttacgtagtaaacgttaaaggtaacttaacgtacggtcgtccgtacccgttcttaccggttaaccggttccgggtacgggaaccgggtaacgttaacgggaggtacttaaggtaacccg

SEQ ID NO: 131681 - DNA, 517 bp, Homo sapiens
  misc_feature: GYAE6OF02GD8NV.36.7.A07.1.454.CMB.1.raw
  modified_base (194)..(194): a, c, t, g, unknown or other
  misc_feature (194)..(194): n is a, c, g, or t
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatgacccagtctccatcctccctgtctgcatctgtagganacagagtcaccatctcttgtcgggcagtgaggacattgtcaattatttagcctggtatcagcagagaccagggagagttcctaagctccgtgatctatgctgcctcctatttgctagtcagggtcccagtctcgttcagtggctagtggatcgtagggacagtctttacacttctacacctatacacgcacgtcctgccacgtcctagaagtattagttcgtactaactttattattagtaacgtaaagttactaactagtacgtcttaccgacgtaccttaccgttcggacggacggtaccgtaaggtggtactacgtaacg

SEQ ID NO: 131682 - DNA, 617 bp, Homo sapiens
  misc_feature: GYAE6OF02I7VIW.36.7.A07.1.454.CMB.1.raw
  modified_base (199)..(199): a, c, t, g, unknown or other
  misc_feature (199)..(199): n is a, c, g, or t
tcagtacgctgtctcacgaccggtgctcgatttagcacgtgtcgcagggggcagaagtctctctcagtcaggacacagcatggacatgagggtccctgctcagctcctgggactcctgctgctctggcctcccagactaccagatgtgacatccagatcgacccagtctccatccctcctgtctgcatcgtagtagganacagagtccaccatcctcttggtcgggcaggttgaggactagttgtactaatttagtttacgccttaggtattccgaagcaaggacgaaccgagggtagtacgttacctaagcctcctagtactctatcgacttgtccctacttagtttcgcgtagtacgacgggtcccattcgtcggttacgagtcggactgtacgacttcggaggtacctagttaacttccaccgttctaccgacctatccgagcgtacgtcccgtagcctacgtccgtaagtacggtagttcgttacgactttaacgttttaacttagttacgtaaacgtaaaacgtaacgtacctaggtccgtaccttaccgtacgttaccgtacggtttacggaccgggaaccggtaacgttaggtagtacgtagtaaaccgg

SEQ ID NO: 131683 - DNA, 550 bp, Homo sapiens
  misc_feature: GYAE6OF02IICBX.36.7.A07.1.454.CMB.1.raw
  modified_base (210)..(210): a, c, t, g, unknown or other
  misc_feature (210)..(210): n is a, c, g, or t
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcaccatctnttgtcgggcgagtgaggactattgtacaatttatttagccttggtatcagcagagaccgagggagtagttacctaagctcctgtatctatgctgcctctatttcgctagtcgacgggtccattccgtcgttcgagtggcgtagtggtatcgtgggactagtactttcgacttctacacctatcgagcacgccgtacgctacgaccgtagaacgtacttgttacgacttaactttattacgttagtaactaaagttactaagtacgtcgtcgtccgtccttaccgtaccgtttacggacgggtacggtaaccggtaacgggtaggtacgttaagtaaccgg

SEQ ID NO: 131684 - DNA, 609 bp, Homo sapiens
  misc_feature: GYAE6OF02FZCIO.36.7.A07.1.454.CMB.1.raw
tcagtacgctgtctcacgaccggtgctcgatttagcacgtgtcgcaggggacccaaaaaccacacccctccttgggagaatcccctagatcacagctcctcaccatggactggacctggagcatcctttttcttggtggcagcagcaacaggtgcccactcccaggttcaattggtgcagtctggagctgaactgaagaagcctggggccttagtaaacttctcctgcaaggcttctggttactcctttcttacgtatggcatcagctgggtgcgacaggcccctggacaagggctcgagtggatggggtggatcgaggcctaacgaagtcggttaacaacaaactatcgacacggaagttgcaggacagaatgaccatgaccacagacacgtaccaacgagaccacgacgacgtaacagtagggaacgtggaggacgtccgtagacggaccgtagaccgacgaccggaccattaagtacttacgttggtcgacggaagaaacgtaaccgggacgttaccgttagtcggttagtaaggttttaaggttttagggggtaatttacggtagttaggttactttccgttttaggattacgttacgtacgggg

SEQ ID NO: 131685 - DNA, 531 bp, Homo sapiens
  misc_feature: GYAE6OF02F8TT2.36.7.A07.1.454.CMB.1.raw
  modified_base (343)..(343): a, c, t, g, unknown or other
  misc_feature (343)..(343): n is a, c, g, or t
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatgacccagtctccatccctccctgtctgcatctgtaggagacagagtccaccatctcttggtcgggcgagtgaggacattgtcaattatttagcctggtatcagcagagaccagggagagttcctaagctcctgtatctatgctcgcctcctatttgctagtcaggggtcccatcgtcgttcaggtgngagtggactcgtagggacaggtatttcacgttctaccaccatccagcacgcctcgcgacgccgtagaacgtagtgtttacgacttaaactttatttattacgtaactaaaagttataactagtcgtcctcctacctaccgtacgtttcggacggtacgggaaccgtagggtaggtactagtaaaccgg

SEQ ID NO: 131686 - DNA, 651 bp, Homo sapiens
  misc_feature: GYAE6OF02ICRML.36.7.A07.1.454.CMB.1.raw
  modified_base (193)..(193): a, c, t, g, unknown or other
  misc_feature (193)..(193): n is a, c, g, or t
  modified_base (361)..(361): a, c, t, g, unknown or other
  misc_feature (361)..(361): n is a, c, g, or t
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatgacccagtctccatcctcctgtctgcatctgtagganacagagtcaccatctcgttggcgggcgagtgaggactattgtactaatttatttaggtccgtggtactcgagcagaggaccgaagggtagtacgtccgtaagtcctctgtatctatcgtctcgtcctcttatttcgctagtccgacgggtccctatccgttcggttcnggtcggcgtaggtcgtagtccggtagggtactaggttactttactacgttcctccacctactacgacgcgtacgtccgtcgaccgtacgtccgtagtaacgtacgtttcgttaacgtaacgtttaaacgttttaagtttaacgtttaacgttaaacgttaaaacggttattaaaccgttacggtcgtaccccgttacccttaccggttaccgtttaacccggttttccggggacccgggttaacggggtaaacccggtaagggttaacggttaccgttaacgttaaccgg

SEQ ID NO: 131687 - DNA, 593 bp, Homo sapiens
  misc_feature: GYAE6OF02JHUIZ.36.7.A07.1.454.CMB.1.raw
  modified_base (312)..(312): a, c, t, g, unknown or other
  misc_feature (312)..(312): n is a, c, g, or t
  modified_base (359)..(359): a, c, t, g, unknown or other
  misc_feature (359)..(359): n is a, c, g, or t
  modified_base (403)..(403): a, c, t, g, unknown or other
  misc_feature (403)..(403): n is a, c, g, or t
  modified_base (421)..(421): a, c, t, g, unknown or other
  misc_feature (421)..(421): n is a, c, g, or t
tcagtacgctgtctcacgaccggtgctcgatttagcacgtgtcgcaggggacccaaaaaccacacccctccttgggagaatcccctagatcacagctcctcaccatggactggacctggagcattcctttttcttggtggcagcagcaacaggtgcccactcccaggttcaattggtgcagtctggagctgaactgaagaagccgtggggccttaagtaaacttctccgtgacaaggtcttcgtggttacttcctttcttacgtatggctatcagcgtgggtgcgacgacggcccctggacgagggctcggngtggagtgggtgatcgaggacctaacgagttggtaacaactaacgtntggacaggtaatcgacgaggacagaatcgaacagtacgaaccanacgtaccacgtacacgancgagacggtacgtacagtaggaacgtgacggacgtcgtagaccgacgtgaaccgacgccgactatactatctgcgacgaagaaacgtacggattcgtagttagttaggtagtttacggttagggtattagagttcgttacttttccgttagtacgttagtcggttaaccggg

SEQ ID NO: 131688 - DNA, 608 bp, Homo sapiens
  misc_feature: GYAE6OF02JD7LB.36.7.A07.1.454.CMB.1.raw
  modified_base (150)..(150): a, c, t, g, unknown or other
  misc_feature (150)..(150): n is a, c, g, or t
  modified_base (163)..(163): a, c, t, g, unknown or other
  misc_feature (163)..(163): n is a, c, g, or t
  modified_base (195)..(195): a, c, t, g, unknown or other
  misc_feature (195)..(195): n is a, c, g, or t
  modified_base (436)..(436): a, c, t, g, unknown or other
  misc_feature (436)..(436): n is a, c, g, or t
tcagtacgctgtctcacgaccggtgctcgatttagcacgtgtcgcagggggcagaagtctctctcagtcaggacacagcatggacatgagggtcccctgctcagctcctgggactcctgctgctctggctcccagataccagatgtgacntccagatgacccngtctccatcctccctgtctgcatctgtagganacagagtccaccatctcgttggtcgggcgtagtgaggactattgtctaattattagccgtaggtatacagcagagaccgagggagacgttccgtaagccgtcgtagtatactatcgctacgccttacctatttcgactacgtaccggtacgggtccctagtccgttacggttccgaggtcggcgtagtggtagtacgtcggtacagttactttctacctctacgacctacgtacacgtacncgtcctgcacgtcgttagaacgtgttacgttacgtacgttaactttacgtttagttataaacgttaaaagtacttaacgtaggttacctaccgttccgtaccgttacgttaccggtttaccgggacgggtaaccggtaacggtaacgggtaggtaacgtaccgttaaaccgg

SEQ ID NO: 131689 - DNA, 578 bp, Homo sapiens
  misc_feature: GYAE6OF02HDUY6.36.7.A07.1.454.CMB.1.raw
  modified_base (351)..(351): a, c, t, g, unknown or other
  misc_feature (351)..(351): n is a, c, g, or t
  modified_base (484)..(484): a, c, t, g, unknown or other
  misc_feature (484)..(484): n is a, c, g, or t
tcagtacgctgtctcacgaccggtgctcgatttagcacgtgtcgcaggggacccaaaaaccacacccctccttgggagaatcccctagatcacagctcctcaccatggactggacctggagcatcctttttcttggtggcagcagcaacaggtgcccactcccaggttcaattggtgcagtctggagctgaactgaagagccgtggggccttagtaaacgtctcctgcaaggcttctggttactcctttcttacgtatggacatcagctgggtgcgacgacggcccctggacaaggggctcggagtggagtggggtgatcgaggcctaaacgagtcggttaacacaaatangacgaacggtaagttgacaggacagaatcgaccatcgaaccaacagaaccacgtaccacgagacacacggacgtactagtaggaactggagacgcgtagacgacctgaacgacgacggacaatatacttacgngtacgacgtacgaacgtaaccgggacgtacgtagtagttagtaagtttaggtttaggggtacttgagtgtacgttcttagtattgtaggtcggg

SEQ ID NO: 131690 - DNA, 579 bp, Homo sapiens
  misc_feature: GYAE6OF02JD204.36.7.A07.1.454.CMB.1.raw
  modified_base (195)..(195): a, c, t, g, unknown or other
  misc_feature (195)..(195): n is a, c, g, or t
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatgacccagtctccatccctccctgtctgcatctgtagganacagacgtccaaccatccttcgttggcgggcagtggaggacattgtactaatttacttacgcctggtatcagcagacgaccgagggagtacgttcctaagctccgtagtactctatcgctcgccttcctatttcgctagtcgtacgggtcccagttccgtcggttacaggtggcgtaggtggtacttacggtacgggactagtactttccacgttctaccactatctacgctacgtcctgaccgacgtcctagaacgttattcgttacgaaccttaatttagtttaacttacgtaaactaaagttactacgtacgttcgtaccttccgtacgttccttaccggttcgggacggtacggtaccgtaggtacgtacttagtaaccg

SEQ ID NO: 131691 - DNA, 660 bp, Homo sapiens
  misc_feature: GYAE6OF02F13DO.36.7.A07.1.454.CMB.1.raw
  modified_base (194)..(194): a, c, t, g, unknown or other
  misc_feature (194)..(194): n is a, c, g, or t
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatgacccagtctccatcctccctgtctgcatctgtagganacagagtccaccattctcgtttggccgggacgagtgaggtactagttgtctaattattttagcctggtatcagctagaagaccgtagggagtacgttccgtaagctccgtagaactcttatggtcctcgtaccgttaccttacgttttcgaccgtagttccgtaaccggggttccctaagttccgtccggttacgtaacggtcgggtacgtggtaggtacgttacggtagggactaggtacctttacgtactccgttaccactagtaccgtagcctaacggcttacggcgtacggtccgtagaaacgtagttacggttacgttaaccgttaaccgtttaatttaacttacggaaaccttaaaagggtaactttaacgacgttaccgtcgttaacccggtcttaccgttaccggtttacggtacccgggtaggtaaaccggtaaggtcgtaacgtagttaaacccgg

SEQ ID NO: 131692 - DNA, 638 bp, Homo sapiens
  misc_feature: GYAE6OF02IFB63.36.7.A07.1.454.CMB.1.raw
  modified_base (148)..(148): a, c, t, g, unknown or other
  misc_feature (148)..(148): n is a, c, g, or t
  modified_base (219)..(219): a, c, t, g, unknown or other
  misc_feature (219)..(219): n is a, c, g, or t
tcagtacgctgtctcacgaccggtgctcgatttagcacgtgtcgcagggggcagaagtctctctcagtcaggacacagcatggacatgagggtccctgctcagctcctgggacctcctgctgctctggctcccagataccagatggtnacatccagatcgaccccagtcctccattccctcccgtgtctgacctatctggtaggagacaggatccaacnttcttcgttggcgggacgtagtcgaggtactagttgtactaatttacgttacgccgttggtaactcgacgacgacgaacgaccgaaggacgtacgttactaacgtctacctagtatctagtcgtcttccgccttacctagtttcacgtacgtacggtacgggtccctagtccgttcggtctaggtcgtcgtaacggtgtacgtcgtcgggaactacggttatttcctacttcctacttacccagttacgacgtcaaccgtccgcgtacgacgtccgtaaggacgtagttcgtacgtacttaactttattactaagtaactaaaagtataaccgtgttaccggtaccgtccgttctaaacggttcccggtttacgggacgggtaacggtaaccgttaagggactaacgtaccgtaaacgg

SEQ ID NO: 131693 - DNA, 690 bp, Homo sapiens
  misc_feature: GYAE6OF02GX4F1.36.7.A07.1.454.CMB.1.raw
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatgacccagtcctccatccctccctgtctgcatctgtaggagacagagtccaccatctcgttggtcgggcgagtgaggactagttgtactaatttatttacgccgttggtatcagcagagaccgagggagtaggttacctaaggtccttcctagtatctagtcgctcgtccttccttagttttcgactacggttccggaccgggttccctacgttccgttacggttcgtaggtcggtacgacggttggtacgtcggtacgggtactagttactttccacttacctacctacctacgtacgacgaccgacgtcctacgaccgtacggtcctaaggtaacgttacgttacggttaccgtaacctttaacgttttaatttaacgtttaaacgtaaacgttaaaaacgttacttaaacgtacggttaccgtacccttaccggttacccgttaaccgttaaccggttttacccggggaaccgggttaaccgggtaacccggtaaaggggtttacggtaacgttaaccggttaaaaccccgg

SEQ ID NO: 131694 - DNA, 694 bp, Homo sapiens
  misc_feature: GYAE6OF02HT8W7.36.7.A07.1.454.CMB.1.raw
  modified_base (85)..(85): a, c, t, g, unknown or other
  misc_feature (85)..(85): n is a, c, g, or t
tcagtacgctgtctcacgaccggtgctcgatttagcacgtgtcgcagggggcagaagtctctctcagtcaggacacagcatgganatgagggtccctgctcagctcctgggactcctgctgctctggctccagataccagatgtgacatccagatcgacccagtctcatcctccctgtctgcatcgtagtaggacgaacagacgtccacctactcttcgttacggcgggacgagttggaggtactgttagtctaatttactttagccgttaggtactcgagtacgtaagacgaaccgaaggggtacgtacggtttacctaaacgtccgttaccgttagtacttacttagtacgtcgttacgtacccctttacttagttttcgaccgtacgtacggtacggggtaccctacggttccgttcgttaccgtaggtcggtacgtaggttacgtacgttcggtcgggtaacgtaacgttacttttaccggacttacccttaaccgaccctaagtcgaacgtacgaacgtccgtcgacgaccggtaccgttagtaacgtagttcgttacctacgtaacttttagttagttaacgttaaacgtaaacgttaagtaacgtaggtccgtcttaccgttccgtacgttaccggttacgggaacgggtaacggtaccggttaaaggtacgtacgtaataaaccgg

SEQ ID NO: 131695 - DNA, 678 bp, Homo sapiens
  misc_feature: GYAE6OF02FQGR6.36.7.A07.1.454.CMB.1.raw
  modified_base (324)..(324): a, c, t, g, unknown or other
  misc_feature (324)..(324): n is a, c, g, or t
tcagtacgctgtctcacgaccggtgctcgatttagcacgtgtcgcaggggacccaaaaaaccacacccctccttgggagaatcccctagatcacagctcctcaccatggactggacctggagcatcctttttcttggtggcagcagcaacaggtgcccactcccaggttcaattggtgcagtctggagctgaactgaagagcctgggcttagtaacgtctcctgcaaggcttctggttactcctttctacgtatggcatcagctgggtgcgacaggcccctggaccaagggctcggagtggagtggggtgatcgaggcctaaanaagtggttaacaacaaactatcgcaacgggagttgcgaggacaagtaatcgaccagtacgaaccacacgaccaccggtaccaacgagaccaacgacggtaccgtaactaagtacgggaaacgtagggaacggtaacgtcccgttaggaaacgtacccgttaccggaaccgaaccggtaccggaccctaaacgtaacgttaccgtttacgtaggttcgaaccggaacgtaaacggtaaacccgggttaacgttcccggttaagttaggttacgttaagttttaacgggtttagggggtaacttttacggagtttaggttccgtttacgttttagactttacgtcggttaacgggg

SEQ ID NO: 131696 - DNA, 660 bp, Homo sapiens
  misc_feature: GYAE6OF02GZ6WV.36.7.A07.1.454.CMB.1.raw
  modified_base (121)..(121): a, c, t, g, unknown or other
  misc_feature (121)..(121): n is a, c, g, or t
  modified_base (249)..(249): a, c, t, g, unknown or other
  misc_feature (249)..(249): n is a, c, g, or t
  modified_base (542)..(542): a, c, t, g, unknown or other
  misc_feature (542)..(542): n is a, c, g, or t
tcagtacgctgtctcacgaccggtgctcgatttagcacgtgtcgcagggggacccaaaaaccacacccctccttgggagaatcccctagatcacagctcctcaccatggctggacctggancatccttttctggtgcagcagcaacaggtgcccactcccaggttcaattggtgcagtctggagctagaactgaagacgcctggggccttagaaacgtctcctgcaaggtcttctcggttactcctttntacgttatgctatcagtcgtgggtgcgtacgaccggccctggaccgaagggcttcggaggtagggagttgggggtaggagtcggacggtaccgtaaacgtagttcgggttaacaacgtaaaacttgtacgaccgtaacgggtacgttagaccggaagtaccgtaagtaacgttacggaaccctagtaccgaacccgactacggaacctccgaccacggtacgaccgtacaacggacgtaacagttacggaactgggacgtacgactggacgacgtgaacgtacgacggctaanattagtacgtggtacgacgtaaagtacgtaacggtctacgtgttcgtaggtaagttttacggttagggtacttagtacgttaggttacctttagtttacgagttagtacggtaccggg

SEQ ID NO: 131697 - DNA, 857 bp, Homo sapiens
  misc_feature: GYAE6OF02HYKLG.36.7.A07.1.454.CMB.1.raw
  modified_base (159)..(159): a, c, t, g, unknown or other
  misc_feature (159)..(159): n is a, c, g, or t
  modified_base (221)..(221): a, c, t, g, unknown or other
  misc_feature (221)..(221): n is a, c, g, or t
tcagtacgctgtctcacgaccggtgctcgatttagcacgtgtcgcagggggcagaagtctctctcagtcaggacacagcatggacatgagggtccctgctcagctcctgggactcctgctgctctggcctcccagactaccagatgtgacatccgaagntcgacccagtcctccactcctccctgtctgcatcgtgtacggagaccgaggtactccaactnttccgttcgttacgggcgggccggtaagttacggacggtaacttagttacgtaacgtaaattttagttacgccgttagggtactacgacgtcaaggtaaccgacgaacgggtagtacgttacctaacgccttaccgtagtactctaacggtcgtaccgtacgtccttacgttattttcggaaccgtacggttaccggtaccggggtttaccctagtttacccggttttaccggtacgtaacggggtttccgggtacgttaacggggttacgggttaccgtttaccgggtaacggggtaaccctaagggtttaccttacccggtaacctttcccgtaaaccgtaacccttacggtaaccgaccgggttaaccctaacgggttcccgttcgtaaccggtaccgtcccgggttaaagtaccggttaaacgtttcggtttaaccgtaacgtttaaaccgttttaacgtttaaacggttaaccggttaaaacgtaaacggtttaaccctaacggttacgttacccggttcgtaacccccgtttaaggtttaaccccggttaacgggtttacggggtaaacccggggttaacgggttaaaccgttaggggtttaaacgtacggttaaacccttaacccgggg

SEQ ID NO: 131698 - DNA, 755 bp, Homo sapiens
  misc_feature: GYAE6OF02FK2BD.36.7.A07.1.454.CMB.1.raw
tcagtacgctgtctcacgaccggtgctcgatttagcacgtgtcgcaggggacccaaaaaaccacacccctccttgggagaatcccctagatcacagctcctcaccatggactggacctggagcatcctttttcttggtggcagcagcaataggtgcccactcccaggttcaattggtgcagtctggagctgaactgaagaagccgtggggccttagtaaacgtctcctgcaaggcttctggttactcctttcttacgtatggcatcagctgggtgcgacaggccctggacaagggctcgaggtggagtgggggtgagtacgaggacctaaacgaagttgggttaacactaaaacttatagaccgtaacgggtaaagttgacgtaagggaacgaagaactagaaccaagtacgacctaacgaacgaaccgtaaccgtacccgaacggtaacggacgaaccgaacggtaccgtaacgaacggtacgggaaaccgttagggaacgggtacggaccgtaacggaacggtaacccgtagggaacccgaaccggtaaccgggaccctaaagttaagtttaacgttaaccgttagggtaccgacggtaaaacgaaacggtaaacccggggtaacgtttaccggttaacgttggtttaacggttaaacgttttaagggtttttacggggggttaactttacgggtaacgttaggttacccttttaccggttttacggtaacgttacggttaccggtacggggg

SEQ ID NO: 131699 - DNA, 710 bp, Homo sapiens
  misc_feature: GYAE6OF02IRCNV.36.7.A07.1.454.CMB.1.raw
tcagtacgctgtctcacgaccggtgctcgatttagcacgtgtcgcagggggcagaagtctctctcagtcaggacacagcatggacatgagggtccctgctcagcctccgtgggactcctgctgctctggcctcccagataccagatgtgacatccagatgacccagtctccatccctccctgtctgcatcgtgtaggagacagacgtacaccatctcttggtacgggcgagtgaggactattgtactaatttattacgtccgtaggtatcagtcaagacggaccgaggggtagtacggttacctaacgcttaccgtcgactacgtatcgtactcgtcctaccttacgttttcgacgtagtccggtaacggggtcccttacgtaccgttccggtttacgtaggttacgggtacgtagggtttaccgggtacgtttcgggtaacggtacgtaaacggttactttaccctaccgttacctaaccaaccgtaacgtaccaagaccgtaccgacccgtagtacgtaaccgtccgaaaggtaacgtacgttcgttacgtaacttaactttaagttttaacgtacgttaaaaccgttaaagtaaaccttaagtaaccggttccgtaccggttaccttaccgttacccgttaccgggtttaacgggacccgggttaaacggtaccgggtaaggtacggtaacgttaacggtaaaccgg

SEQ ID NO: 131700 - DNA, 556 bp, Homo sapiens
  misc_feature: GYAE6OF02FNMGS.36.7.A07.1.454.CMB.1.raw
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtccaccatctcttggtcgggcagtgaggacattgtactaatttattttagccttaggtatcagtcagaacgaccgagggagtagttcctaagcctcctgatctatgctcgcctcctatttcgctagtcgacgggtccctattccgtcggttcagtggctaggtggatcgtagggacagtctttcacttcctacaccactccgagcacgcctcgactacgcctagagtattgtacgactaagttttattaagttactaacgtaaagttactacgtaggttacgtaccgtaccgtccgttacgtaccggtttacgggacggtaacggtaaccgtaagggtagtaactacggtaaaccg

SEQ ID NO: 131701 - DNA, 787 bp, Homo sapiens
  misc_feature: GYAE6OF02F6IJD.36.7.A07.1.454.CMB.1.raw
  modified_base (194)..(194): a, c, t, g, unknown or other
  misc_feature (194)..(194): n is a, c, g, or t
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatgacccagtctccatccctcctgtctgcatctgtagganacagacgtacacctattctcgttggcgggctagtgaggactagttgtactaattagtttacgccgttaggttatacgacgacgtaagaacggaccggtaaggggtacgtaacggttaccgtaacggtccgttaccgtagtaacttactacgtacgtccgttcgtcccttaccgttacgttttaccggaccgttacggtaccggtaacgggggttcccctacgtttccggttacggttacgtacgggttcgggacgttacgggtacgggtacgttaccgggttaacgggtaactacggtttacgtttaccgtaaccgttaccggttaaccctaaccgtaacgtaccgtaaccggtaccgtaccgtacccggtacgtaccgtaccggtaccgttaaggaacggttacggtttacggttaacgtaacccttttaagtttaacgttttaacgttaaacgttaaacgttaaaacggttacgttaacgttacggttaccggtccgttaccgttaccgttaaccggtttaccgggtttacgggaaccggggttaacgggtaaccggttaaggggttacgtaacgttaaccgtaaaccggg

SEQ ID NO: 131702 - DNA, 749 bp, Homo sapiens
  misc_feature: GYAE6OF02HULSO.36.7.A07.1.454.CMB.1.raw
  modified_base (218)..(218): a, c, t, g, unknown or other
  misc_feature (218)..(218): n is a, c, g, or t
  modified_base (239)..(239): a, c, t, g, unknown or other
  misc_feature (239)..(239): n is a, c, g, or t
tcagtacgctgtctcacgaccggtgctcgatttagcacgtgtcgcaggggacccaaaaaccacacccctccttgggagaatcccctagatcacagctcctcaccatggactggacctggagcattccttttcttggtggcggcagcaacaggtgccccacctccctaggttccaccgttggtgcagtctggagctggaggtgaagagcctggggcctnagtgaggtctcctgacgagtnttctggttactattctttaggaggtatgacaatacctaccggtgggtggccgtacgacggccccgtacggacgaacggggtcttagcgttgggaagtggatggatacagccgtacttagaataggtaacaacgtaaattagtacgaacgtaagtaacgttacgacggacagacgtacacatacgaaccaacaaacaacgacgtacacacgacaacactaccaacacgttaggacgtacgtacggacgtacgaccgtaggtactacggtacttacgggaaacccgtacgggtacccggtaccgttagtttaaccgttttgggttacggttacgggggtacgggggtttaacggggggggttaggtttacggggttcggggtccgggttaaaccgtaccggttaaccggtaaccggttacccggtaggttaaccccgggtttaacccgggtaaacccggtttaccccgggtttacccggttaccccggggtaccggggtaaacccccggggg

SEQ ID NO: 131703 - DNA, 773 bp, Homo sapiens
  misc_feature: GYAE6OF02GTX8Y.36.7.A07.1.454.CMB.1.raw
tcagtacgctgtctcacgaccggtgctcgatttagcacgtgtcgcagggggcagaagtctctctcagtcaggacacagcatggacatgaggtccctgctcagctcctgggactcctgctgctctggcctcccagataccagatgtgacatccagatcgacccagtctccattcctccctgtctgctatctgtaggataccagacgtacaccatctcttggtccgggactagtgaggactattcgtactaattactttagccttggtactcagtacaggtaacgaccggagggtacgtacgttaccgtaaggtcctccgttagtacttacttaatcggtacttcgtccgttaccttagttttacggctaacggttccgtaccggggttacccctctttacccggtcggtttaccgacgggtgggtaaccgtgggtttacggtaacgtttcgggaacgggtaaaccgtaacgggtttaccttttaccaaaccgtttcccgaacccgtaccgttaacaccggtacgtcccgtaaaccggtccttacggacctaccgtggttaaccgagttaacgtttacggttacttaaccgttttaacgttaactttttacggttaaaggttaaacctaaacggtttaacgttaacgttcggttacccgttaccgtttacccggtttaacgttaccccgttaacggggttttccccggggaaacgggttaccgggggtaaacccttaagggggttaaaccgttaaccgttaaggtttaaaccccg

SEQ ID NO: 131704 - DNA, 860 bp, Homo sapiens
  misc_feature: GYAE6OF02FZ1SN.36.7.A07.1.454.CMB.1.raw
tcagtacgctgtctcacgaccggtgctcgatttagcacgtgtcgcagggggcagaagtctctctcagtcaggacacagcatggacatgagggtccctgctcagctcctgggactcctgctgctctgactcccagataccagatgtgacactccagatcgacccagtcctccattcctccctgtctgcatctaggtagacacgagacgtccaccattcttcgttggccggggacaggtggacggtacattcgtacttaatttacgtttacgccgttaggtatacgtagacaggacgaccggaggggacgttacgttaccgtaacgtccttacgtagtacttacgttaacgtcgttaccttcggtcccttaccgtttagttttacggaccgtacgggttacccggtaacccggggttcccttaacggtttcccggttaccgggtttaacgtaggggttaccgggtaccgtaaagggttcgggttaaccgtccgggttaacgggtaaccgtttaacgttaactttccccggtaacttcccgtacccgtaaaccgtatacccgacggttacccgtaacggtccgtacccggtaaccgtacccggtttaaccggtaagggtaaaccgtttacgggtttacggttaaccttaaaccgttttaaaaccgttttaaacgttttaacggttaaaacccggttaaaagttaaaaaccggttaacgtaaccggttaacggttcccggttaaccccgttacccgttaccggtttaacccggttacccgggggtttaacccggggaaccgggttaaacgggtaaaccccgggtaaggggtaaacccggtttaaactaccggttaaaacccggg

SEQ ID NO: 131705 - DNA, 743 bp, Homo sapiens
  misc_feature: GYAE6OF02IYWKD.36.7.A07.1.454.CMB.1.raw
tcagtacgctgtctcacgaccggtgctcgatttagcacgtgtcgcagggggcagaagtctctctcagtcaggacacagcatggacatgagggtccctgctcagctcctgggactcctgctgctcgtggctcccagataccagatgtgacatccagatcgacccagtctccatccctcctgtctgcatcgtgtagagacagacgtccacctatccttcgttggtccgggagaggtcgaggtactagtttgtacttaatttacttacgtccgttaggtatacgtacgcgaaggacggaccggagggtaacgtacgttaccacgtcctacgtgtacgttctacgtcgtctccgtcctacgttagttttcgcgtaacgtccggttaccggggtcccttacggttccgttcgggttacgtacggttcgacgtagggttacgacgttcgggtaggtaagtacggttacgtttaccaccgttaccgtacgtaaccctacggtaccgacgttaccgtacggtccctacgtaccgaccggttcctaaggttacgtacggtttcgtaaccgttaacgttaacgtttttaagtttaacgtttaaaccgttaaacggtaaaacttttaacggacgttaccgttacccggtaaccgtttccggtaaccgtttacccggttaacgggttaccgggggtaacggtaaccgggtaacggttaacgggtaaccgggtttacctaacggtttaaaccccgg

SEQ ID NO: 131706 - DNA, 634 bp, Homo sapiens
  misc_feature: GYAE6OF02JX70W.36.7.A07.1.454.CMB.1.raw
  modified_base (365)..(365): a, c, t, g, unknown or other
  misc_feature (365)..(365): n is a, c, g, or t
  modified_base (440)..(440): a, c, t, g, unknown or other
  misc_feature (440)..(440): n is a, c, g, or t
  modified_base (496)..(496): a, c, t, g, unknown or other
  misc_feature (496)..(496): n is a, c, g, or t
  modified_base (541)..(541): a, c, t, g, unknown or other
  misc_feature (541)..(541): n is a, c, g, or t
  modified_base (567)..(567): a, c, t, g, unknown or other
  misc_feature (567)..(567): n is a, c, g, or t
tcagtacgctgtctcacgaccggtgctcgatttagcacgtgtcgcagggggcagaagtctctctcagtcaggacacagcatggacatgaggtccctgctcagctcctgggactcctgctgctctggctcccagataccagatgtgacatccagatcgacccagctccgactcctccctgtctgcatcgtgtacggagacgtagagtccacctatctcttcggtcgggcagtcgaggtacatttcggactaatttacttagccttgtactacagtcgagtaagaccgtaggacgtacgttacctaagccttcgtgactctagtcgctcgtaccttctatttgcgtacggtccgtacgggtaccctnttctcggttacaggtcggtacgtaggtttggacgtttcggtacgggactagggtctttcacgtacttcgacctancgtacgtactacggacctcgtaccacggttacgtacgtaaacgttacgttccggtntaacgttaactttaagtttcgttactaaaacggttaaaccttaanaacgttcgttacggtaccttaccggnttaacccgttcgttaaccggggacgggtaaacggtacttacggggtaggtaccctttaagtaaccgg

SEQ ID NO: 131707 - DNA, 704 bp, Homo sapiens
  misc_feature: GYAE6OF02JUJUE.36.7.A07.1.454.CMB.1.raw
  modified_base (97)..(97): a, c, t, g, unknown or other
  misc_feature (97)..(97): n is a, c, g, or t
  modified_base (148)..(148): a, c, t, g, unknown or other
  misc_feature (148)..(148): n is a, c, g, or t
  modified_base (177)..(177): a, c, t, g, unknown or other
  misc_feature (177)..(177): n is a, c, g, or t
  modified_base (196)..(196): a, c, t, g, unknown or other
  misc_feature (196)..(196): n is a, c, g, or t
  modified_base (213)..(213): a, c, t, g, unknown or other
  misc_feature (213)..(213): n is a, c, g, or t
  modified_base (279)..(279): a, c, t, g, unknown or other
  misc_feature (279)..(279): n is a, c, g, or t
  modified_base (311)..(311): a, c, t, g, unknown or other
  misc_feature (311)..(311): n is a, c, g, or t
tcagtacgctgtctcacgaccggtgctcgatttagcacgtgtcgcagggggcagaagtctctctcagtcaggacacagcatggacatgagggtcccngctcagctcctgggactcctgctgctctggcctcccagactaccagagtgngacacgtccagatcgacccagtcctactntccctccgtgtcctagctntcgtgtagagtcaagcncaacctgtctcgtagtccggatacggtgacggactagtcgtaatactttattaacgcgttagtatnacgcagataccggaggtagtacgttcagtacncgtagtacttctagtcgtctacgtacttcggttaacttcggtacgtacgttcggttaccgggtacctagttccgttaccggttgtaacgtcggaccggttagtcggttaacgtcggttacggacgttaagttaccgttaactctaacccttacgtaactaccgtactacgaccgtacgtaccgtccgtacgtaccgtaccgttaggtaccgtaacgttcgggtttaacccaattttaaccgtttaacgttaacgtttaaccgtaaattaacgtttaacgtacccgttacggtaccccttaccgggtacccgtttacgtaaccgggtttaccgggtaaccggttaaacgggacgtaaccgggtaggtaacgttaacccggtaaacgttaaccgg

SEQ ID NO: 131708 - DNA, 667 bp, Homo sapiens
  misc_feature: GYAE6OF02JNH5C.36.7.A07.1.454.CMB.1.raw
  modified_base (210)..(210): a, c, t, g, unknown or other
  misc_feature (210)..(210): n is a, c, g, or t
  modified_base (225)..(225): a, c, t, g, unknown or other
  misc_feature (225)..(225): n is a, c, g, or t
  modified_base (289)..(289): a, c, t, g, unknown or other
  misc_feature (289)..(289): n is a, c, g, or t
  modified_base (337)..(337): a, c, t, g, unknown or other
  misc_feature (337)..(337): n is a, c, g, or t
  modified_base (510)..(510): a, c, t, g, unknown or other
  misc_feature (510)..(510): n is a, c, g, or t
  modified_base (522)..(522): a, c, t, g, unknown or other
  misc_feature (522)..(522): n is a, c, g, or t
tcagtacgctgtctcacgaccggtgctcgatttagcacgtgtcgcaggggggcagaagtctctctcagtcaggacacagcatggacatgagggtccctgctcagcctcctgggactcctgctgctctggcctcccagactaccagatgtacgacactccagactcgaccctagtctccacgtccctccctgtctagccatcgtgtagganactagacgtcaaccntcgtcgttcggacgggcaggtcgaggtactattcgactaagttacttacggccgttaggttacncgagccgtaagacggaccgtagggtactacgttcctaaggctaccgtntaacgtcgtatcgtactcgtccttacctgtttagccgtagttccggaacgggttcctcgtcgttaccgtagtacgtacggcgtagggtctaacgtccggtaggtacctagttcgttacgtactccgtactaacgtctacgactacgtcgtactcgtacactccgaagtacgtnttacgtaccgtntaaacgtttcgttacgttaacaacgttaaataaccggttacgacgttacgtacccggttaactccggttaacgttaccgggttaccggtacggggttaaaccccggtgttaaaccggggtacgtttaccgaaacccgttaaccgg

SEQ ID NO: 131709 - DNA, 784 bp, Homo sapiens
  misc_feature: GYAE6OF02HSJT2.36.7.A07.1.454.CMB.1.raw
  modified_base (198)..(198): a, c, t, g, unknown or other
  misc_feature (198)..(198): n is a, c, g, or t
tcagtacgctgtctcacgaccggtgctcgatttagcacgtgtcgcagggggcagaagtctctctcagtcaggacacagcatggacatgagggtccctgctcagctcctgggactcctgctgctctggcctcccagataccagatgtgacatccagatgacccagtcctccactccctccctgtctgcatcgtgtaggnacagacgtcacctatctcttggtcgggcgagtgaggactagttcgtactaagtttacttagcctaggtactaccgagtcaaggacgtaaccggagggtacgtacggttacctaaggcctcgtagtactcgtatcggctcgtccttacttagttttcgacgtacggttaccggaccgggtttaccctacgtttcggttacgggtttaccgaaggttcgggtacgtaacgggtttcgggtaaccgtttacgggtacgggtaaacgttacgggtttaacctttccctaaccgttcccttaaaccgtaccgtaacttaccgggactaaccgtccggtacccgtagacccgtacgttaccgtagggaaaccgtttaggttccgttaacgtaacccgtttaaacttttacgtttaaacgtttaaacgttaaaaccgtaaaaacgttaccgttaaccgtacgggttaccgtacccggtttccccggttaaaccgttaccccgggttacccgggtttacccggggtaaccggggttaaccgggtaaacccggtttaaggggtaacccggttacgttaaaccggttaaacccggg

SEQ ID NO: 131710 - DNA, 1041 bp, Homo sapiens
  misc_feature: GYAE6OF02HJXXK.36.7.A07.1.454.CMB.1.raw
tcagtacgctgtctcacgaccggtgctcgatttagcacgtgtcgcaggggacccaaaaaccacacccctccttgggagaatcccctagatcacagctcctcaccatggactggaccgtggagcattcctttttcgttggtggcagcagccaacgaggtcgaccccgacttaccccgaggtttacaagtttgggtcgacgtaagttccgtaggggaactccgttacggaaacgttaggaaaacggaacgggtcccgggttaggggggtaaccctttaaagggttaaaacccgttttccgttaccccgttagggaccgtaaacggggtcccttttacggttaacggggtttaacctaacgttttaccgggttttaaggggtaagggttaacgttacggactaaaacgttccgtaaccggggtttcgggggtaccgaaccggtaaccgggtacccgggtacccccggtttaacgggaaccggttaaacgggggttccgttttaggggaggggttacgggtagggttacggggtaaggttacggggtaaccttaccggaacggtccggtttaacctttaaacggtaacggttaacggtaaactaaacgttaaagttacggtaaccgaaagtaacggtaaccggttacgaacggggtaaccacggtaaccgttaaccaaacggtactaaccgtaaaccgaaactaacccggtaactacgtaaccgaaccggtacgaacccgtaacgaaccggtaaccgtacgttaacggtaccgggtacgtaaccgggtaggaacgggtccggttacggacgtacgttacgaccggtacgaccggaccggtaaccgggtacgtagtttaacgtagttacggggtaggggtacggggttaagggggttacttcggggttacggttaccgggtaccggttaacggtaccccgtagggtaccccgtttaacggttaaaccgtaaccgggttaaacggtttaccccggggttaaccccgggaacccgggggtacccggggtaacccccggtacccggggg

SEQ ID NO: 131711 - DNA, 748 bp, Homo sapiens
  misc_feature: GYAE6OF02FKZFI.36.7.A07.1.454.CMB.1.raw
tcagtacgctgtctcacgaccggtgctcgatttagcacgtgtcgcagggggcagaagtctctctcagtcaggacacagcatggacatgagggtccctgctcagctcctgggactcctgctgctctggcctcccagataccagatgtgacatccagatcgacccagtcctccatccctccctgtctgcatctgtaggagacagagtccaccatctcgttggtcggcgtaggtgagactattagtactaattatttagcctagtatcagctagacgacgaggacgtacgttaccaacgctccgtgactctatcgctacgtcctaccttagtttcgcgtacgttaccggtacgggtaccctacgttccgtacggttacgtaggtcgggacccgttaagggtacggtactacgggtacgggtaaaccgtaggtttaaccgtttacctaccgtaccttaacccgaacctaacgtcgtaaccgtcgaaccgttaccgtccggtaaccgacgtaacccggtaggaaacggtttacgttacggtttaaccgtaaccttttaaaaccgttttagtttaaactttaacggtttaaaaccgtaaagtttaaaccgttaacggttaacggtttaccggtaccccgtttaccgttaaccccgttacgttttaacccgggggttacgggttaacccggggaaacgggtttaacccgggtaaacggggtttaccggtaacgtttaaccggtaaaaccccgggg

SEQ ID NO: 131712 - DNA, 755 bp, Homo sapiens
  misc_feature: GYAE6OF02IA7K6.36.7.A07.1.454.CMB.1.raw
  modified_base (154)..(154): a, c, t, g, unknown or other
  misc_feature (154)..(154): n is a, c, g, or t
  modified_base (378)..(378): a, c, t, g, unknown or other
  misc_feature (378)..(378): n is a, c, g, or t
tcagtacgctgtctcacgaccggtgctcgatttagcacgtgtcgcagggggcagaagtctctctcagtcaggacacagcatggacatggaggggtcccctgctcagctccgtgggactcctgctgctctggcctacccgagactaccagatggngaccatccgagactaccgaacccctagtcctacctacttcccctcccgttgtctgactacgttcgtagggtaacggaggaaccagacgtccaacctacgttcgttcgttgggccgggacgtggaggtaggactagttacgtaacttaatttacgttacgtccgttagtagtcagacgagacggaacggagggagtacgtacctacgtacctcgtagtatacgtntcggtacctccgtaccctttaccgttacgttttcggaccgttaaccggtccggttaaccggggtacccttacggtttccggtttacggttaccggtaacggtcgggtacggaggtttacgggtctacggggtagtacgttagttacttccgaacttctaaccgtacgtacgacgtacgtacgacgtccggtacacgtaccgtaccgttaaggaagttacgttacggttaccttacgtttaaactttagtttaacgtaaaagttaaaccgttaaaacgtactaacggttccggtactacccgttcctaacgttaccggttaacgggtccggggtaacgggaccgggtaaacgtagggttaactaggtaacgtaaacgg

SEQ ID NO: 131713 - DNA, 737 bp, Homo sapiens
  misc_feature: GYAE6OF02GIYGB.36.7.A07.1.454.CMB.1.raw
  modified_base (145)..(145): a, c, t, g, unknown or other
  misc_feature (145)..(145): n is a, c, g, or t
  modified_base (662)..(662): a, c, t, g, unknown or other
  misc_feature (662)..(662): n is a, c, g, or t
tcagtacgctgtctcacgaccggtgctcgatttagcacgtgtcgcagggggcagaagtctctctcagtcaggacacagcatgacatgaggtccctgctcagctctggactcctgctgctctggcctccaagactaccgagatgtnactatccagtatgacccagtctccattccctccgtgtctacgctacttcgtagtaggacgacacgactacaaccattcctcttcgggtacggacgtagtaggacggtaactattggtacctaattacgtttacgcctaggtaatccgtaagacgtaacgtaacgaacccgtaggggacgtaaccgttaacccgtaagtccgttaccgtagtaactacgtacgtacgtacgtccgtaccgtacctagttttaccggactacggtcggtaccggggttaccctagttccttacgggtactaacgggtgtaccgttaggtagtacgttacgtaggtaaccgtagttaccgtttctaacgttcctacgtaccgtaagttaccgacgtacgtaccgtacccgtagacgaacggttcccaaggacttacgtcgttaacgtacctaagttttaacgttacgttagttaaaaccgttaaagtttaaacgaaccgtacgtaccggtttaacccgaccggttaaccncccggttttaaacgtaccggggtaacgtaacggggtaacccgtaaagggttttacggaaccgtttaagaacccgg

SEQ ID NO: 131714 - DNA, 653 bp, Homo sapiens
  misc_feature: GYAE6OF02IAVPY.36.7.A07.1.454.CMB.1.raw
  modified_base (344)..(344): a, c, t, g, unknown or other
  misc_feature (344)..(344): n is a, c, g, or t
  modified_base (430)..(430): a, c, t, g, unknown or other
  misc_feature (430)..(430): n is a, c, g, or t
tcagtacgctgtctcacgaccggtgctcgatttagcacgtgtcgcaggggacccaaaaaccacacccctccttgggagaatcccctagatcacagctcctcaccatggactggacctggagcatccttttcttggtggcagcagcaacaggtgcccactcccaggttcaattggtgcagtctggagctgaactgaagaagcctggggccttagaacgtctcctgcaaggcttctggttactcctttcttacgtatggctatcagcgtgggtgcgacgacggccctggacgaagggctcggaggtggagtggggtgatcgaggtcctaacaagttaggttaacanaaacttagagcgaacggtagttacgcgaaggacaagtaactgaacagtcgaaccacgacgacacgtaccagagactacgagtcganagtacgaacgtggaggacgtccgaggtaccgaacgtacggaacgacgacggactaacgttaatacttacgtggtacgtaacggtacgtaaacggtaaccgggtacttaccgttagttacggtttacggttaagtttttaacgggttttagggggtactttaacggtagttacggttacgtttaccgtttttaggtaacgtttacggttaccgggtaacggggg

SEQ ID NO: 131715 - DNA, 723 bp, Homo sapiens
  misc_feature: GYAE6OF02GMCH8.36.7.A07.1.454.CMB.1.raw
  modified_base (208)..(208): a, c, t, g, unknown or other
  misc_feature (208)..(208): n is a, c, g, or t
  modified_base (520)..(520): a, c, t, g, unknown or other
  misc_feature (520)..(520): n is a, c, g, or t
  modified_base (537)..(537): a, c, t, g, unknown or other
  misc_feature (537)..(537): n is a, c, g, or t
tcagtacgctgtctcacgaccggtgctcgatttagcacgtgtcgcagggggcagaagtctctctcagtcaggacacagcatggacatgagggtccctgctcagctcctgggactcctgctgctctggcctccagactaccagatgtgacatccagatcgaccctagtcctaccactccctccctgtctcgctactcgtaggtacgganacgagacgtaccacctatccttcgttcggtaccgggactaggtggaacggaccttagtttgtaaccttaaagttttacgttaacgccttagggtacttccgaggactaaggaacgaaccgggtaaggggtaacttaaccggttacctaaaggtccttaaccgtagtaacgttctaagtcgacgtccgtacccttattaacgtttcgacgtacgtaccggtaccgggtccctaagttccgtacgtttcgaaggtcggtacgtaggtaggtaccgtggtaaggtactagttacgttaccgacttccacgtaacnctcggactacgccgtcncggacaggtaccaggtatagttcggtaactaacgtttaactttaagttacttaaacggtaaaactaaacgttactaaccggtccgtacccgtacccgttaacgtaccggttaaccgggtaccgggaagggtaacccggttaacgggtaagggtaacgaaccggttaacccaaggttaaacccgggg

SEQ ID NO: 131716 - DNA, 900 bp, Homo sapiens
  misc_feature: GYAE6OF02F2JTE.36.7.A07.1.454.CMB.1.raw
  modified_base (160)..(160): a, c, t, g, unknown or other
  misc_feature (160)..(160): n is a, c, g, or t
tcagtacgctgtctcacgaccggtgctcgatttagcacgtgtcgcagggggacccaaaaaccacacccctccttgggagaactcccctagatcacagctcctcacctatggactggacctgggacgctattccttttcgttggtggacagcgagcaacgnggtcgcccacctcccgagggtttacaaggtttcgggtgctagttcgtagggactctaggaaacgtggaaaggacgccggtcggggtaccttaaggtaaccgttctccgtagacgaaggtcctttacgtacggtttaccttccttttacgttaccgtagtcgggactaacgtcgtacgtcggttagggtcgaccgaaccggtaccggtaccccggttacgggaaccggtaaacgggccggttaacggtaggggttacgggtaacgggggttggggggggtacgtacggtttacccggaaccgggtaaccgtttaaacggttaacgggttttaccggtaaaaccgttaaaccggtaaaacgttacggttcggggaaccggtaacgggttaaggtcggtacgaaacgggtagaagtaaccgacggaaacgttcgaacggaaccacgaaccgtaccgtaacccggtacgaccgaacgtaacccaagggtaccgacgttaccggaaggttaacgaacggttagggaaccggcggttaagaccggtaacggacccgtacgggtaaaccgacggtaaccgggtacttaatacggtttacgccggtgtaacggaagttaacgaacccgggttaacgtatacggtttggtaacgtttagggtttaaggtttttccgggcgggtttaattacgtacggtttacgtttccgtttaacggttcggtaactttacgggggaccggttaacggg

SEQ ID NO: 131717 - DNA, 803 bp, Homo sapiens
  misc_feature: GYAE6OF02FIY0V.36.7.A07.1.454.CMB.1.raw
tcagtacgctgtctcacgaccggtgctcgatttagcacgtgtcgcagggggcagaagtctctctcagtcaggacacagcatggacatgagggtccctgctcagctcctgggactcctgctgctctggctcccagataccagatgtgacatccagatgacccagtctccatcctccctgtctgcatctggtacggagacagagtcaccatctcttggtcgggcgagtgaggacattgtacaattattttagcctggtatctagcagacgaccgagggagtacgtttaccgtaagtccgtaccgtagtaacttcgttaagtcggtccttacggtcccctttaccgttaagttttttacggaccgttaacgggttaccggttaaccggggggttacccccttaaacgtttcccgttaccggggttttaccgtaaaggggtttaccgggtaccgttaacgggtttacggggtaacgtttccgggttaacgggggtaactaacgggttaacctttttaccgaaccctttacctaacccgtaaaccctaacttacccggaacgaccggtaaaccggtccgtacggaccgtaccgtaaccggttaggaaaccgttggtttacgtttacggtaactttaaaccgttttaatttaagtttaacgttaaaacgtaaaaacgtttaacttaaaccggtaaggttacggtaacccgttacccgttacgttacccgttaaccggttttccgggaaccggggttaaccgggtaacccggttaaggggtaccggttaacgttaagttaaaaacccggg

SEQ ID NO: 131718 - DNA, 654 bp, Homo sapiens
  misc_feature: GYAE6OF02G15UO.36.7.A07.1.454.CMB.1.raw
tcagtacgctgtctcacgaccggtgctcgatttagcacgtgtcgcagggggcagaagtctctctcagtccggacacagcatggacatgagggtccctgctcagctcctgggactcctgctgctctggctcccagactaccagatgtgacatccagatgacccagtcctccatcctccctgtctgcatctgtaggagacagagtcacctatcctcttggtcgggcgagtggaggactattgtactaagtttatttacgccttaggtactcagcaggaacgaccgagggagtacgttaccgtaagtcctaccgtgtactactatcgtctacgtcccttactacttttcgctacggtcgtacggggtccctacgttccgtacggttcgtaggtcggcgtaggtcggagttacggtagggtactagtactttactacctcctacctacctactacgacggactacgtcctagcgaccgacgtaggaacgtagttacgttacgtaacttacgttttaagttacgttaacgttaaacgtaaacggttaactaaccggtagttaccgtacccggttaccggtccgttacgttaaccggttaccgggtaacgggtaacgggtacggtaacgggtacggtaacgttaacgtaaccgtaaacgg

SEQ ID NO: 131719 - DNA, 780 bp, Homo sapiens
  misc_feature: GYAE6OF02H1GDU.36.7.A07.1.454.CMB.1.raw
tcagtacgctgtctcacgaccggtgctcgatttagcacgtgtcgcagggggcagaagtctctctcagtcaggacacagcatggacatgagggtccctgctcagctcctgggactccgtgctgctctggcctccagataccagatgtacgacactccagatcgaccctagtcctccactcccttcccgtcgtcctgctacttgttacggtaggaacgtaacgaacggactaccaacctacgtttccgttcgtttcggaccgggacggacggttaggaccggagttactttacggttactaaacgttttagttacgtccgttagttactacgtacgacgtaaggaccgtaaccggaaggggtaccgttaaccggttaccgtaacgttccgtaccggtagtaacttcgttagtccgtaccgttcccgtccgtttacgttacgtttacggccgtacgggttaccggtaccgggttaccctacgttccggtttacggtacttggggtcgtaccggtaggtttcgacgttcggtacggtactacggtttacttcctaccttacgacctaccgtaaagttccgacgttccgacgtcccgttacgaaccgtcgtaccggtaagttacggtacgttcgtaacgttacgttttaactttaagtttaacgtagttaaaacgttaacgttaacgacgttgtaccggttcccttaccgttaccgtacccggtttacggttaccgggaacggttaacgggtaacgtacggttaacggttaactaccgtaaccgg

SEQ ID NO: 131720 - DNA, 195 bp, Homo sapiens
  misc_feature: GYAE6OF01ANYPG.40.25.C03.1.454.CMB.1.raw
  modified_base (193)..(195): a, c, t, g, unknown or other
  misc_feature (193)..(195): n is a, c, g, or t
tcagtctagcgactcacgaccggtgctcgatttagtagtgtagatttgggtttgggcactttaataattaccctcatatcaccttcggccaagggacacgactcgagattaaacgaactgtggctgcaccatctgtcttcatcttcccgccatctgaagtcgctagactgagcgggctggcaaggcgcatagnnn

SEQ ID NO: 131721 - DNA, 186 bp, Homo sapiens
  misc_feature: GYAE6OF02GS9P0.40.25.C03.1.454.CMB.1.raw
  modified_base (185)..(186): a, c, t, g, unknown or other
  misc_feature (185)..(186): n is a, c, g, or t
tcagtctagcgactcacgaccggtgctcgattagtagtgtagattggttggcactttaataattacctcatatcaccttcggccaaggacacgactcgagattaacgaactgtggctgcaccatctgtcttcatcttcccgccatctgaagtcgctagactgagcgggctggcaaggcgcatagnn

SEQ ID NO: 131722 - DNA, 279 bp, Homo sapiens
  misc_feature: GYAE6OF02GZCN5.40.25.C03.1.454.CMB.1.raw
  modified_base (277)..(279): a, c, t, g, unknown or other
  misc_feature (277)..(279): n is a, c, g, or t
tcagtctagcgactcacgaccggtgctcgatttagtagtgtagatttgggtttggggttcagcggcagtggatctgggacggatttcactctcaccatcagcagcctgcagcctgaagattttgcaacttattactgtcaacactttaataattaccctcatatcaccttcggccaagggacacgactcgagattaaacgaactgtggctgcaccatctgtcttcatcttcccgccatctaagtcgctagactgagcgggctggcaaggcgcatagnnn

SEQ ID NO: 131723 - DNA, 164 bp, Homo sapiens
  misc_feature: GYAE6OF01EQ9W9.5.82.H05.1.454.CMB.1.raw
  modified_base (164)..(164): a, c, t, g, unknown or other
  misc_feature (164)..(164): n is a, c, g, or t
tcagatcagacacgcacgaccggtgctcgatttagtcgagctctctcgcgggcacgaccggtgctcgatttagtcacgcgagaaagggaaggggctggccctagcgcgttcctgttcccaccctcctccgtgtctgatctgagcgggctggcaaggcgcatagn

SEQ ID NO: 131724 - DNA, 804 bp, Homo sapiens
  misc_feature: GYAE6OF01C1F1D.5.82.H05.1.454.CMB.1.raw
tcagatcagacacgcacgaccggtgctcgatttagtcgagctctctcgcgggcacgaccggtgctcgatttagtacacgtgattagggattggggatactttctgagactcatggacctcctgcacaagaacatgaaacacctgtggttcctcctcctcctggtggcagctcccagagtgggccctgtctcgaggtgcagctgcaggacgtcgggcccaggactggtagaacgtccgttccggggaccctcgtccctcacctgcgtattgtttcgtcgtcggctccatcagactacttaattaagttggtcgtaccgtgggtccgacccacggacccccgaaaggaacggacggtcgtgggacgtagggtagttggggatagttctaatacgaacgtaccgggacgacaaccaaacctacaaacttcccgtaccctaacgaacgtacgtacgtaacggtaccaaccgtaactaacgttacttaaacgtaacgtaaacctaaccggtaaccgtaaaacctaaaccccgttaacgtttaccccttaaccccgttaacggtaaacgggttaccgttaaccccgttacgtttaccggtaccgggtaacccccggtaccccgggtaccgggaaccccggtaaccccgggtcccgtttacccgttaaaccggttttaccggtccggttaccgggtacccgggtaaccggtttaacggttttaccggaaacggggtaaaccggggtaaaccgaacgggtaaacccttaaacgttaacgtttaaccgtccgggtaaccgggttacccggggg

SEQ ID NO: 131725 - DNA, 172 bp, Homo sapiens
  misc_feature: GYAE6OF02HHOMB.5.82.H05.1.454.CMB.1.raw
  modified_base (165)..(172): a, c, t, g, unknown or other
  misc_feature (165)..(172): n is a, c, g, or t
tcagatcagacacgcacgaccggtgctcgatttagtcgagctctctcgcgggcacgacctgtgctcgatttagtcgagctctctcgcgggctggcaaggcgcatagctgcctggtcaaggactacttcccgtgtctgatctgagcgggctggcaaggcgcatagnnnnnnnn

SEQ ID NO: 131726 - DNA, 718 bp, Homo sapiens
  misc_feature: GYAE6OF02IJTCK.5.82.H05.1.454.CMB.1.raw
tcagatcagacacgcacgaccggtgctcgatttagtcgagctctctcgcgggcacgaccggtgctcgatttagtacacgtgatttagggattggggatactttctgagactcatggacctcctgcacaagaacatgaaacacctgtggttcctcctcctccgtggtgcagctcccagatcgggccctggtctcaggtgcagctgctaggacgtcggccctaggacctggtagaacgtccgttccggggaccctcgtcccgtcaccgttgccgagttcgtttcgtcggtacgtcctccatcgacgtcgtacttaagtttaagttcggtcggtacctcgggtcccgccaccgtaccccgtaagggaaaacgtcgggtaccgtgggtaggtaccggggtaaggttccggggagtagtaccttaacgagttaaccggacgggacacgtaaaccctaacgttaacgaaccgttcccggaaccctagtaacggtacgtacgtacggtacctaaacccaggtttaacacgttaacgaaacgtaccgtaacgtaaccgaaacacccgttaacggtcctacccgaggtaacggtcaacgttcgtacgttacgaccggaccgtacggtacgaccgttacgttaccgtaattccgtacggtcgtaccggtcgttaagtttcgaacggcgtaacggtacgaccgttaacaggtaccgtacgaccgttggg

SEQ ID NO: 131727 - DNA, 554 bp, Homo sapiens
  misc_feature: GYAE6OF01CXAHG.41.85.H08.1.454.CMB.1.raw
  modified_base (281)..(281): a, c, t, g, unknown or other
  misc_feature (281)..(281): n is a, c, g, or t
tcagtctatactatcacgaccggtgctcgatttagtatcactcagtcgcgggggcagaagtctctctcagtcaggacacagcatggacatgagggtccctgctcagctcctgggactcctgctgctctggctcccagataccagatgtgacatccagatgacccagtctccatccctccctgtctgcatctggtgggagacagagtccaccatcacttggccgggcgagtcgagggcatagactaatttattagcctggtatcagacaagaaacgaggaanctacctaagctctgatactatacgaaacactactattttcgactaacgtcgacgggtaccctagttcgtcggttcgacgtcggctaggtgtagtcgtggatagtattcactctactacgtcagcacgcctgcagccgtagaacgtgtagttcgtacttaacttattaactagttaactaaagtactaacgtacgtaccgtacccctacgtaccgttacgtttcccggccgttaccggaacctacgtacgtagtactacgtacgaaggtaaccg

SEQ ID NO: 131728 - DNA, 755 bp, Homo sapiens
  misc_feature: GYAE6OF01DTM0X.41.85.H08.1.454.CMB.1.raw
  modified_base (203)..(203): a, c, t, g, unknown or other
  misc_feature (203)..(203): n is a, c, g, or t
tcagtctatactatcacgaccggtgctcgatttagtatcactcagtcgcgggggcagaagtctctctcagtcaggacacagcatggacatgagggtccctgctcagctcctgggctcctgctgctctggctcccagataccagatgtgacatccagatcgacccagtctccactccctccctgtctgctatcgtggtaggganacgagacgtccacctatcacgttcggccggcgagtcgaggactattagacttaatttattacgtccgtaggtatacgagacgaaacggaaaaccgaaggggaaaccgtccttaacccgtaacggtccctacgttacgaacttactaaactacgaaaaccttacttaccttattttacgactaacgtaccggtaccgggttaccctacgttccgttaccggttacgacggtcggtacggtaggtacgggacgttcgggtaacgggtaacctaggtttacctttaccacctttaccctaccgtaacccgtacgacgtacctaccggtccgtaccggaccgtaccggtaccgtaggtaacgttagtttacgttaaccgttaacctttaaccgttttaacttaccggtaacgtttaaactaaacgtttacgttaaacccgtccggttaccccgtaccccttaaccgttaacccgtttccccggttaccccggtaccgtaacccgggtacccgtaaacgtacggttaagtacctaacttaccggaaggttaacccgg

SEQ ID NO: 131729 - DNA, 274 bp, Homo sapiens
  misc_feature: GYAE6OF01C21KN.1.8.A08.1.454.CMB.1.raw
  modified_base (259)..(274): a, c, t, g, unknown or other
  misc_feature (259)..(274): n is a, c, g, or t
tcagacgagtgcgtcacgaccggtgctcgatttagcatactctactcgcgggaagatgaagacagatttcactctcaccatcagcagcctgcagcctgaagattttgcaacttattactgtcaacaggttaatagttaccctctcgtcacttttggccaggggaccaagctggagatcaaacgaactgtggctgcaccatctgtcttcatcttccgccatctgaacgcactcgtctgagcggctggcaaggcgcatagnnnnnnnnnnnnnnnn

SEQ ID NO: 131730 - DNA, 285 bp, Homo sapiens
  misc_feature: GYAE6OF01CXURY.1.8.A08.1.454.CMB.1.raw
  modified_base (272)..(273): a, c, t, g, unknown or other
  misc_feature (272)..(273): n is a, c, g, or t
  modified_base (275)..(285): a, c, t, g, unknown or other
  misc_feature (275)..(285): n is a, c, g, or t
tcagacgagtgcgtcacgaccggtgctcgatttagcatactctactcgcgggaagatgaagacagatttcactctcaccatcagcagcctgcagcctgaagattttgcaacttattactgtcaacaggttaatagttaccctctcgtctacttttggccaggggaccaagctggagatacaaacgaactgtggctgcaccatctgtcttcatccttcccgcctatctagaaccgcaccttcgctgacgcgggctggcaagggcgacagtagnnannnnnnnnnnn

SEQ ID NO: 131731 - DNA, 299 bp, Homo sapiens
  misc_feature: GYAE6OF02FIZTC.1.8.A08.1.454.CMB.1.raw
  modified_base (270)..(299): a, c, t, g, unknown or other
  misc_feature (270)..(299): n is a, c, g, or t
tcagacgagtgcgtcacgaccggtgctcgatttagcatactctactcgggccgggaagatgaagacagatttcactctcaccatcagctagcctgtcagcctgaaggattttgcaacttattacgtggtcaacaggttaatagttaccctctcgtcacttttggccaggggaccaagactggagatcaaacgaactgtggctgcaccatctgtcttcatcttcccaccctcctcacgcactcgtctgagcggctgggcaaggcgcatagnnnnnnnnnnnnnnnnnnnnnnnnnnnnnn

SEQ ID NO: 131732 - DNA, 519 bp, Homo sapiens
  misc_feature: GYAE6OF01ARPNT.49.85.H08.1.454.CMB.1.raw
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaattgggggataaatatgctggctggtatcagcagaagccaggccagtcccctgtgtggtcatctatcaagataccaagcggccctcagggactccctgagcgattctctggctccaactcgtggaacacacgccactctcgaccatcagcgggactcgacggctatcgatgaggctgactattacgtgtcgaggcgtagggacacgccgactacgtggggttacgttccggggcgggacgggaacccaaggccgtacggacccgttccgtaggagtccgacggccccgtaacggg

SEQ ID NO: 131733 - DNA, 486 bp, Homo sapiens
  misc_feature: GYAE6OF01C9W73.49.85.H08.1.454.CMB.1.raw
  modified_base (214)..(214): a, c, t, g, unknown or other
  misc_feature (214)..(214): n is a, c, g, or t
  modified_base (276)..(276): a, c, t, g, unknown or other
  misc_feature (276)..(276): n is a, c, g, or t
  modified_base (331)..(331): a, c, t, g, unknown or other
  misc_feature (331)..(331): n is a, c, g, or t
  modified_base (385)..(385): a, c, t, g, unknown or other
  misc_feature (385)..(385): n is a, c, g, or t
  modified_base (403)..(403): a, c, t, g, unknown or other
  misc_feature (403)..(403): n is a, c, g, or t
  modified_base (423)..(423): a, c, t, g, unknown or other
  misc_feature (423)..(423): n is a, c, g, or t
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgcnctggagacaaattgggggataaatatgctggctggtatcagcagaagccaggccagtccccngtgttggtcatctatcaagataccaagcggcctcagggactccctgagcgattcnctggctcaactctgggaacacagccactctgaccatcagcgggactcaggctancgatgagctgactatacngtcgaggcgtggacagccgngacgtgggtatcgggcggagggaccaagcgtagaccgtcctaggagtccgagcccgtaacggg

SEQ ID NO: 131734 - DNA, 477 bp, Homo sapiens
  misc_feature: GYAE6OF01B0K3K.49.85.H08.1.454.CMB.1.raw
  modified_base (384)..(384): a, c, t, g, unknown or other
  misc_feature (384)..(384): n is a, c, g, or t
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaattgggggataaatatgctggctggtatcagcagaagccaggccagtcccctgtgttggtcatctatcaagataccaagcggccctcagggatccctgagcgattctctggctccaactctgggaacacagccactctgaccatcagcggactcagctancgatgagctgactattactgtcaggcgtgggacagccgcacgtggggtattcggcggagggaccagctgacccgtctgagtcagcccgaacgg

SEQ ID NO: 131735 - DNA, 503 bp, Homo sapiens
  misc_feature: GYAE6OF01ANN0O.49.85.H08.1.454.CMB.1.raw
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaagttgggggataaatatgctggctggtatcagcagaagccaggccagtcccctgtgttggtcatctatcaagataccaagccggccctcgagggactcccgtgagcgatctctggctccaactcgtggaacacagccactctgaccatcagcggactcgaggctatcgatgaggtctgactattactgtacgagggcgtagggacacgccgcgtacgtggggtacttcgggcggagggaccgaggcgtacgaccgtccgagacgtcgacgcccgtacgg

SEQ ID NO: 131736 - DNA, 484 bp, Homo sapiens
  misc_feature: GYAE6OF01ATNLM.49.85.H08.1.454.CMB.1.raw
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaattgggggataaatatgctggctggtatcagcagaagccaggccagtcccctgtgttggtcatctatcaagataccaagcggccctcagggatccctgagcgattctctggctccaactctgggaacacagccactctgaccatcagcggactcaggctatcgatgaggctgactattactgtcaggcgtgggacaggccgcgacgtggggtacttcgggcgggagggaccagctggacccgtctgagtcagcccaacgg

SEQ ID NO: 131737 - DNA, 551 bp, Homo sapiens
  misc_feature: GYAE6OF01AE5N4.49.85.H08.1.454.CMB.1.raw
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaattgggggataaatatgctggctggtatcagcagaagccaggccagtcccctgtgtggtcatctatcaagactaccaagccggccctcgacgggactcccgtgacgcgatttctctcggctaccaacgtcgtacgggaacacacgccactctcgaccactcaggcgggactcgagtctagtcgatggaggctacgacttattactgtacgagggtcggtagggaccgacggccgcgacggttcggggtacgttccggggaccgggaaggggacccgaacggccgtacggacccggtccgtaggacggtccgacggcccgtaaccggg

SEQ ID NO: 131738 - DNA, 509 bp, Homo sapiens
  misc_feature: GYAE6OF01BIRR7.49.85.H08.1.454.CMB.1.raw
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaattgggggataaatatgctggctggtatcagcagaagccaggccagtcccctgtgttggtcatctatcaagataccaagcgccctcagggactccctgacgcgattctctggctaccaacttcgtagggaacacacgccactctcgaccatcgagcgggactcgaggctatcgatgaggctgactattactgtcgagggtcgtgggacacggccgcgacgtggggtattcgggcggagggaccaggcgtaggacccgttcgtacgagtccacggcccgtaacggg

SEQ ID NO: 131739 - DNA, 482 bp, Homo sapiens
  misc_feature: GYAE6OF01ANYSV.49.85.H08.1.454.CMB.1.raw
  modified_base (393)..(393): a, c, t, g, unknown or other
  misc_feature (393)..(393): n is a, c, g, or t
  modified_base (467)..(467): a, c, t, g, unknown or other
  misc_feature (467)..(467): n is a, c, g, or t
  modified_base (473)..(473): a, c, t, g, unknown or other
  misc_feature (473)..(473): n is a, c, g, or t
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaattgggggataaatatgctggctggtatcagcagaagccaggccagtcccctgtgtggtcatctatcaagataccaagcggccctcagggatccctgagcgattctctggctccaactctagggaacacagccactctagaccatcagcgggactcaggctatcgatgnggctgtactattactgtcaggcgtgggacagccgcgacgtggggtatcgggcggagggaccaggctgaccgtcngagtcngccgaacgg

SEQ ID NO: 131740 - DNA, 480 bp, Homo sapiens
  misc_feature: GYAE6OF01EOSKT.49.85.H08.1.454.CMB.1.raw
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaattgggggataaatatgctggctggtatcagcagaagccaggccagtcccctgtgttggtcatctatcaagataccaagcggccctcagggactccctgagcgattctctggctccaactctggaacacagccactctgaccatcagcgggactcaggctatcgatgagctgactattactgtcaggcgtgggacagccgcacgtgggtacttcgggcggagggaccagcgtgaccgtctgagtcagcccgaacgg

SEQ ID NO: 131741 - DNA, 628 bp, Homo sapiens
  misc_feature: GYAE6OF01C0N5T.49.85.H08.1.454.CMB.1.raw
tcagagtcgagagacacgaccggtgctcgatttagtatcactcagtcggcggggctgggcctcaggaagccagcaatcggaggtgccctcagccatggcatggatccctctcttcctcggcgtccttgcttactgcacaggatccgtggcctcctatgagctgactccagccaccctcagttcgtccggtagtccccaggaccagaccagcccagccatcacctgctctggagacaaattggggataaagtaatgctggactggtactcgagccagaagccaggccagtcccctgtgttggcatccatcaagataccaagcgccctgacggatccccgtgacgcgtatttccgtcgtggacctccgaaacttccgtagggtaaccacacgacccactcctacgaacctactccgacgcgggtaactcgacgggtcttaagtaccgtaattcggtaacggtccttcgaacttactttaacttaggttaaccgtagggtacgttcgggaacctacggtcccgtaccgtaccggtgggggttaacttccggggacgggtaagggacccgaaaggcccgttaacggtaaccccggtcgttacgggtacgtcccgtaggaccccgtaaacggg

SEQ ID NO: 131742 - DNA, 497 bp, Homo sapiens
  misc_feature: GYAE6OF01DBQ2D.49.85.H08.1.454.CMB.1.raw
  modified_base (317)..(317): a, c, t, g, unknown or other
  misc_feature (317)..(317): n is a, c, g, or t
  modified_base (432)..(432): a, c, t, g, unknown or other
  misc_feature (432)..(432): n is a, c, g, or t
  modified_base (484)..(484): a, c, t, g, unknown or other
  misc_feature (484)..(484): n is a, c, g, or t
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaattgggggataaatatgctggctggtatcagcagaagccaggccagtcccctgtgttggtcatctatcaaagataccaagccggccctcaggntcccctgagcgatttctctggcctccaactcgtagggaacacagacccactctcgaccatcagcgggactcgaggctatcgatgagctgactattactgtacgaggcgtgggacngccgcacgtgggtagtcgggcggagggaccaggcgtgaccgtccgtgagtcncgcccgtaacggg

SEQ ID NO: 131743 - DNA, 516 bp, Homo sapiens
  misc_feature: GYAE6OF01CDE09.49.85.H08.1.454.CMB.1.raw
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaattgggggataaatatgctggctggtatcagcagaagccaggccagtcccctgtgttggtcatctatcaagataccaagcggccctcgaggactccctgagcgattctctggctcagtctggaacacggccaccctgaccgtcagcacgggtcgaaggccggggatggacggccgactatatctagtcaggtgtgggtatagtagtagtcgcttcggttcggggtgttcggcggagggaccgtagttgaccggttcgttgggtacagtcccgaaggctcgccccgtcggtcc

SEQ ID NO: 131744 - DNA, 539 bp, Homo sapiens
  misc_feature: GYAE6OF01ESKEG.49.85.H08.1.454.CMB.1.raw
  modified_base (324)..(324): a, c, t, g, unknown or other
  misc_feature (324)..(324): n is a, c, g, or t
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaagttgggggataaatatgctggctggtatcagcagaagccaggccagtcccctgtgttggtcatctatcaagataccaagccgccctcagggactcccgngacgcgattctctcggctcccaactcgtacgggaacacacgcccactctgaaccataccgaggccgggactcgaggtcctatcgatggagcgtagacttattacgtgtacgaggcggtagggactacggcccgtacgacggttcggggtacttcggggacgggagggaccaaggccgtacggacccgttctaggacgtccgacgcccgtaacggg

SEQ ID NO: 131745 - DNA, 548 bp, Homo sapiens
  misc_feature: GYAE6OF01BMO03.49.85.H08.1.454.CMB.1.raw
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaagttgggggaataaatatgctggctggtatcagcagaagccaggccacgtccctgtgttggtcatctatcaagactacaacgccggaccctcgaggactcccgtgacgcgtacttcgtctcggcctaccaactcgtacgggaacacacgaccactcgtacgaccagtcacggcggactcgaggctagcgtagtcgaaggtctagtacttacgttacgtgtacgaggtcggtgggaccacggccgacgtacggtggggtacgttcgggacgggacggaccgaacgcgtacggtacccgtccgtaggacgtcacggtcccgaacgg

SEQ ID NO: 131746 - DNA, 507 bp, Homo sapiens
  misc_feature: GYAE6OF01CRYX1.49.85.H08.1.454.CMB.1.raw
  modified_base (403)..(403): a, c, t, g, unknown or other
  misc_feature (403)..(403): n is a, c, g, or t
  modified_base (431)..(431): a, c, t, g, unknown or other
  misc_feature (431)..(431): n is a, c, g, or t
  modified_base (497)..(497): a, c, t, g, unknown or other
  misc_feature (497)..(497): n is a, c, g, or t
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaagttgggggataaatatgactggctggtatcagcagaagccaggccagtcccctgtcgttggtcatctatcaagataccaagccggccctcgagggactcccgtgacgcgtattctctggctcctaactcgtacgggaacacgacgcctactctacgaccatcagcggactcgagctancgatggagctagacttattactgtacgnggcgtcgggacacgccgcgacgtgggtagtcgggcggagggacgagccgtgaccgtcgtagagtcncgccgtacgg

SEQ ID NO: 131747 - DNA, 522 bp, Homo sapiens
  misc_feature: GYAE6OF01ET5LJ.49.85.H08.1.454.CMB.1.raw
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaattgggggataaatatgctggctggtatcagcagagccaggccagtcccctgtgttggtcatctatcaagataccaagcggccctcgaggactccctgagcgattctctggctaccaactcgtagggaacacgacgccactctcgaccatccccccccagcgggactcgacgactactacgatagacggctagactattactgtacgacggtcgtagggacgacgccgcgacgttgggtacgttcgggcgggtagggaccgaacgcgtacgaccgtccgtacgagtcacgccgaacgg

SEQ ID NO: 131748 - DNA, 638 bp, Homo sapiens
  misc_feature: GYAE6OF01CPWHH.49.85.H08.1.454.CMB.1.raw
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtcgtccgtgtccccaggacagacagccagcatcacctgctcgtggagaacaaagttgggggaataaaatatgactggctaggtatcagcaagaagccgaggacccacgtcccctggttgttggtactattctaactacaaagtaactaaccgaacgccggacccttacgaacggggtactccccgtaggacgtacggtaactttcgtacgttcggacctaccaaacttcgtagggaaaccacgacgcctactcgtacaccgtatacgacggaccgggactacggaacgtcctaagtccggataggacgtcttacggaacctttaagttaccgttggtaccgacgggtcggtaacgggacgaccgaccgtcgaacggttggggtaacgttcgggaccgggtagggaacccgtaggacccgtacggacccgtcccgtagtacgtaccgacgtcccggtaaaccgg

SEQ ID NO: 131749 - DNA, 648 bp, Homo sapiens
  misc_feature: GYAE6OF01A8XG9.49.85.H08.1.454.CMB.1.raw
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaagttgggggataaatatgctggctggtatcagcagagccaggccagtcccctgtgttggtcatctatcaagataccaagccgccctcgacggggactccctggacgtcgtatttccgtctcggccttacccgaacttccgtacggggaaaccaccgacggaccctacgttacctcgaacccctattacccgaacgggaccggggtaacctaccggaacgggtaccttaacgtccggtaagttcgggaacgggtcttacggtaacttagtttaaccgtggtaccgtacgggtaccggttacgggaccgacggcccggtccgtaaccggttcgggggttacgttcccgggggacgggaacggggtacccgaaaggtccgtacgggtaccccgttcgtcggaacggttccgacggccccgtaacggg

SEQ ID NO: 131750 - DNA, 764 bp, Homo sapiens
  misc_feature: GYAE6OF01DRO00.49.85.H08.1.454.CMB.1.raw
  modified_base (288)..(288): a, c, t, g, unknown or other
  misc_feature (288)..(288): n is a, c, g, or t
tcagagtcgagagacacgaccggtgctcgatttagtatcactcagtcggcggggctgggcctcaggaagcagcatcggaggtgcctcagccatggcatggatccctctcttcctcggcgtccttgcttactgcacaggatccgtggcctcctatgagctgacacagccaccctcggtgtcagtcgtccccaggacagacggccaggatcacctgctctcggagatgcattcgaccaaacgatatgcttattggtaccagcagacgccggcacggccctgtgttcggtnatgtataagacacgtagagacggccctacgaggtactcccgtgacgcgtattctcgtcggcctccgaggtccaacgggactaaccggtcaacgtacgttcgggaccctagttacgacgggttagggaaccgttacccggaacgggtaccgaaacggggtaacgggtaaccggggtaacgggttaccgttaaccggggtaaacttttaacgttttaacgttttaacggtaacctttaaacgtaacccgtaaaccgtaaacgtaaccccgttaaaccgttacggtttaacggtttaaccgtttaacgttaccgggtttaacccgtttaaccgggtaaaccttaccgggtaaacccggtaaacccggttaaacggggttccccgttaaccccgggttacccgttaccgggggtttaaccccgaaacccggtaccccgggtaaaaccccggtccccccgttaaacccccgttaccccggg

SEQ ID NO: 131751 - DNA, 621 bp, Homo sapiens
  misc_feature: GYAE6OF01BZL2N.49.85.H08.1.454.CMB.1.raw
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtcgtccccaggacagacagccagcatcacctgctctggagaacaaagttgggggaataaatatgcgtggctggtatcgagcagaagccaggccacgtccctgtgttcggtcatctatcaagactaccgaagccgcctcgacggactcccgtgacgcgtacttctcgtcggctaccaactcgtacggaaaccacgacgaccctacgtcctacgaacctataccgacgggaccgggaacctcgaacgggtaccttaagtaccgtagtcgggaacgtccgtagtaacttaacgtttacgtacgtcgaacgggtccggtagggaccagggcccgtacgaacggttacggggttacgttcggggacgggtaacgggaaccccgtaaggtcccgtaacggtaccccggttccgtacggaacgtcccgaacggaccccggtaacggg

SEQ ID NO: 131752 - DNA, 522 bp, Homo sapiens
  misc_feature: GYAE6OF01BGX56.49.85.H08.1.454.CMB.1.raw
  modified_base (396)..(396): a, c, t, g, unknown or other
  misc_feature (396)..(396): n is a, c, g, or t
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaattgggggataaatatgctggctggtatcagcagaagccaggccagtcccctgtgttggtcatctatcaagataccaagcggccctcgacggggactccctgagcgattctctggctccaactcgtagggaacacagccactctgaccatcagcggactcacggctatcgangagctagacttattactgtcgaggtcgtgggacctacggccgcgacgttggggtacttccgggcgggtaagggaccgaacggccgtaggacccgtccgtacggagtccgacggccccgtaaacggg

SEQ ID NO: 131753 - DNA, 604 bp, Homo sapiens
  misc_feature: GYAE6OF01CBJAK.49.85.H08.1.454.CMB.1.raw
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcacgccaccctcagtgtccgtcgtccccaggacagacagccagcatcacctgctcgtggagactaaaggttggggaataaatatgcgtggcgtggtactcgaagcaagacgccgacggccctacgtccccgtggttcgttcggtctacgtctatacaaagaacgtaaccaacggccgccctagacggtacctccgtagacgcgtattcgtcgtcgtctacctaacgtcgtacggaaccacgacgcctactctcgacctatacgacggacggtactcgacgtcgtacgtacgagtacggtacgtactacgtacttacttacggtcgtacgggtggcgggtagacgcggccgcggtacgggtacgggtacgtcggggacggtaaccgggaacgtcggtccgtacggtacccgttcgacggtacgtaccgcgacccggtaaccgg

SEQ ID NO: 131754 - DNA, 626 bp, Homo sapiens
  misc_feature: GYAE6OF01BQ5R9.49.85.H08.1.454.CMB.1.raw
  modified_base (244)..(244): a, c, t, g, unknown or other
  misc_feature (244)..(244): n is a, c, g, or t
  modified_base (261)..(261): a, c, t, g, unknown or other
  misc_feature (261)..(261): n is a, c, g, or t
tcagagtcgagagacacgaccggtgctcgatttagtatcactcaggtcgcggggcgtggggcctcaggaagcagccatcggaggtgcctcagccatggcatggatccctctcttcctcggcgtccttgcttactgcacaggatccgtggcctcctatgagctgactcagccaccctcagtgtccgtcgtccccaggacagacagccagcatcacctgctctggagacaaagttggggataaatntgactggctggtatcanactagaacgccaggccacgtccctgtgttcgcatctatcaagactaccgaagccgcctcgacggactccgtgagcgtattccgtcgtcggtcctaccgaacgttcggtaaggaacctacgacggcctaacgtcctagacccattaccgaggtccggacttcgacggtacctaaggtcgaacgtggacggtctacgtaacttacgttaccgtacggtacggacggtccggtaggaccgtacggacccggtacgtacgggttcggggtaacgttcccgggggaggggtaacccggaaccggttaacgccggttaacccggtaccgttaccggtacgtaccggtaaccgaccggtcccggtaaaccgg

SEQ ID NO: 131755 - DNA, 651 bp, Homo sapiens
  misc_feature: GYAE6OF01EUIZO.49.85.H08.1.454.CMB.1.raw
tcagagtcgagagacacgaccggtgctcgatttagtatcactcagtcgcggggctgggcctcaggaagcagcatcggaggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactggtatcaaacaaaagcctggccaggccccttgttttggtcctttatcgagtacttcaagtccggacccgtctggggactccccgtgacgcgtattctctcgggcctccgacggtcggggaacaggggccactctgacccatcatcgagggcccagggcaacgatgaggctagactattactgtcgaggtcgaaagaccgtacctaaacttgtacctagttagttcgggacggaacggggtaaccctaaaaggtttccggaacccggttccgtacggggtaccaacgggaccccgtaaagggtcccttaccggacccccccgttcgggtaccctacccgttcccgttacccgttccccccaacccccgttccccttaccttaccctccgttcccgtaccttccgg

SEQ ID NO: 131756 - DNA, 545 bp, Homo sapiens
  misc_feature: GYAE6OF01BQHJ5.49.85.H08.1.454.CMB.1.raw
  modified_base (328)..(328): a, c, t, g, unknown or other
  misc_feature (328)..(328): n is a, c, g, or t
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaagttggggataaatatgctggctggtatcagcagaagccgaggccacgtccccgtgtgttggtcatctatcaagactaccgagccggccctcgacggactccgngacgtcgattctcgtcggcctaccgactcgtacgggaacacgacgccctactcctacgacctactcgacggaccgggactacgaggtctagtccgtagtcggaggtctagtacttattacgtgtacgtagggtcggtagggacaggccgcgtacggtcggggtaatcggggacggaggaccacggcgtcgaccgtcgtgagtccgcgcccgtaacgg

SEQ ID NO: 131757 - DNA, 547 bp, Homo sapiens
  misc_feature: GYAE6OF01DSO9G.49.85.H08.1.454.CMB.1.raw
  modified_base (400)..(400): a, c, t, g, unknown or other
  misc_feature (400)..(400): n is a, c, g, or t
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaattgggggataaatatgctggctggtatcagcagagccaggccagtccctgtgtggtcatctatcaagactaccaagtcggccctacgagggactcccgtagacgcgtattctcgtggctaccactcgtaggaacacacgccactctacgaccatcgacggcgggctacgagctancgatggacgctgaacttactactgtacgtagggcgttacgggactacggcccgtacgacgttggggtaacgttccggggacgggaacgggacccaagggtcctacggtacccggtccgttagagttcccgaacgcccgtaaaccggg

SEQ ID NO: 131758 - DNA, 635 bp, Homo sapiens
  misc_feature: GYAE6OF01CDFUD.49.85.H08.1.454.CMB.1.raw
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagattagactcacgccaccctcagtcgtccgtcgtccccgaggacagacagccagcatcacctgctcgtggacgactaaagttagggggaataaaagtagtgcgtggcttaggtatcgagacgaagaacgccgacggccctacgtccccgtggttcgttcggtacattactacgtacgaaagtactaccgaacgccggtccgtacgagggtactcccgtagacgcgtaacgttctcgtacgacctacctaacgtcgtacgggaaacacggtacacccgtacttaccgacgaacctagtaccgacggtaccggaactcgaacgttcacgttacgacgtgaacggtctaggtaacttacgttagtcggtacgacgggtcggtacggactaccggccgtacggtacgtggggtaacgttcgggaaccgggagtaccggagccgtacggtacccgtcgtacggacgtaccgcggtacccgtacgg

SEQ ID NO: 131759 - DNA, 579 bp, Homo sapiens
  misc_feature: GYAE6OF01BOZXL.49.85.H08.1.454.CMB.1.raw
  modified_base (440)..(440): a, c, t, g, unknown or other
  misc_feature (440)..(440): n is a, c, g, or t
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaagttgggggataaatatgctggctggtatcagcagaagccgaggccacgtcccctggttgttcggtctagtctatacaagactaaccaaggccggaccctcgaaggggacctccccgtagacgcgtactttcgtcgtcggtcctcccgaaactcgtagggaaccacgacgaccactactcgaccagtcaacggcggtactcgaggcctaagcgtagngagtctagacttacttacgtggtcgaaggtcggtacggaccgaggacccgtcgacggttcgggtacggttccgggacgggacgggaaccgaacggccgtacgaccgttccgtaggtacgtcgaacggcccgtaacccgg

SEQ ID NO: 131760 - DNA, 618 bp, Homo sapiens
  misc_feature: GYAE6OF01ECMFI.49.85.H08.1.454.CMB.1.raw
  modified_base (365)..(365): a, c, t, g, unknown or other
  misc_feature (365)..(365): n is a, c, g, or t
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtcccccaggacagacagccagcatcacctgctctggagacaaagttgggggataaatatgctggctggtatcagcagaagccaggccagtcccctgttggttggtcatctatcaagataccaagcggccctcgaggctccgtgagcgtattctcgtcggctaccaactcgtagggaaccacncgccaactctgaccatcgaggcgggactcgacggtctagtcgagtggaggtacctagtacttaattacgttcggttacgaaggggtccgggttgggaaccacggcccgacggtaaccgggtttggggggtaacgtttccgggggaaccgggggtaaccggggtaacccgaaagggtcccggttacgggtaacccccgggttcccgtaacgggtaaccggtttacccgaccgggtaacccccggtaaaccgggg

SEQ ID NO: 131761 - DNA, 712 bp, Homo sapiens
  misc_feature: GYAE6OF01DEKQ3.49.85.H08.1.454.CMB.1.raw
tcagagtcgagagacacgaccggtgctcgatttagtatcactcagtcgcggggctgggcctcaggaagcagcatcggaggtgcctcagccatggcatggatccctctcttcctcggcgtccttgcttactgcacgaggatccgtggcctcctatgagctgactcacgcccaccctcacgtcgtccgtcgtacccgaggacagacacgccagcactcctacctgctcgtaggaacgaacgaaaggttaggggaaattaaagtagtaggtcgtcggtgttaggtactacgagacgaaggaaccgaccgacggtacccgtaccggttcccgttggttcggtcggtactacgttacttaatacgaaacgtaacctaaccgaaccggcccgtacccgtacggtacggtaaccctccgtaggacgtacgttacttccgtcggtacgtacctaacctaccgttcggaaccggaacacgacgtaccctacgtactaccgactacgacggacggtcgactacgacgtacctagtacggtagtacggacgttagtacgttaacgttcttaacggtcggtaaccgggaggggttaccggacggacccgtacggccggttacggtaccggggtgggttaacgggcccgggaaggggacccggtacgacggttccgtacgggtacccgtcgacggtaccgacccgtaacgggcccgtaacccggg

SEQ ID NO: 131762 - DNA, 681 bp, Homo sapiens
  misc_feature: GYAE6OF01EERON.49.85.H08.1.454.CMB.1.raw
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagcccaccctcagtcgtccgtcgtccccgaggacagacacgccagcactccacctgctcgtggaacgaacgtaaaggttagggggaataaagtagtgtcgtggtcgttaggtactcgagacgaagacgaccgacggaccgtacgtcccgtggttcgttcggtactactactaactacaaacgactaaccgaacggtccgtcccgtacggacggtactccgtagacgtacgtacttctcgtcggtacctaccgacgtacgtacggaaccacgacctacctacctcgtacgaccacgtacggacgacggtactcgacgtacctaggtcgagtcggtacgtacgtagtaacgtttacgttacgtcggacgggtagggtccggtaggaccggtaccggccggtaccggttaacggggttcggggtaaccggttccgggggaacgggtaccgggaaaccgtcgggacccggttccggtaacccggttcggacggtacgaccgtacccggacccggtacccggg

SEQ ID NO: 131763 - DNA, 738 bp, Homo sapiens
  misc_feature: GYAE6OF01D5304.49.85.H08.1.454.CMB.1.raw
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaagttggggataaatatgctggctggtatcagcagaagccaggcacgtccctgtgttggtcatctatcaagataccaacgccgccctcgacgggtactcccgtgacgcgtactttctcgtcggtcctacccaactcgtacgggaaacctaccgacgacccgtaccttaccgtacggaaccctaacgttcgaacgggtaccggggtaacctccggtaaccgggtctttaacgtaccggtaagttcgggaacgggttccctacgggtaaccgtttaacttttaacccggtcggtttaacccggtaacggggtccgggttaacgggggaacccgtaaccgggtccccggtaaccgggtaaccgggtttcgggggggtttaaaccgtttacccggggggaaccgggggtaaacggggaaccccggtaaacgggtaccccggtttaccggggaaacccccgtttccgggttacggtaaccggggttacccgaaacccgggacccccgggtaaacccgggg

SEQ ID NO: 131764 - DNA, 592 bp, Homo sapiens
  misc_feature: GYAE6OF01CY9X8.49.85.H08.1.454.CMB.1.raw
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaagttgggggaataaatatgctaggctggtatcgagcagaacgccgacggccacggtcccctgtcgttggtcatctatacaagtactaccaagccggccctacgacgggactcccgtagacgcgtattctcgtggtacctccctaacgtcgtagggaacctacgacgccctactcgtcgaaccatccgacggcggtactacgacggccttaagtcgagtcggagctagtactagttacgtgtcgtaggcggttaggaccgacgccgtacgtacgggtggggttacgttacggggacgggaaggtaacccggaaggccgtaccggtacccggtaccgttacggacgtaccgaacggtcccgtaacccggg

SEQ ID NO: 131765 - DNA, 662 bp, Homo sapiens
  misc_feature: GYAE6OF01AZYEW.49.85.H08.1.454.CMB.1.raw
  modified_base (174)..(174): a, c, t, g, unknown or other
  misc_feature (174)..(174): n is a, c, g, or t
  modified_base (366)..(366): a, c, t, g, unknown or other
  misc_feature (366)..(366): n is a, c, g, or t
  modified_base (407)..(407): a, c, t, g, unknown or other
  misc_feature (407)..(407): n is a, c, g, or t
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagcccaccctnagtcgtccgtcgtccccaggacagacagccagcactcacctgcctcgtaggaagtaacgaaaggtttgggggaataaagtagtagcgtaggtcgtcggtatcgagacaggaacgtaccgacgccgaccgtcccgtgtggttcggtctatactatacaagtactaaccgacgccgtccgacgacggactccgngacgcgtactccgtcgtcgtcctaccgactcgacggtaacncacgcctactcgtacacctagcgacggcgaactcgacgtctacgtacgagtacggcgtacttagtaacgttacttacgtcggtacggtacggggtaccggtacggaccgtaccgggtacccgtcgggtaacgggttacgggggttaacggtccgggggaacgggtaacccggggtaaccacgggttcccgtaccgggttaacccggttacggtacggtaaccggtacccgttaaccggtaccgggtacccccggg

SEQ ID NO: 131766 - DNA, 538 bp, Homo sapiens
  misc_feature: GYAE6OF01AQRLZ.49.85.H08.1.454.CMB.1.raw
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaagttgggggataaatatagctggctggtatcagcagaagccaggccagtcccctgtgttggtcatctatcaagataccaagccggccctcgagggactccctgacgcgtatttctctggctccaactcgtacgggaacacgacgcccactctagaccatcaggcggactcgagctagcgatggagctgtactattacgtcgtcgaggtcggtgggacacggccgctacggtggggttattccggggacgggacgggaaccgaaggtccgtacggtacccggtccgtaggacgtccgacggtcccgtaacccggg

SEQ ID NO: 131767 - DNA, 843 bp, Homo sapiens
  misc_feature: GYAE6OF01C2KXY.49.85.H08.1.454.CMB.1.raw
  modified_base (156)..(156): a, c, t, g, unknown or other
  misc_feature (156)..(156): n is a, c, g, or t
tcagagtcgagagacacgaccggtgctcgatttagtatcactcagtcgcggggcgtgggcctcaggaagcagcatcggaggtgcctcagccatggcatggatccctctcttcctcggcgtccttgcttactgcacaggatccgtgcctctatgacnctgactcacgccacctcagtcgtccgtcgtcccgaggacacgacacgccagcatccaccgtcgcctcgtaggactaacgtaaaggtaggggtaactaaagtatgacgttacggtagttacggtactacgaagcaaggtaacgccgacggacctaccggtccccgttggttcggttacggtctaacgttacttaacgtaaccgtaaacgtaaccttaacccgaacgggtaccccggtaaccccggtacggaaccgggttaccgttaccccggtaacggttacggtaccggttatttaccccggttacggtccgggtaacccttaacccggtaaacggtttaccggtaaacggtaaaccctaacgtaacccggtacccttaaccggtccgttaaccggaccttaacgaccggtaaccggtacggggtaaccctaaccggtacgtaacgttaacggtaccggtaagttcgggaacggtttacgttaaccgttaacgttttacgttaccggtacgttaacgggtacgggttaacggtacgggtaaccgtccgggtaccggtaaccggttaacgggggttcccgggttaacgggtccggggtaaaccggggaaacgtaaccgggtaccgttaccggtaaccggtaccgttacggtacggaccggttaaccggaaccgtccccggtaaaccgg

SEQ ID NO: 131768 - DNA, 807 bp, Homo sapiens
  misc_feature: GYAE6OF01BD1MF.49.85.H08.1.454.CMB.1.raw
  modified_base (792)..(792): a, c, t, g, unknown or other
  misc_feature (792)..(792): n is a, c, g, or t
tcagagtcgagagacacgaccggtgctcgatttagtatcactcagtcgcggggctgggcctcaggaagcagcatcggaggtgcctcagccatggcagtgactcctcttccttccgcggtccttcgttcgtactttacgtcgacacgagtactccggtcggtcccttacctagtcggacgtcgttacgtacctacgacccgacccctacccgttagtacggtttccggtccggttacccgtaccccggaacggaaccgaacgaccgaccgaccgacgtcaaccgttacctaccgtcgttccgttacggtaaggaaccgtaaacggttaaaggggttacgggtaaactttaagttacgtcggtccggttggtacgttacggttactacggacgacgaaggacccgaccggtacgacccgttaccgtttccggtggtttacggttacgtactacttacgtaaccgtaaacgtaaacgaccgttaacggacccggtccggtacccgtaggtaccggtaccttccgggtagtacccggactttcgttacgtccgggtaccgtaccgtacctacggtacggtaacccggaactacggtacccgtccttaaccgtcgtaaccgacgtacgtacccggaccggtaccggtagaccggtacgtacctaggtacggtcgtagtaccggtatacgttacgttcgtaccgtggtaacgggcgtagtacgcgtacgcggtccgtaggggttggtaccggaccgggacgactacggcgttcggaccgttccgtaggacgtacccgngtccggccttacggg

SEQ ID NO: 131769 - DNA, 643 bp, Homo sapiens
  misc_feature: GYAE6OF01CP67F.49.85.H08.1.454.CMB.1.raw
  modified_base (219)..(219): a, c, t, g, unknown or other
  misc_feature (219)..(219): n is a, c, g, or t
  modified_base (298)..(298): a, c, t, g, unknown or other
  misc_feature (298)..(298): n is a, c, g, or t
  modified_base (627)..(627): a, c, t, g, unknown or other
  misc_feature (627)..(627): n is a, c, g, or t
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcactgctctgganacaagttggggataaatatgctggctggtatcgagcaagaacgccgaggccacgtcccctggtgttcggtacagtctanacaagactaaccgaagccgtccctagacggtactcccgagacggtccgtactttcgtcgtcggtacctaccgaaacgttccggagggaaacccaacgtccggtaaccctaccgttccgaacgtaacctaacgtaccgacgggaccgggtaacttccggaacggtacctagtacccgtagtacggacggtacctaggtaaacttacgtttacgtccggtacgtagggtccgttagggaaccgcggtcccggaagtaccgggttaggggtaccgttaccggggacggacgggtaacggacctacggtcgacccgtcgtacggtacgtaccnccggtcccgtaaccgg

SEQ ID NO: 131770 - DNA, 644 bp, Homo sapiens
  misc_feature: GYAE6OF01DC8DV.49.85.H08.1.454.CMB.1.raw
  modified_base (373)..(373): a, c, t, g, unknown or other
  misc_feature (373)..(373): n is a, c, g, or t
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgacacagccaccctcggtgtcagtcgtcccaggaccagacgccaggatcaccttgtttggagatacgttacgaaaggatagtggtcattggtaccagcaagaagacgaggccaggcccctgtcttggtggtataataaagcagtgacgacggcctacgagggtactcccgtgacgtcgtattctcgtggctaccgagctacgaagggacaaacgngttacacgttagacctatcgaagttcggacgtccgaaggctaaggaacgaacggacgcgtacgtaacttaacgttatacgtactaagtacacgacgtaacgacgtacccgggttagttaaccgttggtacggggttagttaccggggacgggtaaacggggtaactacggtccgtacgggtaacccgttaccggtaacgggtaccgaaccgaccccgggaagttcccccggtacggacccccccgtttaccgggcttacccgtttccccgg

SEQ ID NO: 131771 - DNA, 626 bp, Homo sapiens
  misc_feature: GYAE6OF01BTYQL.49.85.H08.1.454.CMB.1.raw
  modified_base (222)..(222): a, c, t, g, unknown or other
  misc_feature (222)..(222): n is a, c, g, or t
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcacgccaccctcagtgtccgtcgtccccaggacagacagccagcatcacctgctctgganacaaagttgggggaataaagtatgctggctggtatcgagacaagacgccgaggcctacgtccccgtgttggttcggtactatactatacaagtactaaccgaacgccggaccctacgacgggtacctcccgtaggacgtcgtactttccgtacgtcggtcctacccgtaacgtcggtacggaacacgacgccactcgtacgaccagtcgacggaccggactacgacggtactacgtcgtagtcggacgtactacgtacgttattacggtcgtacgtagggtccggtagggaccgacggcccggtacgtacgggttcgggtacggttccggggacgggtaaccgggaacacgggtcgtaccggtaccggttccgaagggtaccgtacgaccggcccgtaaccggg

SEQ ID NO: 131772 - DNA, 770 bp, Homo sapiens
  misc_feature: GYAE6OF01C0NJ1.49.85.H08.1.454.CMB.1.raw
  modified_base (219)..(219): a, c, t, g, unknown or other
  misc_feature (219)..(219): n is a, c, g, or t
  modified_base (246)..(246): a, c, t, g, unknown or other
  misc_feature (246)..(246): n is a, c, g, or t
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtcgtccgtcgtccccgagacagacagccagcatccactgctcgnggatacgaaagttggggaataaatatnacgtggcttggtatcagcaacgaacgtccgacggccctacgttccccttggtcgtttcggtactacgtactaactacgaaacgtaactaaacccgaacggtacccgggtaccctacgggaaccggtaccgttaccccgtacgggtaaaccggcggtttacctttacgttacccggtaccggtacccccttaacccgttaaaaccgttaccggttaaaccgggaaacccgaaacccgccggtaaaccccgtaccgttacccgtaacccgtacccgtaaaccgttacggaaccgggtaaccgggtaccgtaacggaccgttactacggtacgaacggttacggtacggtacttacgttaacgtttagtaccgttacggtacgtacgggtaccggttagaccggacggacccgtacggtaacgggttacggggtacgtccggggaacgggtaaccggaacgtaccgggccggttaaccgtacccggtaccggtaagtaccggtaaccgccgacccggttaacccggg

SEQ ID NO: 131773 - DNA, 757 bp, Homo sapiens
  misc_feature: GYAE6OF01CHG6C.49.85.H08.1.454.CMB.1.raw
  modified_base (257)..(257): a, c, t, g, unknown or other
  misc_feature (257)..(257): n is a, c, g, or t
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcacgcccaccctcagtcgtccgtcgtccccaggacagacagccagcatcactgctcgtggagacaaagttagggggaataaagtatgacgtcggntggtatcgagcgaagaacgccgacggccacgtccctggttcgttcgactacgtctactacaaacgtactaaccgaacggccggtaccctacggaacggggtactcccgtagacgtaccgttatttccgtcgtcggtaccttacccgaaccgttacggtaacgggaaacctaccggaacgtccccctaacgttccgtaccgtaaccctaagttacccggaacggggtacccgggttaactaccgggtaacggtaaccctaggttaccggaacggttacggaccgggtattaccggtaaaccgttttaagttaccgttccgggtaacggggttaccgggaccggggtttacgggaacccaccgggtccccggtaaggtaccggggttacgggggtttaccgtaccggggggaacggggtaacccgggaacgaacggtccccggttacggacccggttcccggaggtaacccgaccgaccccggggtaacccgtaacccgggg

SEQ ID NO: 131774 - DNA, 628 bp, Homo sapiens
  misc_feature: GYAE6OF01CLRF5.49.85.H08.1.454.CMB.1.raw
  modified_base (156)..(156): a, c, t, g, unknown or other
  misc_feature (156)..(156): n is a, c, g, or t
  modified_base (194)..(194): a, c, t, g, unknown or other
  misc_feature (194)..(194): n is a, c, g, or t
  modified_base (222)..(222): a, c, t, g, unknown or other
  misc_feature (222)..(222): n is a, c, g, or t
  modified_base (241)..(241): a, c, t, g, unknown or other
  misc_feature (241)..(241): n is a, c, g, or t
  modified_base (292)..(292): a, c, t, g, unknown or other
  misc_feature (292)..(292): n is a, c, g, or t
  modified_base (298)..(299): a, c, t, g, unknown or other
  misc_feature (298)..(299): n is a, c, g, or t
  modified_base (336)..(336): a, c, t, g, unknown or other
  misc_feature (336)..(336): n is a, c, g, or t
  modified_base (418)..(418): a, c, t, g, unknown or other
  misc_feature (418)..(418): n is a, c, g, or t
  modified_base (448)..(448): a, c, t, g, unknown or other
  misc_feature (448)..(448): n is a, c, g, or t
tcagagtcgagagacacgaccggtgctcgatttagtatcactcagtcgcggggctgggcctcaggaagcaggcatcggagtgcctcagccatgcatgatccctctcttccgtcggcgtccttgcttactgcactggatccgtggcctcctatgagntgactcagccaccctcagtcgtccgtcgtacccagacngacacgccagcatccacctgctctgganacgaagtggggataaagtntgctggctaggtatcagcgagacgccgacgaccacgtccctagtgtggtcngtctannaagtacactacgcgcctagacgctccgtagcgtactntctcgtagtcctaccacgtgtaccggacacgtacaccctactcgtacaccaacgtcgacgacggtactacggacgtctacgngtacgtagacgtctagaactttgttaccgngtacggtacggcggttacggaaccgcggtaccggtaccggttaacgggggtaccgggggttaggtcccggggggaaacgggtacccgggaaacccgtacggggttctaaaccccgggttccccgttacgggtttcggaaacccggtcccgggttaacccggaccccgggttaaccccggg

SEQ ID NO: 131775 - DNA, 762 bp, Homo sapiens
  misc_feature: GYAE6OF01ATNX9.49.85.H08.1.454.CMB.1.raw
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagcccaccctcagtgtccgtgtccccaggacagacagccagcatcacctgctctggagacaagttgggggataaatatgctggctggtatcagcagaagccaggccagtcccctgtgttggtctagtctatcaagactaaccgaaaggccggccctacgacgggactcccgtgacgcgtattcctcgtcggtcctaccaaacgttccgtacgggaaaccaccgtaacgccctaacctccgttacggaacccctacgtacccaacggttacccggggtaacctaccggacgggtaccttaacgttaccggaacgttacgggacggtacgttacgtaactttaacgtttaccgttacgggttaccggtaaggggtacccgggtttaggggaacccgtacccgggtacccggtaccggtaacggggtttaccggggggtttaaccgggttcccggggggtaaccgggggtaacccgggggtaaaccccggtaaacgggttaccccgggttaaccggggttaacccccccgggttacccgttacgggggtaacccggttacccggtaaaccccggggtaccccccgttaaaacccccgggggg

SEQ ID NO: 131776 - DNA, 810 bp, Homo sapiens
  misc_feature: GYAE6OF01B0TE1.49.85.H08.1.454.CMB.1.raw
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagcccaccctcagtcgtccgtcgtccccaggacagacagccagcatccacctgctcgtaggagaacgaaaggttagggggaataaatagtgtacgttggcgtggtatacgacgacgaacgaacgccgacggacccgtaccggtcccgttggttcggtttacggtactattacgttaactacgtaaacgtaaccgtaaccgtaaaccggggtcccgtacccgtaccggtaaaccgggggtaccttaccccggtacgggaaccgtcgttacgtttccgtaccggtcgtacccgtacccgtaacgtcgtaacgggaaccaccgtaccggtacctaccttacccgacgtaaccgtacgtaaccgggtaccggggtacggtaacttaccgggaacggtacgttaacccggtggtaaacgggtttacggaaccggttaccggtttaaacgtaacgttttaaacgtttcgggtaccgggtaacgggtacggggttacccgggacggggtaaccctccggggtaccggttactacccggggggtttaaagggtcccgggtacgggggtacggggaacccggaccgggtaacgttccccgggtaaccgccgggttacgccggttaaacgggcctaacgggtaccccgtaacccggg

SEQ ID NO: 131777 - DNA, 722 bp, Homo sapiens
  misc_feature: GYAE6OF01EI84F.49.85.H08.1.454.CMB.1.raw
  modified_base (542)..(542): a, c, t, g, unknown or other
  misc_feature (542)..(542): n is a, c, g, or t
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtcgcctcctatgagctgactcacgccaccctcagtcgtccgtcgtccccgaggacagacacgccagcactccacctcgctacgtagggaacgaacgtaaaggttacgggggaaattaaaagtagtgtaccgtggtacgttggttaactcgaacgacgaaacgaacgcccgaacggtcccgtaaccggttccccgttggttcggtttcggtactacgttacttaactacgtaaacgtaactaaccgacggccggacccgtacgacggtacctccgtagacgtacgtacttctacgtcgtacctaccgtaacgtcggtaacggtaacaccgacgtacctaccgtaccacgacctacggtacgacgggaccgtactaccggtacgtacttaagtaccggtagnggtaccggtacgtataacgttttaacgtaccgttacgggtacggacgggttccggtaacggggacctaaccgggtcccgggtaggtacgggttcggggttaacccggtggggaccggaacggtacccgaggttacccgtacggtacccgtcgtaggaccgtcgaacccgtccgtacccgg
